US012297428B2

(12) United States Patent
Chen et al.

(10) Patent No.: US 12,297,428 B2
(45) Date of Patent: May 13, 2025

(54) COMPOSITIONS FOR IDENTIFICATION OF MEMBRANE TARGETS FOR ENHANCEMENT OF T CELL ACTIVITY AGAINST CANCER

(71) Applicant: YALE UNIVERSITY, New Haven, CT (US)

(72) Inventors: Sidi Chen, Milford, CT (US); Lupeng Ye, New Haven, CT (US); Jonathan Park, Scott AFB, IL (US); Matthew Dong, San Francisco, CA (US); Ryan D. Chow, San Jose, CA (US)

(73) Assignee: Yale University, New Haven, CT (US)

( * ) Notice: Subject to any disclaimer, the term of this patent is extended or adjusted under 35 U.S.C. 154(b) by 1063 days.

(21) Appl. No.: 17/264,691

(22) PCT Filed: Jul. 31, 2019

(86) PCT No.: PCT/US2019/044424
§ 371 (c)(1),
(2) Date: Jan. 29, 2021

(87) PCT Pub. No.: WO2020/028533
PCT Pub. Date: Feb. 6, 2020

(65) Prior Publication Data
US 2022/0340898 A1 Oct. 27, 2022

Related U.S. Application Data

(60) Provisional application No. 62/805,585, filed on Feb. 14, 2019, provisional application No. 62/713,217, filed on Aug. 1, 2018.

(51) Int. Cl.
| | |
|---|---|
| *C12N 15/86* | (2006.01) |
| *A61K 40/11* | (2025.01) |
| *A61K 40/31* | (2025.01) |
| *A61K 40/42* | (2025.01) |
| *C12N 15/11* | (2006.01) |
| *C12N 15/90* | (2006.01) |

(52) U.S. Cl.
CPC ............ *C12N 15/111* (2013.01); *A61K 40/11* (2025.01); *A61K 40/31* (2025.01); *A61K 40/42* (2025.01); *A61K 40/4204* (2025.01); *C12N 15/90* (2013.01); *A61K 2239/31* (2023.05); *A61K 2239/47* (2023.05); *C12N 2310/20* (2017.05); *C12N 2800/90* (2013.01); *C12Y 204/01155* (2013.01); *C12Y 503/04001* (2013.01)

(58) Field of Classification Search
None
See application file for complete search history.

(56) References Cited

U.S. PATENT DOCUMENTS

| 2009/0178153 A1 | 7/2009 | Gaitanaris | |
| 2013/0004983 A1* | 1/2013 | Matsunami | C07K 14/70571 435/369 |
| 2016/0355806 A1 | 12/2016 | Lee | |
| 2018/0156800 A1* | 6/2018 | Lin | G01N 33/5017 |

FOREIGN PATENT DOCUMENTS

| WO | WO-2013173652 A1 * | 11/2013 | ......... A61K 31/7115 |
| WO | 2017046259 | 3/2017 | |
| WO | WO-2017046259 A1 * | 3/2017 | ............. C12N 15/90 |
| WO | 2017064566 | 4/2017 | |
| WO | WO-2018195073 A2 * | 10/2018 | ........... C12N 15/111 |

OTHER PUBLICATIONS

Chow et al Nat Neurosci vol. 20 No 10 pp. 1329-1341 (pp. 1-40) (Year: 2017).*
Chow et al Nature Neuroscience, 1329-1341 (Year: 2017).*
Shifrut et al Cell, 175, 1958-1971 (Year: 2018).*
NCBI accession No. AF287263.1, p. 1 (Year: 2001).*
International Search Report and Written Opinion issued in App. No. PCT/US19/44424, mailing date Jan. 6, 2020, 18 pages.
Agarwalla, Pankaj, et al. "Sequential immunotherapy by vaccination with GM-CSF expressing glioma cells and CTLA-4 blockade effectively treats established murine intracranial tumors." Journal of Immunotherapy (Hagerstown, Md.: 1997) 35.5 (2012): 385.
Anderson, A. C., et al. "Lag-3, Tim-3, and TIGIT: co-inhibitory receptors with specialized functions in immune regulation." Immunity 44.5 (2016): 989-1004.
Brown, Christine E., et al. "Regression of glioblastoma after chimeric antigen receptor T-cell therapy." New England Journal of Medicine 375.26 (2016): 2561-2569.
Chen, Daniel S., et al. "Oncology meets immunology: the cancer-immunity cycle." immunity 39.1 (2013): 1-10.
Chen, Runqiang, et al. "In vivo RNA interference screens identify regulators of antiviral CD4+ and CD8+ T cell differentiation." Immunity 41.2 (2014): 325-338.
Chen, Sidi, et al. "Genome-wide CRISPR screen in a mouse model of tumor growth and metastasis." Cell 160.6 (2015): 1246-1260.
Dai, Hanren, et al. "Chimeric antigen receptors modified T-cells for cancer therapy." Journal of the National Cancer Institute 108.7 (2016): djv439.

(Continued)

*Primary Examiner* — Anoop K Singh
(74) *Attorney, Agent, or Firm* — Saul Ewing, LLP; Kathryn Doyle; Lukas Pfannenstiel

(57) ABSTRACT

The present invention includes compositions and methods for identification of membrane targets for enhancement of T cell activity against a disease, disorder or condition, and/or enhancing T cell anti-tumor activity in a subject in need thereof. In some embodiments, the disease is cancer. In further embodiments, the cancer is glioblastoma (GBM) or breast cancer.

1 Claim, 70 Drawing Sheets

Specification includes a Sequence Listing.

(56) References Cited

OTHER PUBLICATIONS

Fecci, Peter E., et al. "Systemic CTLA-4 blockade ameliorates glioma-induced changes to the CD4+ T cell compartment without affecting regulatory T-cell function." Clinical cancer research 13.7 (2007): 2158-2167.
Gilbert, Mark R., et al. "A randomized trial of bevacizumab for newly diagnosed glioblastoma." New England Journal of Medicine 370.8 (2014): 699-708.
Huang, Ching-Tai, et al. "Role of LAG-3 in regulatory T cells." Immunity 21.4 (2004): 503-513.
Ji, Seung Taek, et al. "Promising therapeutic strategies for mesenchymal stem cell-based cardiovascular regeneration: from cell priming to tissue engineering." Stem cells international 2017 (2017).
Jiang, Peng, et al. "Signatures of T cell dysfunction and exclusion predict cancer immunotherapy response." Nature medicine 24.10 (2018): 1550-1558.
Khalil, Danny N., et al. "The future of cancer treatment: immunomodulation, CARs and combination immunotherapy." Nature reviews Clinical oncology 13.5 (2016): 273-290.
Koboldt, Daniel C., et al. "VarScan: variant detection in massively parallel sequencing of individual and pooled samples." Bioinformatics 25.17 (2009): 2283-2285.
Kvistborg, Pia, et al. "Anti-CTLA-4 therapy broadens the melanoma-reactive CD8+ T cell response." Science translational medicine 6.254 (2014): 254ra128-254ra128.
Langmead, Ben, et al. "Ultrafast and memory-efficient alignment of short DNA sequences to the human genome." Genome biology 10.3 (2009): 1-10.
Li, Heng, et al. "Fast and accurate short read alignment with Burrows-Wheeler transform." bioinformatics 25.14 (2009):1754-1760.
Li, Bo, et al. "Comprehensive analyses of tumor immunity: implications for cancer immunotherapy." Genome biology 17.1 (2016): 1-16.
Louveau, Antoine, et al. "Structural and functional features of central nervous system lymphatics." Nature (2015): 7560, 337-341. Author Manuscript, HHS Public Access, Available in PMC Jan. 16, 2016. doi: 10.1038/nature 14432.
Martin, Marcel. "Cutadapt removes adapter sequences from high-throughput sequencing reads." EMBnet. journal 17.1 (2011): 10-12.
Mates, Lajos, et al. "Molecular evolution of a novel hyperactive Sleeping Beauty transposase enables robust stable gene transfer in vertebrates." Nature genetics 41.6 (2009): 753-761.
Mathios, Dimitrios, et al. "Anti-PD-1 antitumor immunity is enhanced by local and abrogated by systemic chemotherapy in GBM." Science translational medicine 8.370 (2016): 370ra180-370ra180. Author Manuscript, HHS Public Access, available in PMC Dec. 11, 2017. doi: 10.1126/scitranslmed.aag2942.
Mount, Christopher W., et al. "Potent antitumor efficacy of anti-GD2 Car T cells in H3-K27M+ diffuse midline gliomas." Nature medicine 24.5 (2018): 572-579. Author Manuscript, HHS Public Access, available in PMC Nov. 2, 2018. doi: 10.1038/s41591-018-0006-x.
Okada, Masahiro, et al. "Blockage of core fucosylation reduces cell-surface expression of PD-1 and promotes anti-tumor immune responses of T cells." Cell reports 20.5 (2017): 1017-1028.
Omuro, Antonio, et al. "Nivolumab with or without ipilimumab in patients with recurrent glioblastoma: results from exploratory phase I cohorts of CheckMate 143." Neuro-oncology 20.5 (2018): 674-686.
O'Rourke, Donald M., et al. "A single dose of peripherally infused EGFRvIII-directed CAR T cells mediates antigen loss and induces adaptive resistance in patients with recurrent glioblastoma." Science translational medicine 9.399 (2017): eaaa0984. Author Manuscript, HHS Public Access, available in PMC Jan. 19, 2018. doi: 10.1126/scitranslmed.aaa0984.

Pardoll, Drew M. "The blockade of immune checkpoints in cancer immunotherapy." Nature reviews cancer 12.4 (2012): 252-264.
Pellegatta, Serena, et al. "Constitutive and TNFα-inducible expression of chondroitin sulfate proteoglycan 4 in glioblastoma and neurospheres: Implications for CAR-T cell therapy." Science translational medicine 10.430 (2018): eaao2731.
Preusser, Matthias, et al. "Prospects of immune checkpoint modulators in the treatment of glioblastoma." Nature Reviews Neurology 11.9 (2015): 504-514.
Ribas, Antoni. "Tumor immunotherapy directed at PD-1." N Engl J Med 366.26 (2012): 2517-2519.
Ribas, Antoni, et al. "Pembrolizumab versus investigator-choice chemotherapy for ipilimumab-refractory melanoma (KEYNOTE-002): a randomised, controlled, phase 2 trial." The lancet oncology 16.8 (2015): 908-918.
Saha, Dipongkor, et al. "Macrophage polarization contributes to glioblastoma eradication by combination immunovirotherapy and immune checkpoint blockade." Cancer cell 32.2 (2017): 253-267.
Shalem, Ophir, et al. "Genome-scale CRISPR-Cas9 knockout screening in human cells." Science 343.6166 (2014): 84-87.
Shibui, Akiko, et al. "Alteration of immune responses by N-acetylglucosaminyltransferase V during allergic airway inflammation." Allergology International 60.3 (2011): 345-354.
Shifrut, Eric, et al. "Genome-wide CRISPR screens in primary human T cells reveal key regulators of immune function." Cell 175.7 (2018): 1958-1971.
Smith, Logan K., et al. "Interleukin-10 directly inhibits CD8+ T cell function by enhancing N-glycan branching to decrease antigen sensitivity." Immunity 48.2 (2018): 299-312.
Sugiura, Kanematsu, C., et al. "Studies in a tumor spectrum. II. The growth of a variety of mouse and rat tumors." Cancer 5.5 (1952): 979-991.
Tumeh, Paul C., et al. "PD-1 blockade induces responses by inhibiting adaptive immune resistance." Nature 515.7528 (2014): 568-571.
Wang, Guangchuan, et al. "Mapping a functional cancer genome atlas of tumor suppressors in mouse liver using AAV-CRISPR—mediated direct in vivo screening." Science advances 4.2 (2018): eaao5508.
Weller, Michael, et al. "EANO guideline for the diagnosis and treatment of anaplastic gliomas and glioblastoma." The lancet oncology 15.9 (2014): e395-e403.
Workman, Creg J., et al. "Cutting edge: molecular analysis of the negative regulatory function of lymphocyte activation gene-3." The Journal of Immunology 169.10 (2002): 5392-5395.
Workman, Creg J., et al. "Lymphocyte activation gene-3 (CD223) regulates the size of the expanding T cell population following antigen activation in vivo." The Journal of Immunology 172.9 (2004): 5450-5455.
Zhou, Penghui, et al. "In vivo discovery of immunotherapy targets in the tumour microenvironment." Nature 506.7486 (2014): 52-57.
Hogquist, K.A., et al., "T-Cell Receptor Antagonist Peptides Induce Positive Selection". Cell 76, 17-27 (1994).
Schlager, C., et al., "Effector T-cell trafficking between the leptomeninges and the cerebrospinal fluid", Nature 530, 349-+ (2016).
Bernards, R., "Finding effective cancer therapies through loss of function genetic screens", Current Opinion in Genetics & Development 24, 23-29 (2014).
Ting, P.Y., et al., "Guide Swap enables genome-scale pooled CRISPR-Cas9 screening in human primary cells", Nat Methods 15, 941-946 (2018).
Demetriou, M., et al., "Negative regulation of T-cell activation and autoimmunity by Mgat5 N-glycosylation", Nature 409, 733-739 (2001).
Granovsky, M., et al., "Suppression of tumor growth and metastasis in Mgat5-deficient mice.", Nat Med 6, 306-312 (2000).

* cited by examiner

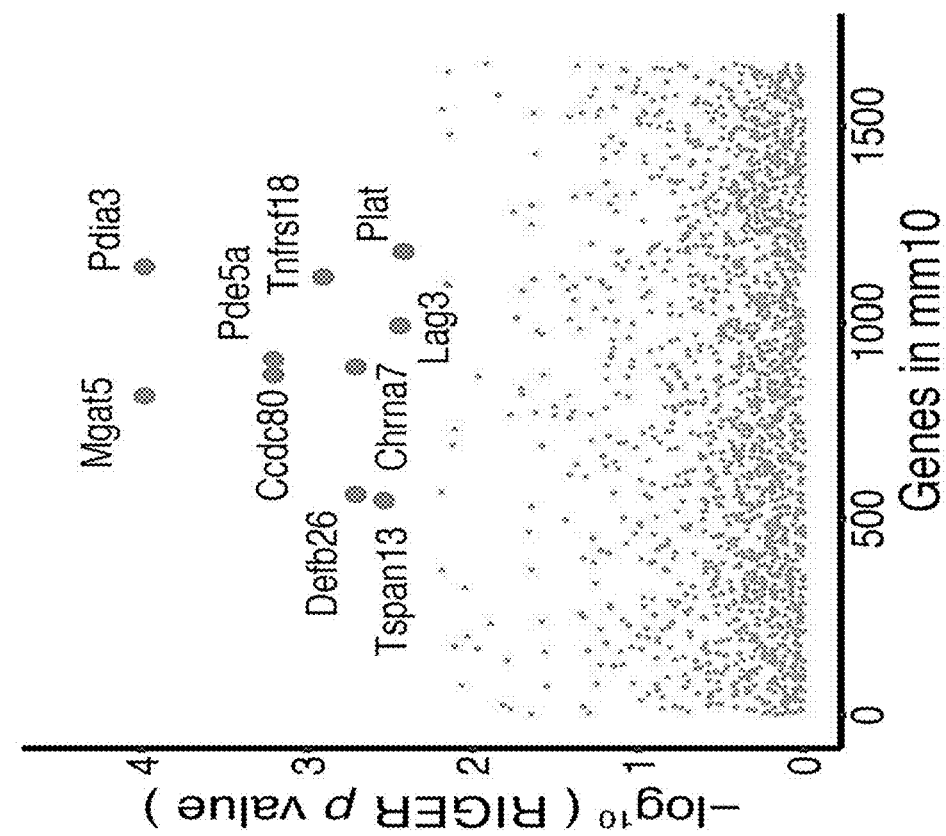
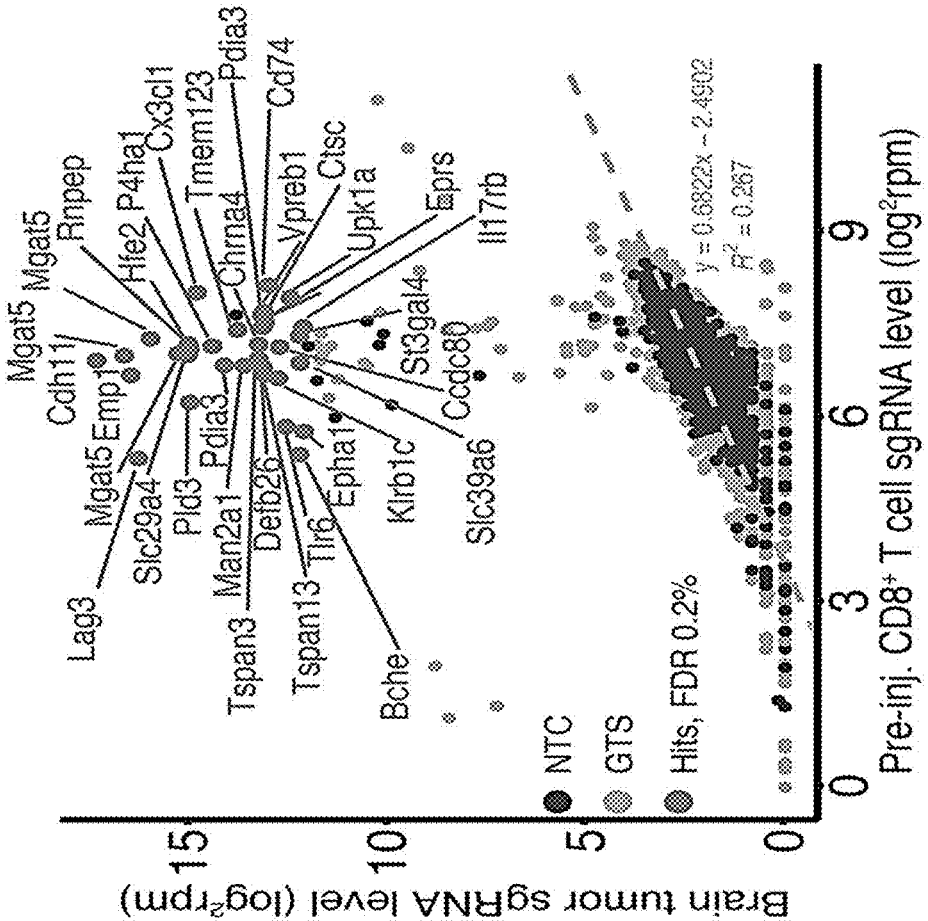
FIG. 1E
FIG. 1D

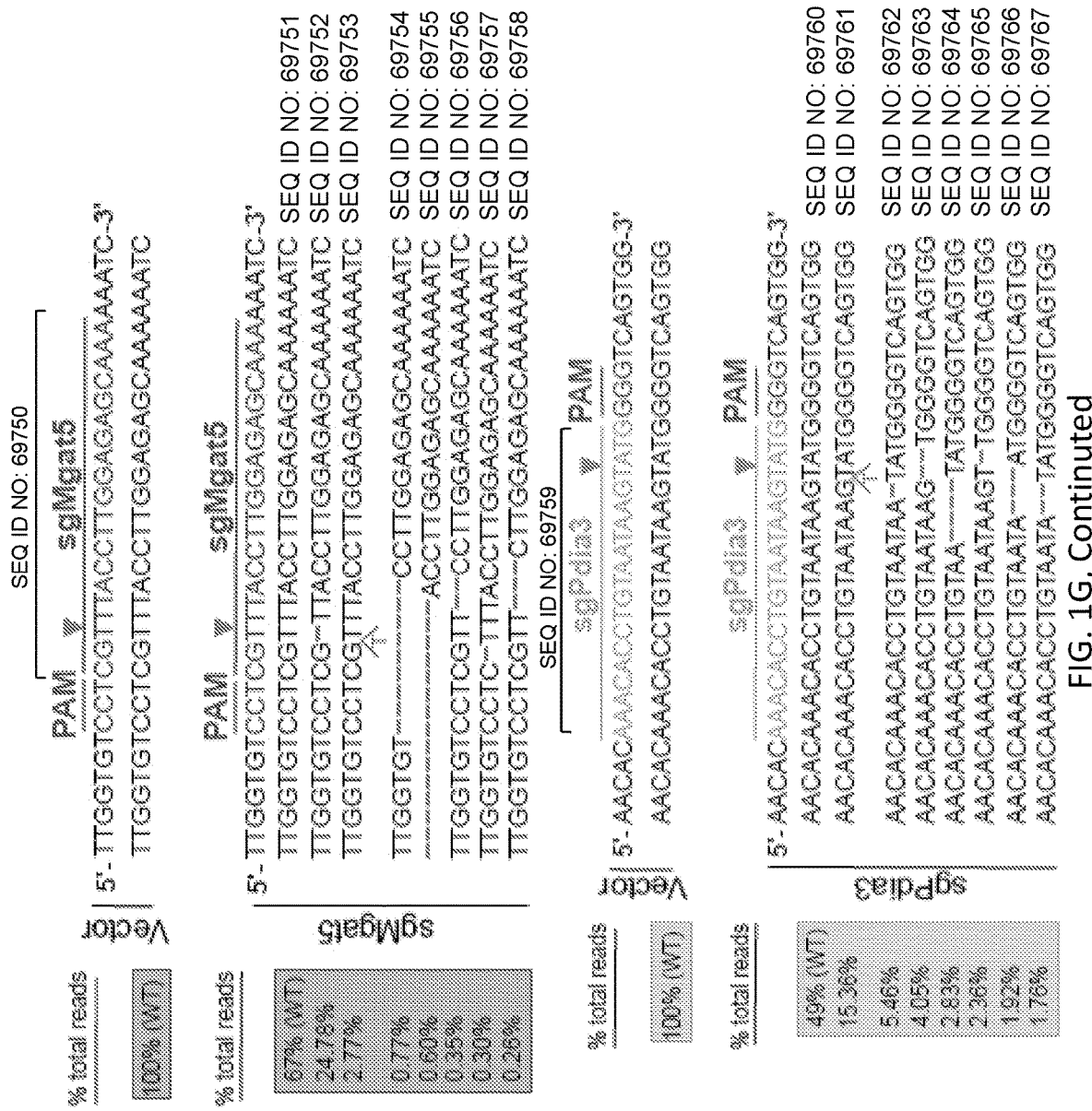
FIG. 1G, Continued

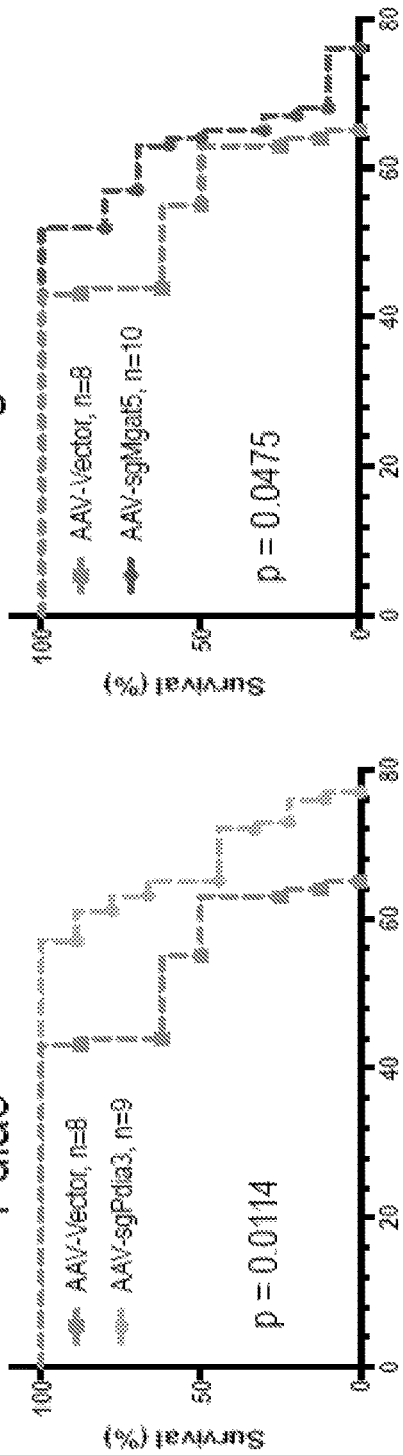
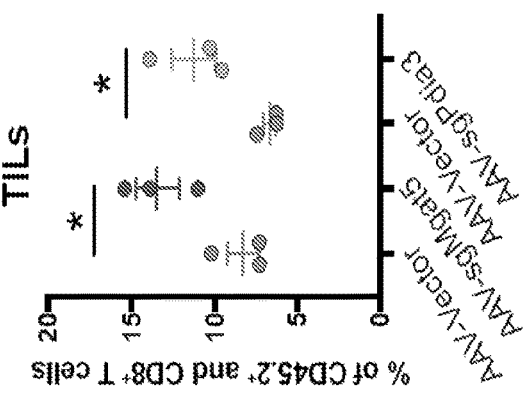
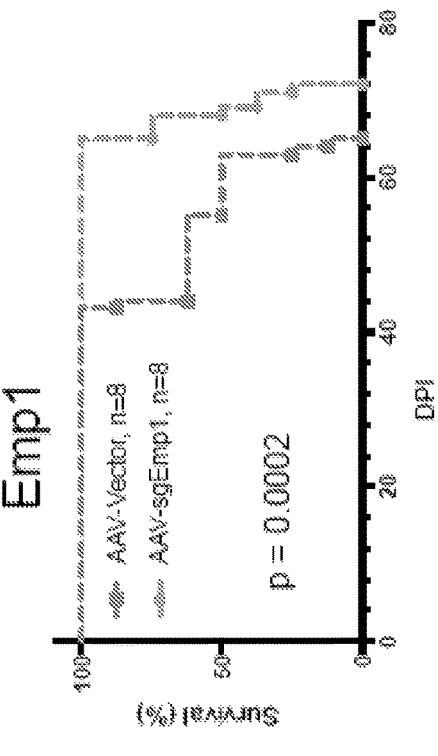
FIG. 1I
FIG. 1J
FIG. 1K
FIG. 1L

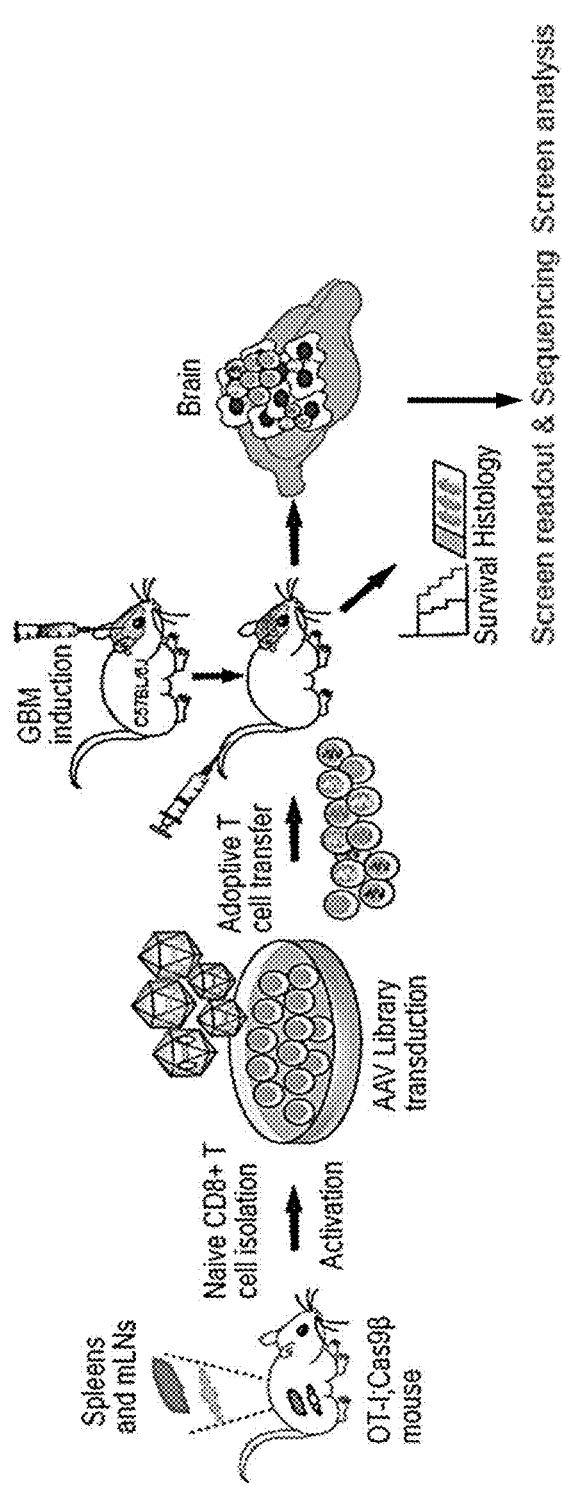
FIG. 2A
FIG. 2B
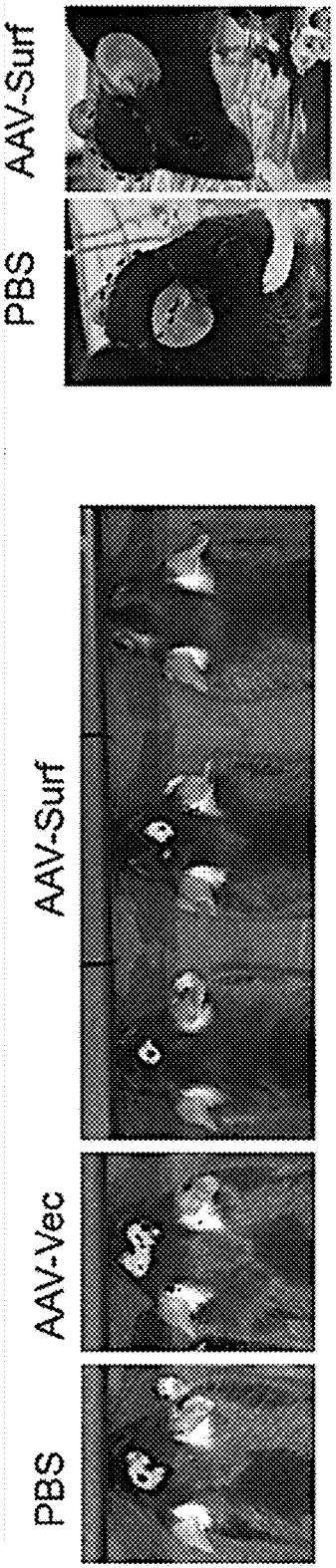
FIG. 2C

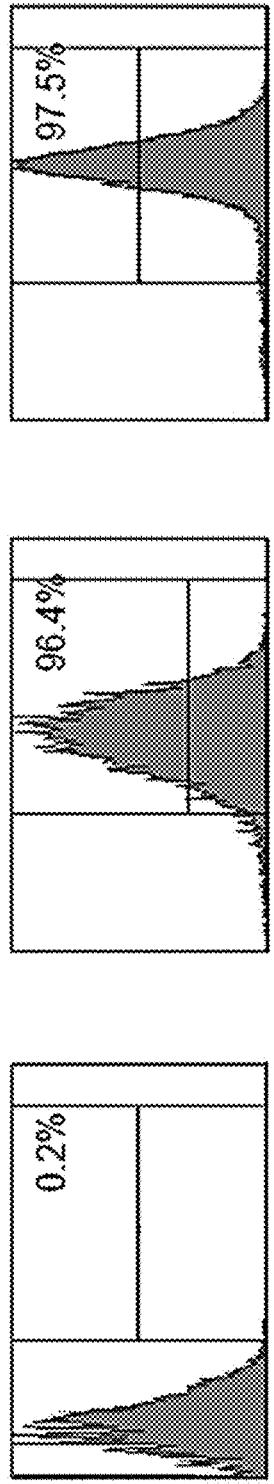
FIG. 3A
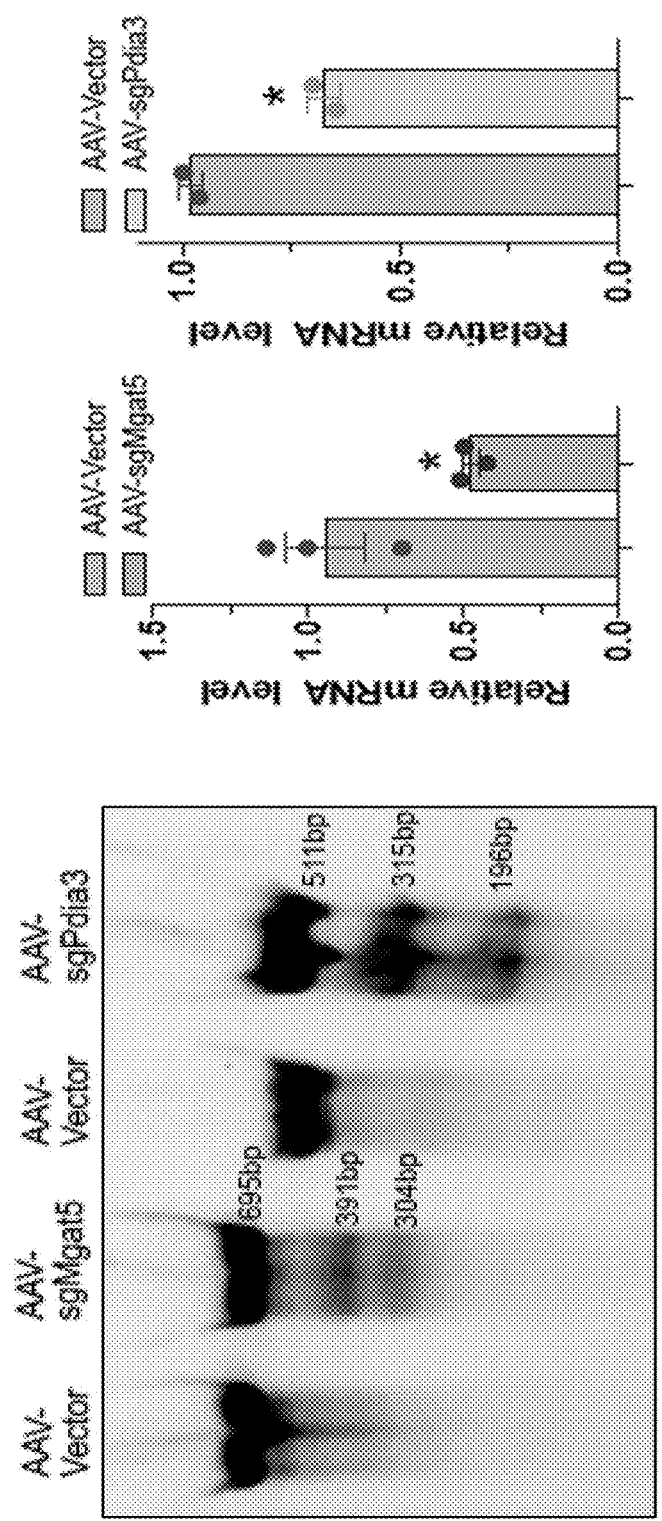
FIG. 3B
FIG. 3C

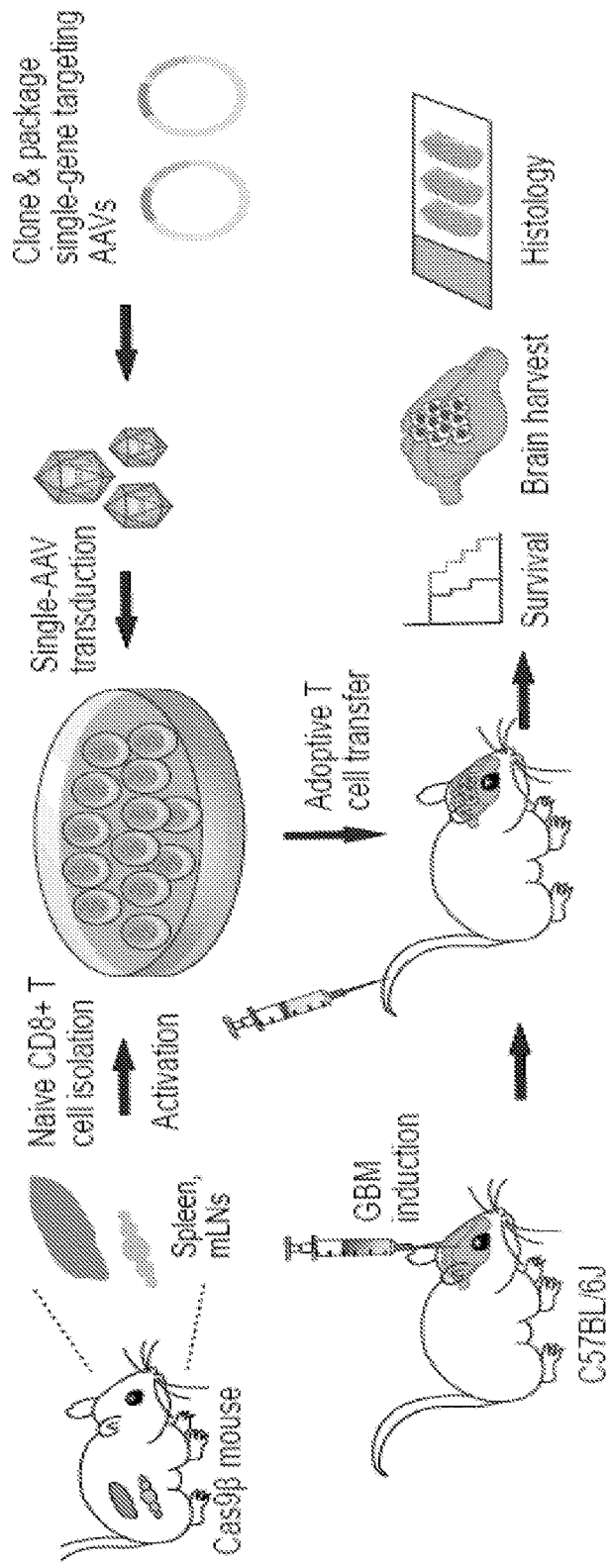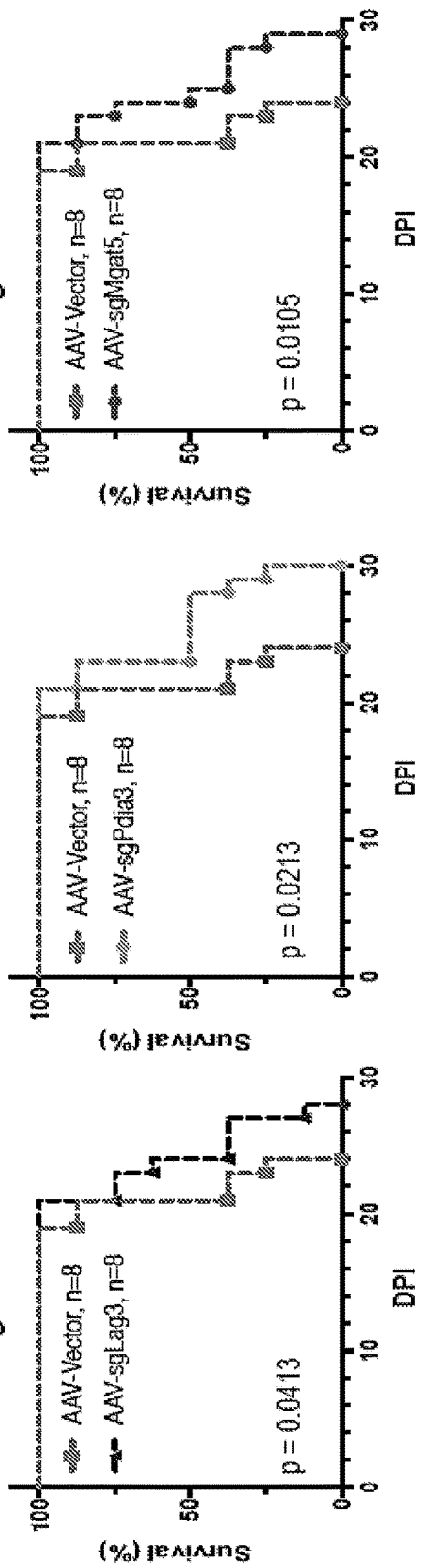
FIG. 3F
FIG. 3G

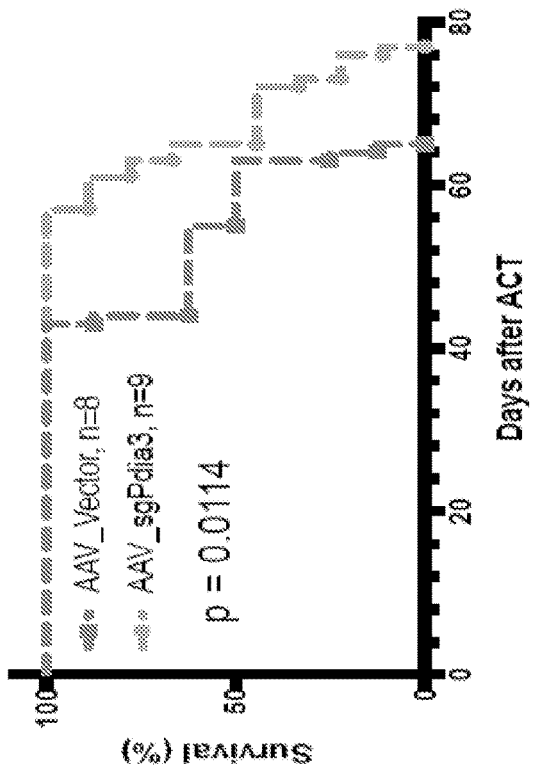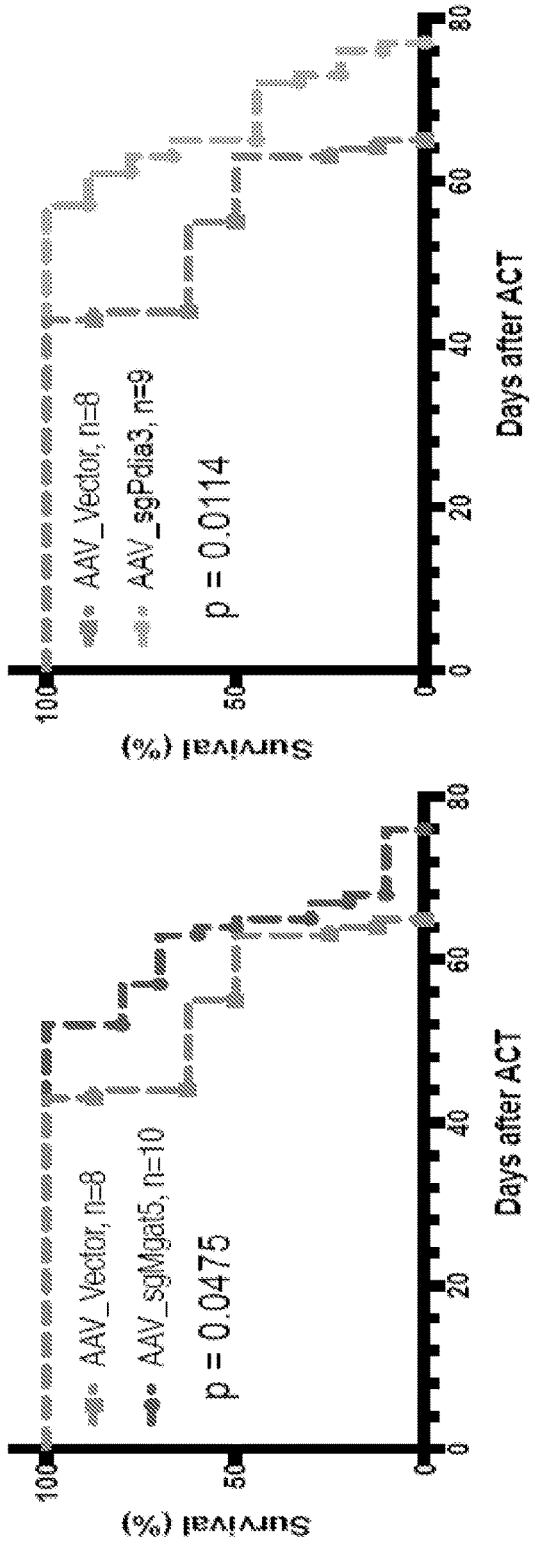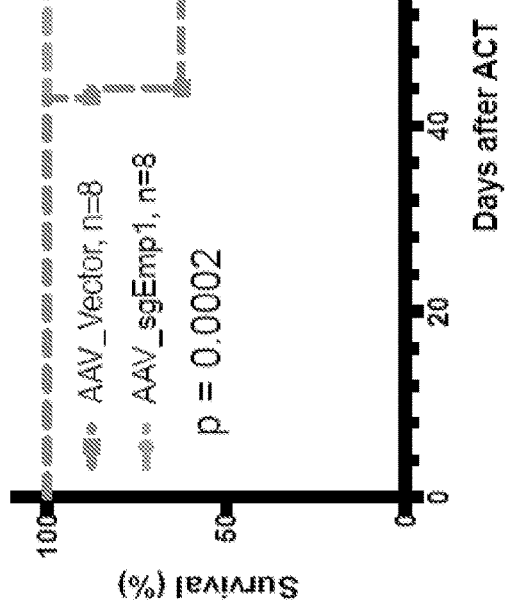
FIG. 5C
FIG. 5D
FIG. 5E

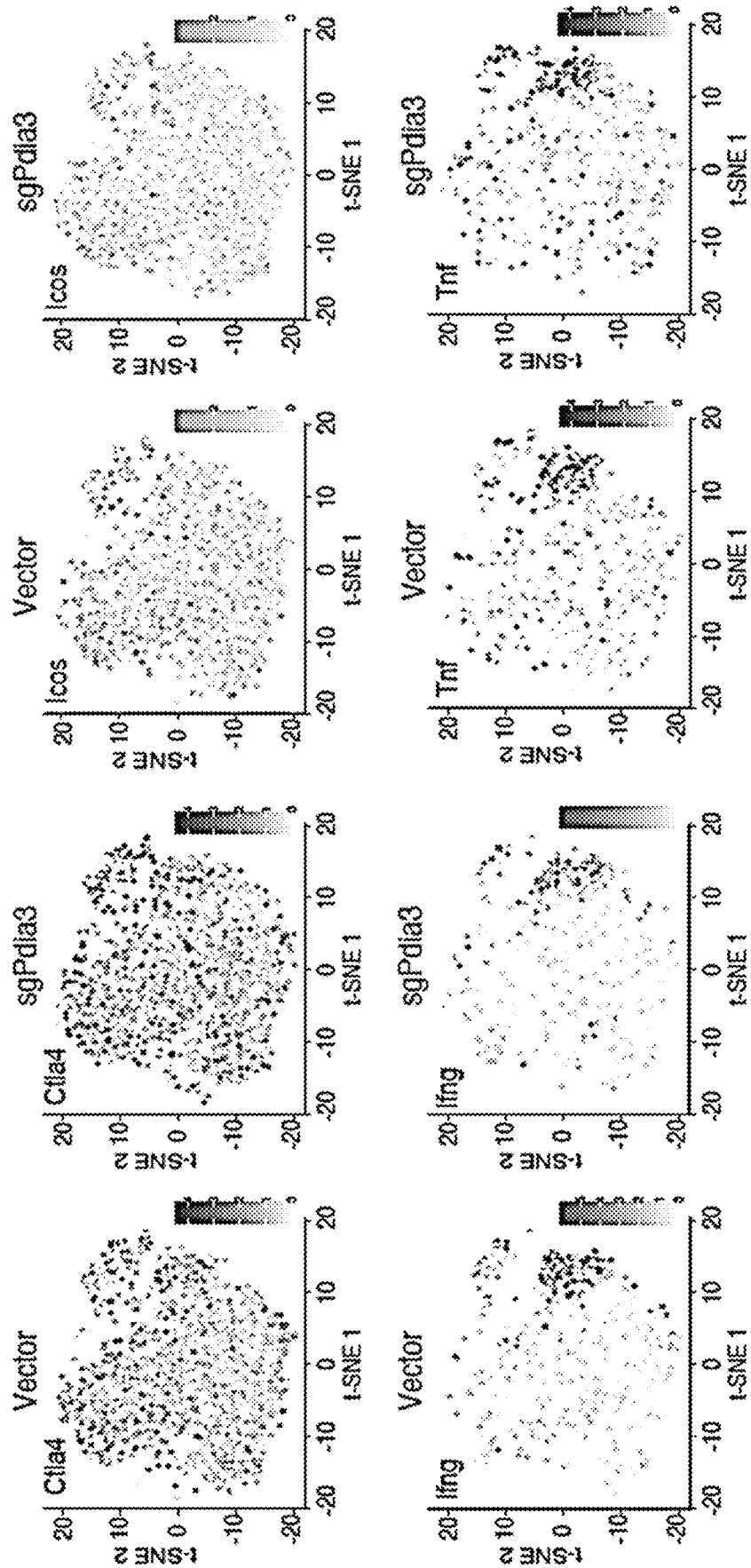
FIG. 9, Continued

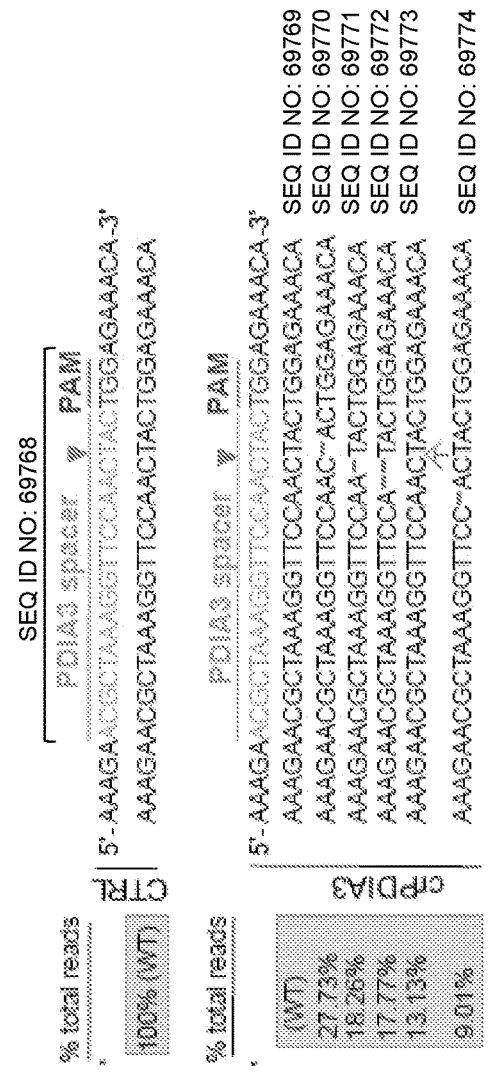
FIG. 11C
FIG. 11B
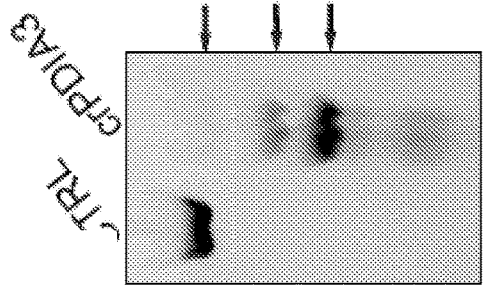
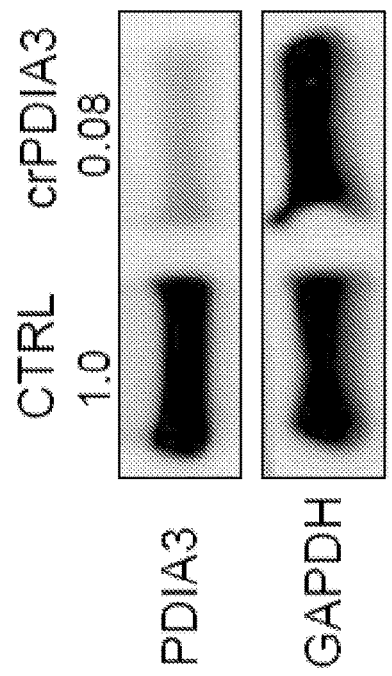
FIG. 11D

Representative SB transposon integration sites

| | Genomic sequence | SB transposon (IR/DR) | |
|---|---|---|---|
| Chr5 | 5'-TAAAAACTATTTTATCAAATACAGTT | GAAGTGGGAAGTTTA-3' | SEQ ID NO: 69799 |
| Chr6 | 5'-TAAAACTATTATCTGATAACTACAGTT | GAAGTGAAGTCGGAAGTTTA-3' | SEQ ID NO: 69800 |
| Chr10 | 5'-GCTTTCAATACATCCTGTTTACAGTT | GAAGTCGGAAGTTTA-3' | SEQ ID NO: 69801 |
| Chr9 | 5'-TTCACGGCGACTACTGCACTTACAGTT | GAAGTGGGAAGTTTA-3' | SEQ ID NO: 69802 |
| Chr14 | 5'-GGATGGGTACAAGATGAGTATACAGTT | GAAGTGAAGTGGGAAGTTTA-3' | SEQ ID NO: 69803 |
| Chr9 | 5'-TCACCCTCTCCAACCAGCCCTACAGTT | GAAGTTCGGAAGTTTA-3' | SEQ ID NO: 69804 |

FIG. 17D

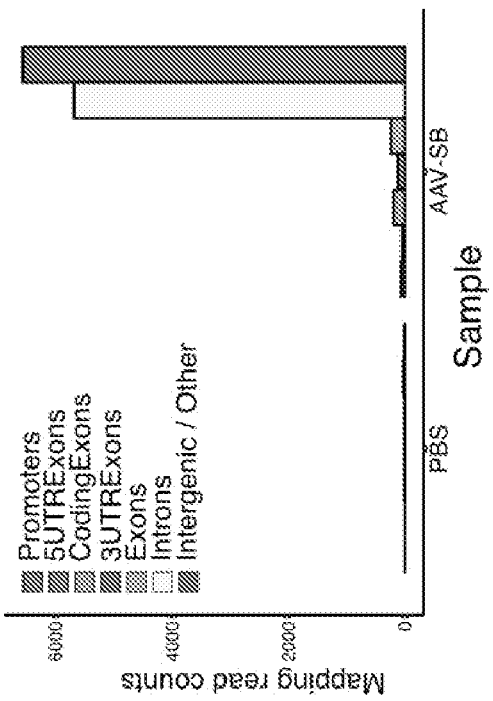

FIG. 17F

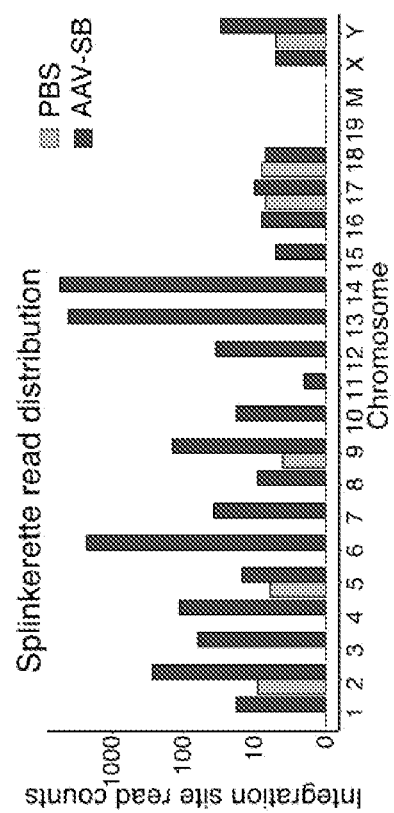

FIG. 17E

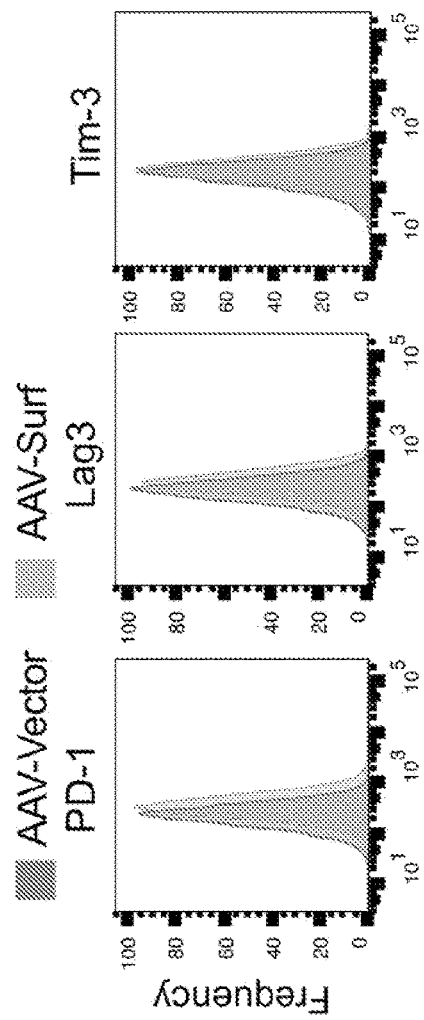
FIG. 20A
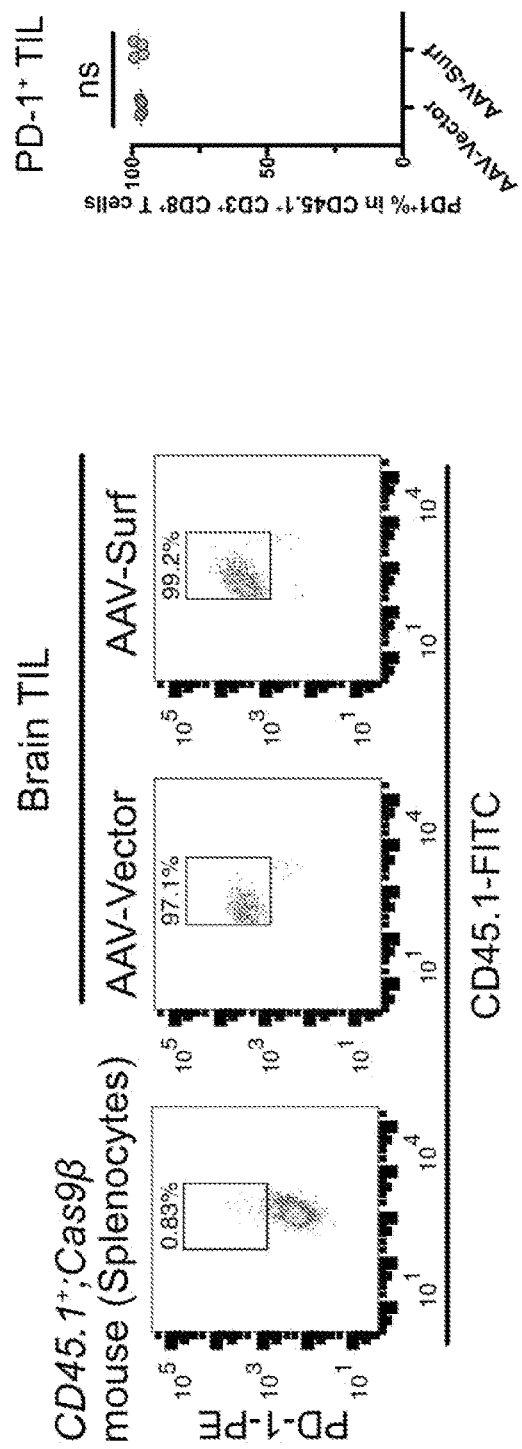
FIG. 20B
FIG. 20C

COMPOSITIONS FOR IDENTIFICATION OF MEMBRANE TARGETS FOR ENHANCEMENT OF T CELL ACTIVITY AGAINST CANCER

CROSS-REFERENCE TO RELATED APPLICATIONS

The present application is a 35 U.S.C. § 371 national phase application from, and claiming priority to, International Application No. PCT/US2019/044424, filed Jul. 31, 2019, which is entitled to priority under 35 U.S.C. § 119(e) to U.S. Provisional Patent Application No. 62/713,217, filed Aug. 1, 2018, and U.S. Provisional Patent Application No. 62/805,585, filed Feb. 14, 2019, each of which are hereby incorporated by reference in their entireties herein.

STATEMENT REGARDING FEDERALLY SPONSORED RESEARCH OR DEVELOPMENT

This invention was made with government support under CA209992, CA231112 and CA238295 awarded by the National Institutes of Health and under W81XH-17-1-0235 awarded by the United States Army Medical Research and Material Command. The government has certain rights in the invention.

BACKGROUND OF THE INVENTION

Glioblastoma (GBM) is the most common and deadliest primary malignant brain tumor in adults. GBM patients only have a median survival period of approximately 15 months under the current standard of care. Once glioblastoma relapses in patients, none of the current treatments can effectively prolong overall survival. Immune checkpoint blockade can enhance the antitumor response of $CD8^+$ T cells by neutralizing cytotoxic T cell lymphocyte antigen 4 (CTLA-4), programmed cell death protein 1 (PD-1) or its ligand PD-L1. However, a recent clinical trial demonstrated that PD-1 blockade does not prolong survival for GBM patients. Combined treatment of anti-PD-1 and anti-CTLA-4 in GBM patients also failed to provide clinical benefits and patients suffered from strong adverse effects. EGFR-vIII CAR-T cell therapy has been through several clinical trials, however, little overall survival benefit was seen for GBM patients. The failure of these immunotherapy modalities revealed an urgent need for identification of novel targets to enhance the anti-tumor activity of $CD8^+$ T cells.

There is an urgent unmet need to develop novel therapeutics for GBM. The present invention satisfies this need.

SUMMARY OF THE INVENTION

As described herein, the present invention relates to compositions and methods for identification of membrane targets for enhancement of T cell activity (e.g. $CD8^+$) against cancer.

In one aspect, the invention includes a non-naturally occurring or engineered sgRNA library (mmSurf) targeting membrane-bound molecules, comprising a plurality of nucleic acids comprising at least one nucleotide sequence selected from the group consisting of SEQ ID NOs: 1-6,628. In another aspect, the invention includes an sgRNA library (mmSurf), comprising a plurality of nucleic acids comprising at least one nucleotide sequence selected from the group consisting of SEQ ID NOs: 1-6,628. In further embodiments, the sgRNA library (mmSurf) further comprises a plurality of nucleic acids comprising at least one nucleotide sequence selected from the group consisting of SEQ ID NOs: 6,629-7,628.

In one aspect, the invention includes a non-naturally occurring or engineered sgRNA library (mSURFEOME2) targeting membrane-bound molecules, comprising a plurality of nucleic acids comprising at least one nucleotide sequence selected from the group consisting of SEQ ID NOs: 7,837-64,747. In another aspect, the sgRNA library (mSURFEOME2), comprises a plurality of nucleic acids comprising at least one nucleotide sequence selected from the group consisting of SEQ ID NOs: 7,837-64,747. In further embodiments, the sgRNA library (mSURFEOME2) further comprises a plurality of nucleic acids comprising at least one nucleotide sequence selected from the group consisting of SEQ ID NOs: 64,748-69,747.

In one aspect, the invention includes an AAV library (AAV-Surf) comprising a plurality of vectors, wherein each vector comprises an expression cassette for an sgRNA comprising a nucleotide sequence selected from the group consisting of SEQ ID NOs: 1-6,628. In further embodiments, the sgRNA library (AAV-Surf) further comprises a plurality of nucleic acids comprising at least one nucleotide sequence selected from the group consisting of SEQ ID NOs: 6,629-7,628.

In one aspect, the invention includes an AAV library (AAV-SURFEOME2) comprising a plurality of vectors, wherein each vector comprises an expression cassette for an sgRNA comprising a nucleotide sequence selected from the group consisting of SEQ ID NOs: 7,837-64,747. In further embodiments, the sgRNA library (AAV-SURFEOME2) further comprises a plurality of nucleic acids comprising at least one nucleotide sequence selected from the group consisting of SEQ ID NOs: 64,748-69,747.

In some embodiments, at least one of the plurality of AAV library vectors comprises SEQ ID NO: 69,821.

In one aspect, the invention includes an AAV-CRISPR T cell vector for efficient gene editing and high-throughput screen in T cells comprising a first ITR, a second ITR, an antibiotic resistance sequence, two sleeping beauty (SB) IR/DR repeats, a first promoter, an sgRNA, a second promoter, a Thy1.1 selection marker, an SB100x transposase, and a poly A sequence.

In some embodiments, the AAV-CRISPR-T cell vector comprises SEQ ID NO: 69,821.

In one aspect, the invention includes a genetically modified cell, wherein at least one gene selected from the group consisting of Mgat5, Pdia3, Lag3, and Emp1 has been mutated in the cell.

In some embodiments, the cell is selected from the group consisting of a primary T cell, a $CD8^+$ cell, a $CD4^+$ cell, a T regulatory (Treg) cell, and a CAR-T cell.

In some embodiments, at least one additional gene has been mutated in the cell.

In some embodiments, the additional gene is selected from the group consisting of Cdh11, Hfe2, Slc29a1, Pld3, Xc3cl1, P4ha1, Rnpep, Man2a1, Tmem123, Vpreb1, Tspan3, Eprs, Chrna4, Ctlc, Ly9, Epha3, Lgals3bp, Plat, Lrrc8b, Crhr1, Vpreb1, Upk1a, Rnpep, Fgb, Vegfa and Kdr.

In one aspect, the invention includes a method of treating a disease, disorder, or condition in a subject in need thereof, the method comprising administering to the subject a genetically modified T cell wherein at least one gene selected from the group consisting of Mgat5, Pdia3, Lag3, and Emp1 has been targeted in the T cell. In some embodiments, the disease is cancer.

In various embodiments of the aspects found elsewhere herein or any other aspect of the invention delineated herein, the T cell is selected from the group consisting of a primary cell, a CD8$^+$ cell, a CD4$^+$ cell, a T regulatory (Treg) cell, and a CAR-T cell.

In some embodiments, the CAR-T cell comprises a CAR encoded by SEQ ID NO: 69,749.

In some embodiments, the subject is a human.

In some embodiments, the T cell is human.

In some embodiments, the cancer is a glioblastoma (GBM). In some embodiments, the cancer is breast cancer. In some embodiments, the breast cancer is triple negative breast cancer. In some embodiments, the cancer is selected from a cancer listed in Table 6.

In some embodiments, the administration comprises intracranial injection. In some embodiments, the administration comprises injection into the lateral ventricle.

In some embodiments, at least one additional gene has been targeted in the T cell.

In some embodiments, the additional gene is selected from the group consisting of Cdh11, Hfe2, Slc29a1, Pld3, Xc3cl1, P4ha1, Rnpep, Man2a1, Tmem123, Vpreb1, Tspan3, Eprs, Chrna4, Ctlc, Ly9, Epha3, Lgals3bp, Plat, Lrrc8b, Crhr1, Vpreb1, Upk1a, Rnpep, Fgb, Vegfa and Kdr.

In some embodiments, the targeted gene is mutated, deleted, transcriptionally repressed, translationally repressed and/or targetedly degraded.

In some embodiments, the method comprises administering an additional treatment to the subject.

In some embodiments, the additional treatment is selected from the group consisting of chemotherapy, radiation, surgery, an immune checkpoint inhibitor, a PD-1 inhibitor, and a CTLA-4 inhibitor.

In some embodiments, the gene is mutated by a CRISPR method.

Another aspect of the invention includes a method of enhancing CD8$^+$ T cell anti-tumor activity in a subject in need thereof, the method comprising administering to the subject a genetically modified T cell wherein at least one gene selected from the group consisting of Mgat5, Pdia3, Lag3, and Emp1 has been mutated in the T cell.

In some embodiments, the subject is a human.

In some embodiments, the subject has GBM.

In some embodiments, the subject has breast cancer.

In some embodiments, the breast cancer is triple negative breast cancer.

In some embodiments, the administration comprises intracranial injection.

In some embodiments, the administration comprises injection into the lateral ventricle.

In some embodiments, at least one additional gene has been mutated in the T cell.

In some embodiments, an additional treatment is administered to the subject.

In some embodiments, the additional treatment is selected from the group consisting of chemotherapy, radiation, surgery, an immune checkpoint inhibitor, a PD-1 inhibitor, and a CTLA-4 inhibitor.

In some embodiments, the gene is mutated by a CRISPR method.

Another aspect of the invention includes a method of performing genome editing and screening of a T cell for a mutation in vitro, the method comprising contacting the T cell with Cas9 and an AAV library, wherein the AAV library comprises a plurality of vectors, wherein each vector comprises an expression cassette for an sgRNA comprising a nucleotide sequence selected from the group consisting of SEQ ID NOs: 1-6,628, whereby the T cell undergoes genome editing; and screening the T cell for a mutation in vitro.

Another aspect of the invention includes a method of performing genome editing and screening of a T cell for a mutation in vitro, the method comprising contacting the T cell with Cas9 and an AAV library, wherein the AAV library comprises a plurality of vectors, wherein each vector comprises an expression cassette for an sgRNA comprising a nucleotide sequence selected from the group consisting of SEQ ID NOs: 7,837-64,747, whereby the T cell undergoes genome editing; and screening the T cell for a mutation in vitro.

Another aspect of the invention includes a method of performing genome editing and screening of a T cell for a mutation in vivo, the method comprising: contacting an isolated T cell with Cas9 and an AAV library, wherein the AAV library comprises a plurality of vectors, wherein each vector comprises an expression cassette for an sgRNA comprising a nucleotide sequence selected from the group consisting of SEQ ID NOs: 1-6,628, whereby the T cell undergoes genome editing to generate a modified T cell, administering to a subject the modified T cell, and screening the T cell for a mutation in vivo.

Another aspect of the invention includes a method of performing genome editing and screening of a T cell for a mutation in vivo, the method comprising: contacting an isolated T cell with Cas9 and an AAV library, wherein the AAV library comprises a plurality of vectors, wherein each vector comprises an expression cassette for an sgRNA comprising a nucleotide sequence selected from the group consisting of SEQ ID NOs: 7,837-64,747, whereby the T cell undergoes genome editing to generate a modified T cell, administering to a subject the modified T cell, and screening the T cell for a mutation in vivo.

In some embodiments, the T cell is selected from the group consisting of: a CD8$^+$ cell, a CD4$^+$ cell, a T regulatory (Treg) cell, a Th1 cell, a Th2 cell, a Th17 cell, a follicular helper T cell (Tfh), a T memory cell, a T effector cell, a T effector memory cell, an engineered T cell, and a CAR T cell In some embodiments, a modified T cell is isolated and enriched.

In some embodiments, the subject is a human.

In some embodiments, the T cell is human.

In some embodiments, the screening provides information about a gene involved in a condition afflicting the subject.

In some embodiments, the condition is cancer.

In some embodiments, the cancer is GBM.

In some embodiments, the cancer is breast cancer.

In some embodiments, the breast cancer is triple negative breast cancer.

In some embodiments, the screening comprises at least one method selected from the group consisting of nucleotide sequencing, sgRNA PCR, and flow cytometry.

Another aspect of the invention includes a method of generating a genetically modified T cell, the method comprising administering to a naïve T cell Cas9 and a vector comprising an expression cassette for an sgRNA comprising a nucleotide sequence selected from the group consisting of SEQ ID NOs: 1-6,628.

Another aspect of the invention includes a method of generating a genetically modified T cell, the method comprising administering to a naïve T cell Cas9 and a vector comprising an expression cassette for an sgRNA comprising a nucleotide sequence selected from the group consisting of SEQ ID NOs: 7,837-64,747.

In one aspect of the invention, the sgRNA targets a gene selected from the group consisting of Mgat5, Pdia3, Lag3, and Emp1.

Another aspect of the invention includes a composition comprising a genetically modified T cell generated by the methods found elsewhere herein.

Another aspect of the invention includes a kit comprising an AAV library and instructional material for use thereof, wherein the AAV library comprises a plurality of vectors, wherein each vector comprises an expression cassette for an sgRNA comprising a nucleotide sequence selected from the group consisting of SEQ ID NOs: 1-6,628. In some embodiments, the AAV library further comprises a plurality of vectors, wherein each vector comprises an expression cassette for an sgRNA comprising a nucleotide sequence selected from the group consisting of SEQ ID NOs: 6,629-7,628.

Another aspect of the invention includes a kit comprising an AAV library and instructional material for use thereof, wherein the AAV library comprises a plurality of vectors, wherein each vector comprises an expression cassette for an sgRNA comprising a nucleotide sequence selected from the group consisting of SEQ ID NOs: 7,837-64,747. In some embodiments, the AAV library further comprises a plurality of vectors, wherein each vector comprises an expression cassette for an sgRNA comprising a nucleotide sequence selected from the group consisting of SEQ ID NOs: 64,748-69,747.

Another aspect of the invention includes a method of treating a disease, disorder, or condition in a subject in need thereof, the method comprising administering to the subject a therapeutically effective amount of an inhibitor of at least one gene selected from the group consisting of Mgat5, Pdia3, Lag3 and Emp1. In some embodiments, the disease is a cancer.

In some embodiments, the inhibitor is selected from the group consisting of an antibody, an siRNA, and a CRISPR system.

In some embodiments, the CRISPR system comprises a Cas9, and at least one sgRNA complementary to Mgat5, Pdia3, Lag3, or Emp1.

Another aspect of the invention includes a method of stimulating a T cell, the method comprising mutating at least one gene selected from the group consisting of Mgat5, Pdia3, Lag3 and Emp1 in the T cell.

In some embodiments, stimulating the T cell results in increased interferon-gamma production by the T cell and/or in increased cytotoxicity of the T cell.

Another aspect of the invention includes a method of stimulating a T cell, the method comprising contacting the T cell with a therapeutically effective amount of an inhibitor of at least one gene selected from the group consisting of Mgat5, Pdia3, Lag3, and Emp1.

In some embodiments, the inhibitor is selected from the group consisting of an antibody, an siRNA, and a CRISPR system.

In some embodiments, the CRISPR system comprises a Cas9, and at least one sgRNA complementary to Mgat5, Pdia3, Lag3, or Emp1.

Another aspect of the invention includes a method of performing genome editing and screening of a T cell for a mutation in vitro, the method comprising contacting the T cell with Cas9 and an AAV library, wherein the AAV library comprises a plurality of vectors, wherein each vector comprises a first ITR, a second ITR, an antibiotic resistance sequence, two sleeping beauty (SB) IR/DR repeats, a first promoter, an sgRNA an expression cassette comprising a nucleotide sequence selected from the group consisting of SEQ ID NOs: 1-6,628, a second promoter, a Thy1.1 selection marker, an SB100x transposase, and a poly A sequence, whereby the T cell undergoes genome editing; and screening the T cell for a mutation in vitro.

Another aspect of the invention includes a method of performing genome editing and screening of a T cell for a mutation in vitro, the method comprising: contacting the T cell with Cas9 and an AAV library, wherein the AAV library comprises a plurality of vectors, wherein each vector comprises a first ITR, a second ITR, an antibiotic resistance sequence, two sleeping beauty (SB) IR/DR repeats, a first promoter, an sgRNA an expression cassette comprising a nucleotide sequence selected from the group consisting of SEQ ID NOs: 7,837-64,747, a second promoter, a Thy1.1 selection marker, an SB100x transposase, and a poly A sequence, whereby the T cell undergoes genome editing; and screening the T cell for a mutation in vitro.

Another aspect of the invention includes a method of performing genome editing and screening of a T cell for a mutation in vivo, the method comprising contacting the T cell with Cas9 and an AAV library, wherein the AAV library comprises a plurality of vectors, wherein each vector comprises a first ITR, a second ITR, an antibiotic resistance sequence, two sleeping beauty (SB) IR/DR repeats, a first promoter, an sgRNA an expression cassette comprising a nucleotide sequence selected from the group consisting of SEQ ID NOs: 1-6,628, a second promoter, a Thy1.1 selection marker, an SB100x transposase, and a poly A sequence, whereby the T cell undergoes genome editing; and screening the T cell for a mutation in vivo.

Another aspect of the invention includes a method of performing genome editing and screening of a T cell for a mutation in vivo, the method comprising: contacting the T cell with Cas9 and an AAV library, wherein the AAV library comprises a plurality of vectors, wherein each vector comprises a first ITR, a second ITR, an antibiotic resistance sequence, two sleeping beauty (SB) IR/DR repeats, a first promoter, an sgRNA an expression cassette comprising a nucleotide sequence selected from the group consisting of SEQ ID NOs: 7,837-64,747, a second promoter, a Thy1.1 selection marker, an SB100x transposase, and a poly A sequence, whereby the T cell undergoes genome editing; and screening the T cell for a mutation in vivo.

In some embodiments, the vector comprises SEQ ID NO: 69,821.

Another aspect of the invention includes an isolated antibody or antigen binding fragment thereof that binds human MGAT5, wherein the isolated antibody or antigen binding fragment thereof comprises at least one of the amino acid sequences of Table 3.

In some embodiments, said antibody or antigen binding fragment thereof comprises a heavy chain comprising at least one amino acid sequence selected from the group consisting of SEQ ID Nos.: 7645-7647, 7649-7651, 7653-7655, 7657-7659, 7661-7663, 7665-7667, 7669-7671, 7673-7675, 7677-7679, 7681-7683, 7685-7687, 7689-7691, 7693-7701, 7703-7705, 7707-7709, 7711-7713, 7715-7717, 7719-7727, 7729, 7730 and 7731; and a light chain comprising at least one amino acid sequence selected from the group consisting of SEQ ID Nos.: 7648, 7652, 7656, 7660, 7664, 7668, 7672, 7676, 7680, 7684, 7688, 7692, 7702, 7706, 7710, 7714, 7718 and 7728.

In some embodiments, the isolated antibody or antigen binding fragment thereof of any one of the preceding embodiments, wherein said antibody or antigen binding fragment thereof comprises H1, H2 and H3 CDRs of a given clone of Table 3.

In some embodiments, the isolated antibody or antigen binding fragment thereof of any one of the preceding embodiments, wherein said antibody or antigen binding fragment thereof comprises L3 CDR of a given clone of Table 3 and further comprises the nucleotide sequence of SEQ ID NO: 69,837.

In some embodiments, said antibody or antigen binding fragment thereof comprises L3 CDR of a given clone of Table 3 and further comprises the amino acid sequence of SEQ ID NO: 7,824.

Another aspect of the invention includes an isolated antibody or antigen binding fragment thereof that binds human MGAT5, wherein the isolated antibody or antigen binding fragment thereof is encoded by a nucleic acid comprising any one of the nucleic acid sequences of Table 5.

In some embodiments, the antibody or antigen binding fragment thereof is humanized, human, or chimeric.

In some embodiments, the antibody or antigen binding fragment thereof is a Fab, Fab', F(ab')$_2$ or IgG.

Another aspect of the invention includes a nucleic acid encoding any of the elsewhere herein antibody or antigen binding fragments.

Another aspect of the invention includes a pharmaceutical composition comprising any of the isolated antibodies or antigen binding fragments found elsewhere herein.

Another aspect of the invention includes a method of treating a disease, disorder, or condition in a subject in need thereof comprising administering to the subject an effective amount of the pharmaceutical composition.

In some embodiments, the disease is cancer.

In some embodiments, the cancer is glioblastoma or breast cancer.

In some embodiments, the disease is autoimmune disease.

In some embodiments, the disease is an immune system disorder.

Another aspect of the invention includes an isolated antibody or antigen binding fragment thereof that binds human PDIA3, wherein the isolated antibody or antigen binding fragment thereof comprises any one of the amino acid sequences of Table 4.

In some embodiments, said antibody or antigen binding fragment thereof comprises a heavy chain comprising at least one amino acid sequence selected from the group consisting of SEQ ID Nos.: 7732-7734, 7736-7738, 7740-7742, 7744-7746, 7748-7750, 7752-7754, 7756-7758, 7760-7762, 7764-7766, 7768-7770, 7772-7774, 7776-7778, 7780-7782, 7784-7786, 7788-7790, 7792-7794, 7796-7798, 7800-7802, 7804-7806, 7808-7810, 7812-7814, 7816-7818, 7820, 7821 and 7822; and a light chain comprising at least one amino acid sequence selected from the group consisting of SEQ ID Nos.: 7735, 7739, 7743, 7747, 7751, 7755, 7759, 7763, 7767, 7771, 7775, 7779, 7783, 7787, 7791, 7795, 7799, 7803, 7807, 7811, 7815, 7819 and 7823.

In some embodiments, said antibody or antigen binding fragment thereof comprises H1, H2 and H3 CDRs of a same clone of Table 4.

In some embodiments, said antibody or antigen binding fragment thereof comprises H1, H2 and H3 CDRs of a same clone of Table 4.

In some embodiments, said antibody or antigen binding fragment thereof comprises H1, H2 and H3 CDRs of a same clone of Table 4.

In some embodiments, said antibody or antigen binding fragment thereof comprises L3 CDR of a clone of Table 4 and further comprises the nucleotide sequence of SEQ ID NO: 69,837.

In some embodiments, said antibody or antigen binding fragment thereof comprises L3 CDR of a clone of Table 4 and further comprises the amino acid sequence of SEQ ID NO: 7,824.

Another aspect of the invention includes an isolated antibody or antigen binding fragment thereof that binds human PDIA3, wherein the isolated antibody or antigen binding fragment thereof is encoded by a nucleic acid comprising any one of the nucleic acid sequences of Table 5.

In some embodiments, the antibody or antigen binding fragment thereof found elsewhere herein is humanized, human, or chimeric.

In some embodiments, the antibody or antigen binding fragment thereof is a Fab, Fab', F(ab')$_2$ or IgG.

Another aspect of the invention includes a nucleic acid encoding any of the antibodies or antigen binding fragments described elsewhere herein.

Another aspect of the invention includes a pharmaceutical composition comprising any of the isolated antibodies or antigen binding fragments described elsewhere herein.

Another aspect of the invention includes a method of treating a disease, disorder, or condition in a subject in need thereof comprising administering to the subject an effective amount of the immunopharmaceutical composition described elsewhere herein In some embodiments, the disease is cancer.

In some embodiments, the cancer is glioblastoma or breast cancer.

In some embodiments, the cancer is selected from a cancer listed in Table 6.

In some embodiments, the disease is autoimmune disease.

In some embodiments, the disease in an immune system disorder.

BRIEF DESCRIPTION OF THE DRAWINGS

The following detailed description of specific embodiments of the invention will be better understood when read in conjunction with the appended drawings. For the purpose of illustrating the invention, there are shown in the drawings exemplary embodiments. It should be understood, however, that the invention is not limited to the precise arrangements and instrumentalities of the embodiments shown in the drawings.

FIGS. 1A-1L illustrate AAV-CRISPR CD8$^+$ T cell screen of surface proteome knockouts in GBM. FIG. 1A top is a schematic of the hybrid AAV-SB-CRISPR vector. FIG. 1A bottom is a diagram of an AAV-CRIPSR screen in a syngeneic mouse model of GBM. A schematic of naïve CD8$^+$ T cell isolation, AAV library transduction, GBM cell transplantation, adoptive cell transfer (ACT), organs isolation, sgRNA readout and deep sequencing are shown. FIG. 1B is a series of plots showing flow cytometry analysis of TILs in the GBM bearing brain. 5×10$^5$ GL261-FLuc cancer cells were injected per mouse, at day 12 after tumor injection, luciferase imaging was performed to reasonably group mice based on luminescence intensity, then 4×10$^6$ CD45.1$^+$; Cas9β CD8$^+$ T cells were i.v. injected. Mice were euthanized at day 6 after T cell injection, brains (without olfactory and hindbrain) were dissected for TIL isolation. The i.v. injected CD45.1$^+$;CD3$^+$;CD8$^+$ T cells were quantified and sorted for TCR-seq. Cas9β mouse and CD45.1$^+$;Cas9β mouse splenocytes were used as gating controls. Data was collected from one experiment. FIG. 1C is a graph showing quantification of TIL number after transduction with AAV-Vector and AAV-Surf virus. Data was collected from two mice per group, two independent stainings were performed for each mouse. Data shown are mean±s.e.m. * p<0.05, Mann Whitney test, two-tailed. FIG. 1D shows bulk analysis for brain tumor vs. pre-injection CD8 T cell sgRNA library representation of an AAV-Surf GBM CD8$^+$ T cell screen experiment. A list of most significantly enriched sgRNAs in brain tumors are labelled (FDR<=0.2%). Among the significant sgRNAs, three independent Mgat5 sgRNAs and two independent Pdia3 sgRNAs were enriched. A well-known immune check-point surface molecule, Lag-3, as well as Man2a1, a member of the Mgat5 pathway, were also enriched at this level. FIG. 1E shows RIGER analysis for brain tumor vs. cell gene level significance of the AAV-Surf screen experiment. The top 10 most highly enriched genes (by RIGER p-value) in brain tumors are highlighted. Weighted Sum method was used for this analysis. Analysis using Second-Best sgRNA method is consistent with the Weighted Sum method. Mgat5 and Pdia3 are the two most significant hits by RIGER p-value. Known immune checkpoint regulators Lag-3 and Tnfrsf18 are also among the top 10 by significance. FIG. 1F displays CD8$^+$ T cell mRNA levels of several top hits from the AAV-Surf GBM screen. FIG. 1G (left) is a Nextera indel analysis for Mgat5 and Pdia3 knockout mouse CD8$^+$ T cells. Shaded text indicates the sgRNA sequence for Mgat5 (SEQ ID NO: 69,750) and Pdia3 (SEQ ID NO: 69,759). Resulting indels and their frequencies are listed (SEQ ID NOs: 69,751-69,758 for Mgat5; SEQ ID NOs. 69,760-69,767 for Pdia3). FIG. 1G (right) shows the quantification of total indel frequency for each gene. FIG. 1H is a schematic of the therapeutic efficacy testing strategy for top candidates from the AAV-Surf screens using an independent model of GBM immunotherapy, where cancer cells express a cognate cOVA model tumor antigen recognized by CD8$^+$ T cells from TCR transgenic OT-I mice. FIG. 1I illustrates a survival plot of mice who received adoptively transferred mutant Pdia3 CD8 T cells. FIG. 1J illustrates a survival plot of mice who received adoptively transferred mutant Mgat5 CD8 T cells. FIG. 1K illustrates a survival plot of mice who received adoptively transferred mutant Emp1 CD8 T cells. FIG. 1L Is a bar plot of quantitative results for CD45.2$^+$ and CD8$^+$ CD8$^+$ T cell infiltration in GBM bearing mice (TILs) with or without Mgat5 or Pdia3 knockout (n=3 for each group). Unpaired t test was used for assess significance. * p<0.05. Data are shown as mean±s.e.m., plus individual data points on the bar graph.

FIGS. 2A-2H describe an AAV-CRISPR CD8$^+$ T cell screen for membrane-bound knockouts in GBM. FIG. 2A is a schematic of the hybrid AAV-SB-CRIPSR CD8$^+$ T cell screen in a syngeneic mouse model of GBM, showing steps of naïve CD8$^+$ T cell isolation, AAV library transduction, GBM cell transplantation, adoptive T cell transfer, brain and tumor isolation, and sgRNA readout by deep sequencing. FIG. 2B are representative in vivo images illustrating the growth of GL261-FLuc tumors in the brains of C57BL/6 mice. FIG. 2C are representative images of mice after GBM transplantation and T cell treatment. Dashed circles indicated macrocephaly suggestive of growing brain tumors. FIG. 2D shows CD8$^+$ T cell qPCR results of several top hits from AAV-Surf GBM screen. The mRNA level of all candidates were measured with RT-qPCR. The results suggested that all of them were expressed in CD8$^+$ T cells. FIG. 2E shows a survival plot of mice after GBM engraftment and adoptive transfer. C57BL/6J mice were transplanted with 1.2×10$^6$ GL261-FLuc into the lateral ventricle (LV). 4×10$^6$ OT-I;Cas9β CD8$^+$ T cells were injected after 10 days of tumor engraftment. Survival significance was assessed by a log-rank Mantel-Cox test. The p-values and number of mice used in each group was indicated in the plots. FIG. 2F are representative H&E stained brain sections from PBS, AAV-Vector and AAV-Surf groups. Areas within gray dashed lines indicate brain tumors. Scale bar, 2 mm for whole brain sections, and 100 μm for zoom-in sections. These are representative images at the endpoint of survival thus not quantitative for comparison in terms of tumor burden. FIG. 2G shows a scatterplot of brain vs. cell sgRNA library representation of the AAV-Surf short-term screen experiment (max survival 20 days post injection). The most enriched sgRNAs in the brain are highlighted. Purple dash line, y=x curve; blue dash line, linear regression of the distribution of the 1,000 NTCs between the brain and cell samples. FIG. 2H shows a scatterplot of brain vs. cell sgRNA library representation of AAV-Surf longer term screen experiment (max survival 92 days post injection). The most enriched sgRNAs in the brain are highlighted. Dark grey dashed line, y=x curve; light grey dashed line, linear regression of the distribution of the 1,000 NTCs between the brain and cell samples.

FIGS. 3A-3G describe the endogenous gene expression of top hits in primary CD8$^+$ T cell, clonal GBM cell line generation, and representative mouse GBM histology with single gene knockout adoptive transfer. FIG. 3A shows representative histograms generated from showing the expression levels of GL261-FLuc-mCh-cOVA clones for cOVA expression level. FIG. 3B shows the gene editing of Mgat5 and Pdia3 with AAV-SB100x vector by T7EI assay indicated. FIG. 3C shows bar graphs of Mgat5 and Pdia3 mRNA expression following infection with AAV6 carrying specific gene-targeting. Unpaired t test was used for the significance assessment, AAV-Vector vs. AAV-sgMgat5, p=0.0242; AAV-Vector vs. AAV-sgPdia3, p=0.0111. * p<0.05. FIG. 3D shows a representative H&E stained brain sections from AAV-Vector and AAV-sgRNA single knockout groups in C57BL/6J mice. Scale bar, 100 μm. These are representative images at the endpoint of survival thus not quantitative for comparison in terms of tumor burden. FIG. 3E shows a representative H&E stained brain sections from AAV-Vector and AAV-sgRNA single knockout groups in Rag1$^{-/-}$ mice. Scale bar, 100 μm. These are representative images at the endpoint of survival thus not quantitative for comparison in terms of tumor burden. FIG. 3F shows the therapeutic efficacy testing strategy for top candidates identified from the AAV-Surf screens using adoptive transfer of single gene-edited CD8$^+$ T cells in a syngeneic mouse model of GBM. FIG. 3G shows survival plots of the top candidate validations in a syngeneic mouse model of GBM. C57BL/6J mice were engrafted with 2×10$^5$ GL261 cancer cells, and adoptive transfer was performed after 10 days of tumor engraftment by intravenous injection of 6×10$^5$ Cas9β CD8$^+$ T cells infected with AAV-Vector (n=8), AAV-sgLag3 (n=8), AAV-sgMgat5 (n=8), and AAV-sgPdia3 (n=8). Survival significance was assessed by a log-rank Mantel-Cox test. The p-values and number of mice used in each group was indicated in the plots. AAV-Vector vs. AAV-sgLag3, p=0.0413; AAV-Vector vs. AAV-sgMgat5, p=0.0213; AAV-Vector vs. AAV-sgPdia3, p=0.0105. DPI, days post tumor implantation.

FIG. 4A shows representative flow plots of CD8+ T cells from mouse brain tumors following adoptive transfer of non-mutated or mutated CD8+ T cells. FIG. 4B is the quantification of FIG. 4A. Unpaired t test was used for assess significance. * p<0.05. Vector vs. sgMgat5, p=0.0328; Vector vs. sgPdia3, p=0.0303. Data are shown as mean±S.E.M., plus individual data points on the bar graph.

FIGS. 5A-5E illustrate the validation of top candidates from AAV-Surf CD8+ T cell screen in GBM. FIG. 5A shows a schematic of the validation strategy for top candidates from the AAV-Surf screens using a cognate TCR-model tumor antigen system. FIG. 5B (top) shows representative in vivo imaging at day 48 after tumor engraftment, illustrating the growth of GL261-FLuc-mCh-cOVA #1 cells in the brains of Rag1$^{-/-}$ mice. FIG. 5B (bottom) shows the quantification of total luciferase flux in each group, demonstrating that T cells with Mgat5, Pdia3 or Emp1 knockout significantly enhance anti-tumor effect. * p<0.05, unpaired t test. (AAV-Vector (n=6) vs. AAV-Mgat5 (n=9), p=0.0374; AAV-Vector (n=6) vs. AAV-Pdia3 (n=9), p=0.0949; AAV-Vector (n=6) vs. AAV-Emp1 (n=8), p=0.0383). FIG. 5C shows a survival plot of mutant Mgat5 CD8 T cells in in Rag1$^{-/-}$ mice (n=10). All mice were engrafted with $1 \times 10^5$ GL261-FLuc-mCh-cOVA #1 cells, and ACT was performed by intravenous injection of $1 \times 10^6$ OT-1;Cas9β CD8+ T cells which were infected with AAV—after 10 days of tumor engraftment. Survival significance was assessed by a log-rank Mantel-Cox test. The p-values and number of mice used in each group are indicated in the plots. FIG. 5D is a survival plot of mutant Pdia3 CD8 T cells in in Rag1$^{-/-}$ mice (n=9). All mice were engrafted with $1 \times 10^5$ GL261-FLuc-mCh-cOVA #1 cells, and ACT was performed by intravenous injection of $1 \times 10^6$ OT-1;Cas9β CD8+ T cells which were infected with AAV—after 10 days of tumor engraftment. Survival significance was assessed by a log-rank Mantel-Cox test. The p-values and number of mice used in each group are indicated in the plots. FIG. 5E is a survival plot of mutant Emp1 CD8 T cells in in Rag1$^{-/-}$ mice (n=8). All mice were engrafted with $1 \times 10^5$ GL261-FLuc-mCh-cOVA #1 cells, and ACT was performed by intravenous injection of $1 \times 10^6$ OT-1;Cas9β CD8+ T cells which were infected with AAV—after 10 days of tumor engraftment. Survival significance was assessed by a log-rank Mantel-Cox test. The p-values and number of mice used in each group are indicated in the plots.

FIG. 6A shows a schematic of the therapeutic efficacy testing of AAV-SB-CRISPR gene editing of the top targets by adoptive transfer of T cells directly into the brain in a syngeneic mouse model of GBM. C57BL/6J mice were implanted intracranially with $5 \times 10^5$ GL261-FLuc cancer cells at day 0. In vivo imaging was performed at day 12 to ensure all mouse brains had growing tumors. $5 \times 10^5$ T cells were intracranially injected at the same coordinate as the tumor injection. The luciferase imaging was performed every 2 days using an IVIS system. A timeline for tumor induction, adoptive transfer and imaging is shown at the bottom. FIG. 6B shows representative IVIS images. In vivo imaging illustrates that all mouse brains had a growing tumor at day 12. The tumor growth rate was significantly slow down after injecting T cells infected with AAV-sgMgat5 or AAV-sgPdia3 virus compared with AAV-Vector group. FIG. 6C is a quantification of tumor burden as total luciferase flux at days 12, 16 and 18, the results demonstrated that T cells with Mgat5 or Pdia3 knockout significantly enhance anti-tumor effect. Day 20 and 22 data points were not used for statistics because most mice in the AAV-Vector group had already reached endpoint. Grouped time series data, Wilcoxon rank sum test with continuity correction, two sided, AAV-sgMgat5 vs. AAV-Vector, p=0.005314; AAV-sgPdia3 vs. AAV-Vector, p=0.04317. Labeled on graph, *p<0.05, **p<0.01. Data are shown as mean±s.e.m. plus individual data points on bar graphs. FIG. 6D are survival plots of mice treated with mutant CD8 T cells. Survival significance was assessed by a log-rank Mantel-Cox test. AAV-sgMgat5 vs. AAV-Vector, p=0.0001; AAV-sgPdia3 vs. AAV-Vector, p=0.0072. DPI, days post tumor implantation. FIG. 6E shows a timeline for tumor induction, adoptive transfer, and imaging of the therapeutic efficacy testing of AAV—SB-CRISPR targeting Pdia3, Mgat5 and combination in CD8+ T cells in a syngeneic mouse model of GBM. C57BL/6J mice were implanted intracranially with $2 \times 10^5$ GL261-FLuc cancer cells on day 0. In vivo imaging was performed at day 14 before T cell injection for randomization with tumor-burden matched subgrouping. $1.5 \times 10^6$ T cells were intracranially injected at the same coordinate as tumor injection. The luciferase imaging was performed every 2-3 days. FIG. 6F shows representative IVIS images of brain tumor growth in GL261-FLuc cancer cell injected mice receiving adoptive transfer of T cells infected with AAV-Vector, AAV-sgMgat5 and AAV-sgPdia3 virus groups. FIG. 6G shows survival plots from GL261-FLuc mice that received adoptively transferred T cells infected with AAV-Vector, AAV-sgMgat5 and AAV-sgPdia3 virus groups. Overall survival significance was assessed by a log-rank Mantel-Cox test between Vector and mutant groups (p=0.0198). Comparison between groups, Wilcox test, AAV-sgMgat5 vs. AAV-Vector, p=0.07; AAV-sgPdia3 vs. AAV-Vector, p=0.005; AAV-sgPdia3+ AAV-sgMgat5 vs. AAV-Vector, p=0.01. DPI, days post tumor implantation. FIG. 6H are a series of micrographs depicting whole brain section H&E staining of four long-term survivor mice. Scale bar, 2 mm for whole brain sections. Data was collected from one independent experiment, survivor mice were from the same experiment as in FIG. 6G.

FIG. 7A is a t-SNE plot of sample distribution based on the transcriptome of 9,193 single cells from AAV-sgPdia3 and AAV-vector infected CD8+ T cells. FIG. 7B shows a volcano plot of scRNA-seq of mouse Pdia3 knockout CD8+ T cells. Pdia3 mRNA was significantly downregulated after infected with AAV-sgPdia3. In addition, Gzma, Gzmb, and Gzmc were significantly upregulated after Pdia3 knockout. FIG. 7C shows t-SNE plots of CD3e, CD8, and Pdia3 clusters. CD3e and CD8 were not significantly changed between groups, while Pdia3 expression level was dramatically reduced at the single-cell level. FIG. 7D shows t-SNE plots of Gzma, Gzmb, and Gzmc clusters.

FIG. 8A shows a t-SNE plot of hierarchical clustering of scRNA-seq results. A total of 9,193 single cells were captured and their transcriptomes were sequenced for the AAV-sgPdia3 (4,549 single cells) and AAV-Vector (4,644 single cells) treated CD8 T cells. FIG. 8B shows a bubble-rank plot of differential gene expression of scRNA-seq. Delta-mean is the difference of mean expression value between AAV-sgPdia3 and AAV-Vector treated single CD8 T cells. Statistical significance is scaled by −log 10 p-value as shown in the size key. FIG. 8C shows a volcano plot of all differentially expressed genes between AAV-Vector and AAV-sgPdia3 transduced mouse primary CD8+ T cells (n=3 biological replicates). Differential gene expression was performed with Sleuth using Wald test, the FDR adjusted q-value was used for the plot. FIG. 8D is a heat map of representative immune-related differentially expressed genes between AAV-Vector and AAV-sgPdia3 transduced mouse primary CD8+ T cells (n=3 biological replicates). FIG. 8E shows a heat map of top 50 variable genes by hierarchical cluster of scRNA-seq data. FIG. 8F is a plot showing RT-qPCR validation of the scRNA-seq and bulk mRNA-seq results that confirmed the upregulation of granzyme genes upon AAV-sgPdia3 perturbation (n=4). Unpaired t test, two-tailed. * p<0.05, **** p<0.0001. FIG. 8G is a series of three plots showing RT-qPCR validation of scRNA-seq and bulk mRNA-seq results of the granzyme gene upregulation using two independent Pdia3 sgRNAs (n=3). Unpaired t test, two-tailed. * p<0.05,  p<0.01, * p<0.001, **** p<0.0001.

FIG. 10A shows RT-qPCR validation of the scRNA-seq upregulation of granzyme transcripts upon AAV-sgPdia3 perturbation. Unpaired t test was used to assess the significance. Gzma, AAV-Vector vs. AAV-sgPdia3, p<0.0001; Gzmb, AAV-Vector vs. AAV-sgPdia3, p=0.0159; Gzmc, AAV-Vector vs. AAV-sgPdia3, p<0.0001. * p<0.05, **** p<0.0001. FIG. 10B shows a dose-dependent TCR signaling for Pdia3 or Mgat5 KO, showing an upregulation in the phosphorylation levels of PLCγ and ERK1/2. Two-sided paired t test, sgPdia3 or sgMgat5 vs vector, * p<0.05,  p<0.01, * p<0.001, **** p<0.0001. FIG. 10C shows dose-dependent TCR signaling experiment for Pdia3 KO showing upregulation of the phosphorylation level of Plcγ and Erk1/2. Original western blot gel of a representative experiment among the three independent replicate experiments. FIG. 10D is two graphs showing quantification of relative phosphorylation level of Plcγ and Erk1/2, (n=3). Data are shown as mean±s.e.m. Two-way ANOVA, sgPdia3 vs vector, * p<0.05, *** p<0.001. FIG. 10E shows representative flow plots showing IFNγ expression in OT-I; Cas913 CD8 T cells infected with AAV-vector alone, AAV-sgMgat5, or AAV-sgPdia3. Prior to IFNγ detection, T cells were rested for 12 hours and reactivated with different concentrations of anti-CD3c for 4 hours. FIG. 10F shows the quantification FIG. 10E. Correct for multiple comparisons using the Holm-Sidak method was used to assess the significance. * p<0.05,  p<0.01, * p<0.001,**** p<0.0001. FIG. 10G shows ifnγ intracellular staining after Pdia3 KO using a different sgRNA. Two-sided multiple t test was used to assess the significance, Holm-Sidak method was used for multiple comparisons correction. *p<0.05,  p<0.01, * p<0.001, ns, not significant. FIG. 10H shows a schematic of the therapeutic efficacy testing strategy for Pdia3 knockout T cell using a subcutaneous model of GBM. Rag1−/− mice were implanted subcutaneously with 4×10$^6$ GL261-FLuc-mCh-rOVA cells on day 1. On day 8, naïve CD8+ T cells were isolated from OT-I;Cas9β mice, activated, transduced with single AAVs and cultured for 3 days. 1×10$^6$ T cells were intravenously injected on day 11 post tumor implantation. Tumor sizes were measured every 3-5 days after T cell adoptive transfer. FIG. 10I shows tumor growth curves of GL261-FLuc-mCh-rOVA tumor-bearing mice injected with CD8 T cells infected with AAV-Vector (n=4) or AAV-sgPdia3 (n=5). Wilcoxon rank sum test with continuity correction, two sided, p=0.005982. DPI, days post tumor implantation. FIGS. 10J-10K describe the efficacy testing of Pdia3 knockout T cells using a syngeneic triple-negative breast cancer (TNBC) model. FIG. 10J shows a schematic describing the experiment. RagF mice implanted with 3×10$^6$ E0771-mCh-cOVA cells into the mammary fat pad on day 1. On day 2, naïve CD8+ T cells were isolated from OT-I;Cas9β mice, activated, transduced with single AAVs on day 4, and cultured for another 3 days. 1.5×10$^6$ and 0.5×10$^6$ T cells were intravenously injected on day 7 and day 17 post tumor implantation. Tumor sizes were measured every 2-3 days after T cell adoptive transfer. FIG. 10K shows tumor growth curves of E0771-mCh-cOVA TNBC bearing mice receiving CD8 T cell therapy. Wilcox test, two sided, using only data points on or after T cell adoptive transfer: AAV-Vector vs. AAV-sgPdia3, p=4.469e-05; AAV-Vector vs. PBS, p=7.007e-11. DPI, days post-tumor implantation.

FIGS. 11A-11J describe CyTOF analysis of PDIA3 knockout human CD8 T cells. FIG. 11A shows a schematic of human CD8+ T cell isolation, culture, RNP electroporation, T7EI assay, Nextera sequencing, and CyTOF analysis. FIG. 11B shows that the T7EI assay yielded high efficiency knockout of PDIA3 in human T cells compared to control. Arrows pointed to pre- and post-cleavage products of predicted sizes. FIG. 11C shows the Nextera data quantification of gene editing efficiency from FIG. 11B. Shaded text indicates the sgRNA targeting PDIA3 (SEQ ID NO: 69,768). The table below indicates resulting indel sequences and their frequencies (SEQ ID NOs: 69,769-69,774). FIG. 11D shows a Western Blot showing PDIA3 protein expression CRISPR knockout versus control cells. FIG. 11E is a series of plots showing IFNγ intracellular staining after PDIA3 KO. FIG. 11F is a plot showing quantification of FIG. 11 E. Two-sided multiple t test was used to assess the significance. Holm-Sidak method was used for multiple comparisons correction. *p<0.05,  p<0.01, ns, not significant. FIG. 11G is a plot showing qPCR validation of GZMA expression. Unpaired t test, two-tailed. *p<0.001. FIGS. 11H-11I show t-SNE plots of CyTOF data with k-means clustering. From a total of 227,848 single cells profiled, 7,000 single cells were randomly sampled for each sample, with a subtotal of 42,000 cells in the plots. FIG. 11H shows a t-SNE plot with k-means clustering yielded 10 major clusters. FIG. 11I shows a t-SNE plot clustered by samples. The 3 PDIA3 KO samples grouped with each other, the 3 WT samples also grouped with each other, and that PDIA3 KO samples and WT samples formed distinct groups. FIG. 11J are t-SNE plots of representative markers detected by the CyTOF. Perforin, two co-stimulatory molecules (CD134/OX40 and CD278/ICOS) and CXCR3 were found to be significantly upregulated at the single cell level upon PDIA3 KO (n=3 replicates each, sampled 7,000 cells per replicate for comparison). Violin plots were used for visualizing marker levels quantitatively in single cells. Violins show kernel probability density on side, and boxplot is standard, i.e. middle band is median, hinges/ends of box are interquartile range (25% and 75% quantiles), lower whisker=smallest observation greater than or equal to lower hinge-1.5*IQR, upper whisker=largest observation less than or equal to upper hinge+1.5*IQR. Wilcoxon test, two-sided, p value adjusted by Benjamini & Hochberg method. KO vs WT, PERFORIN, p=1.35e-294; CD278, p=0 (below algorithm detection limit); CD134, p=0; CXCR3, p=0.

FIG. 13A shows the analyses of PDIA3 expression signatures in cytotoxic T lymphocyte (CTL) are associated with better survival, where high expression of PDIA3 decreases the overall survival of CTL-high patients with GBM. FIG. 13B shows the analyses of PDIA3 expression signatures in cytotoxic T lymphocyte (CTL) are associated with better survival, where high expression of PDIA3 decreases the overall survival of CTL-high patients with TNBC. FIG. 13C shows the analyses of PDIA3 expression signatures in cytotoxic T lymphocyte (CTL) are associated with better survival, where high expression of PDIA3 decreases the overall survival of CTL-high patients with LUAD. FIG. 13D shows PDIA3 expression is linked to better survival in melanoma patients treated with Ipilimumab (anti-CTLA4).

FIG. 16A is a schematic showing human PDIA3$^{-/-}$-EGFRvIII CAR-T cell generation. CD8 T cells were electroporated with crPDIA3:tracRNA:Cas9 first, then PDIA3$^{-/-}$ T cells were knock-in (KI) with an EGFRvIII-CAR construct which consists of TRAC locus homology-directed repair (HDR) 5' and 3' arms, an EFS promoter, an EGFRvIII-CAR expression cassette, and a short polyA. The donor KI constructs were packaged into AAV6, then introduced into T cells by viral transduction after TRAC first-exon targeting RNP electroporation. U87-GFP-Luc-EGFRvIII (U87-GLEvIII) and PDIA3-EGFRvIII CAR-T cell co-culture assay was set up after CAR-T cells were established to test PDIA3$^{-/-}$-EGFRvIII CAR-T cell killing ability. FIGS. 16B-16D are graphs showing killing assays of NTC-EGFRvIII-CAR and PDIA3$^{-/-}$-EGFRvIII-CAR T cells with U87-GLEvIII and U87-GL (parental line control) human GBM cells, with a titration series of Effector:Target (E:T) ratios at 24h post co-culture: FIG. 16B is a kill assay with PDIA3-sg1, on U87-GLEvIII cells; FIG. 16C is a kill assay with PDIA3-sg2, on U87-GLEvIII cells; FIG. 16D is a kill assay with PDIA3-sg1, on U87-GL parental control cells; Data are shown as mean±s e.m., plus individual data points, n=5 biological replicates. Two-way ANOVA test was used to evaluated significance.

FIGS. 17A-17F show Splinkerette PCR identify genome integration of the Sleeping Beauty transposon. FIG. 17A is an illustration showing Nextera indel analysis for Mll3 and B2m knock-out in mouse CD8$^+$ T cells using AAV-sgRNA vectors. Shaded text indicates the Mll3 or B2m sgRNA (SEQ ID NOs: 69,775 and 69,787, respectively). Representative mutations and their frequencies were shown around predicted sgRNA target sites in the indicated tables (Mll3: SEQ ID NOs: 69,776-69,786; B2m: SEQ ID NOs: 69,788-69,798) FIG. 17B is a schematic of splinkerette PCR procedures. The steps include genomic DNA isolation, restriction enzyme digestion, adaptor ligation, PCR, NGS library prep, and sequencing. FIG. 17C displays electrophoresis of the splinkerette PCR products. The gel within red dash line was gel purified for the Nextera library preparation and sequencing. FIG. 17D shows representative SB transposon integration sites in the mouse genome (SEQ ID NOs: 69,799-69,804). FIG. 17E is a bar plot of splinkerette PCR read distribution for the number of integration sites along mouse chromosomes. FIG. 17F is a bar plot showing splinkerette PCR read distribution for the number of integration sites according to functional annotation of genomic regions.

FIG. 19A shows a bar plot of mortality rate of mouse after intracranial GBM induction. Different GBM cell lines, GL261, GL261-Luc-Ova, and GL261-Luc, were used for brain injection, and each cell line injected with different cell number. FIG. 19B is a bar plot of a number of mice that met euthanasia endpoints due to brain tumor growth FIGS. 20A-20F are a series of graphs showing AAV-Surf library transduced mouse CD8$^+$ T cell surface phenotypes and TCR repertoires before and after adoptive transfer. FIG. 20A shows flow cytometry analysis of surface PD-1, Lag3, and Tim-3 expression after transduced with AAV-Vector and AAV-Surf virus. Result from one experiment. FIGS. 20B-20C are flow cytometry analysis of proportion of PD-1$^+$ TILs. ns, non-significant. Data are shown as mean±s.e.m., with individual data points. FIG. 20D is a bar plot of T cell clonal composition from TCR sequencing. Pre injection, mouse CD8$^+$ T cells transduced with AAV-Surf virus and cultured for 5 days; Post injection (TIL), AAV-Surf transduced T cells i.v. injected into GBM-bearing mice and isolated as TILs at day 6 after T cell injection. FIG. 20E is a ring plot of TCR distribution for T cells before i.v. injection. Top TCR sequences were labeled in the plot. Sequence identities from top to bottom: 1. SEQ ID NO: 69,805, SEQ ID NO: 69,806, SEQ ID NO: 69,807; 2. SEQ ID NO: 69,808, SEQ ID NO: 69,809; 3. SEQ ID NO: 69,810, SEQ ID NO: 69,811; 4. SEQ ID NO: 69,812; 5. SEQ ID NO: 69,813, SEQ ID NO: 69,814, SEQ IS NO: 69,815.

FIG. 20F. is a ring plot of TCR distribution for T cells after i.v. injection (TILs). Top TCR sequences were labeled in the plot. Sequence identities from top to bottom: 1. SEQ ID NO: 69,816; 2. SEQ ID NO: 69,817; 3. SEQ ID NO: 69,818; 4. SEQ ID NO: 69,819; 5. SEQ ID NO: 69,820.

FIG. 21A shows quantification of tumor burden as total luciferase flux at days 12, 16, and 18. Day 20 and 22 data points were not used for statistics because most mice in the AAV-Vector group had already reached endpoint. Mice being imaged, n=8 for Vector, n=8 for sgMgat5, n=5 for sgPdia3. Data are shown as mean±s.e.m. plus individual data points on bar graphs. FIG. 21B shows quantification of tumor burden as total luciferase flux at days 14, 15, 17, 19, and 22 after tumor induction. Mice being imaged, n=7 for Vector, n=7 for sgMgat5, n=8 for sgPdia3, n=8 for sgMgat5$^+$sgPdia3. Data are shown as mean±s.e.m. plus individual data points on bar graphs. The numbers of mice that had reached endpoint, euthanized, and therefore removed from the imaging group are indicated on the top table.

DETAILED DESCRIPTION

Definitions

Figure 1A:
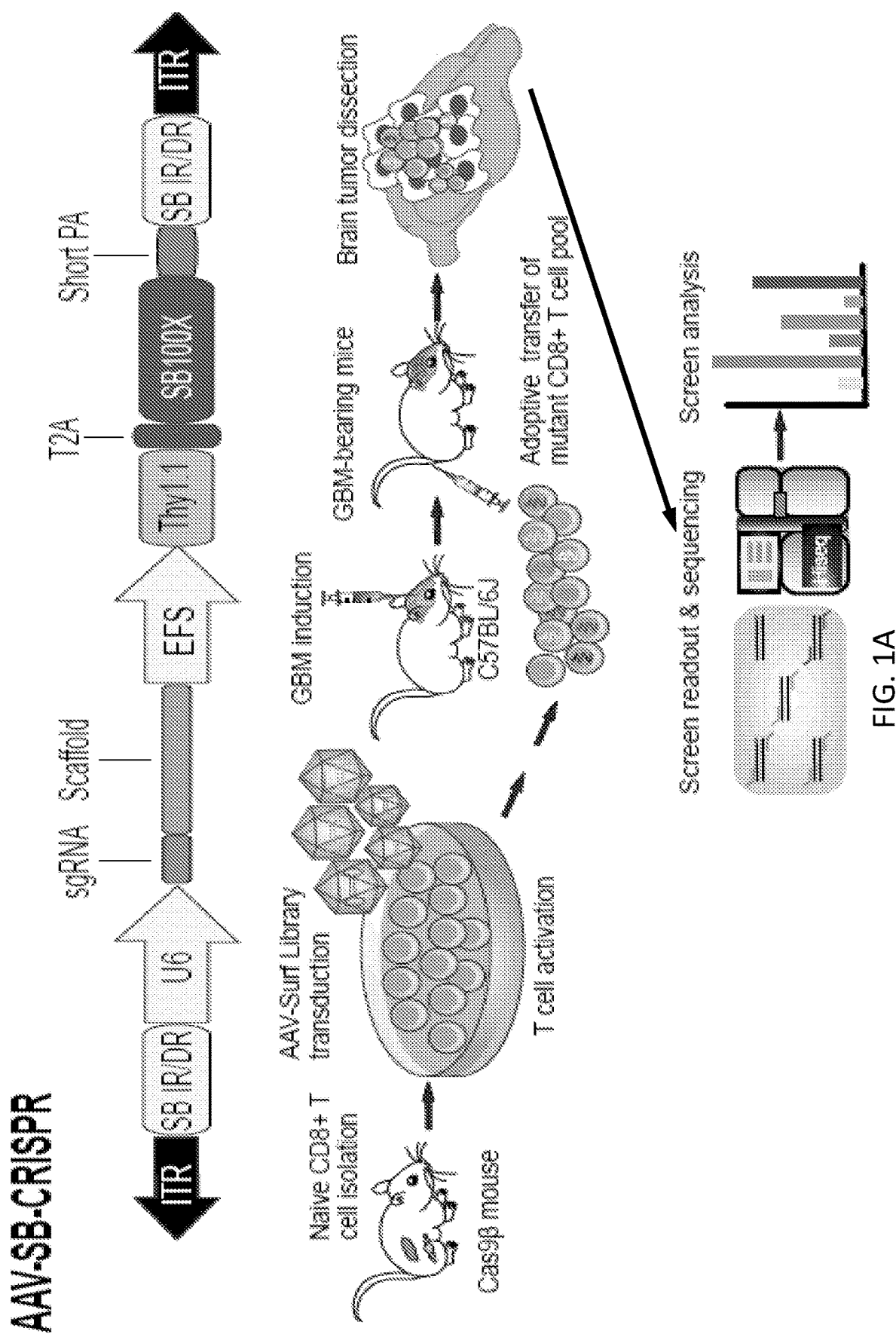

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20% or ±10%, more preferably ±5%, even more preferably ±1%, and still more preferably ±0.1% from the specified value, as such variations are appropriate to perform the disclosed methods.

As used herein the term "amount" refers to the abundance or quantity of a constituent in a mixture.

As used herein, the term "bp" refers to base pair.

The term "complementary" refers to the degree of antiparallel alignment between two nucleic acid strands. Complete complementarity requires that each nucleotide be across from its opposite. No complementarity requires that each nucleotide is not across from its opposite. The degree of complementarity determines the stability of the sequences to be together or anneal/hybridize. Furthermore various DNA repair functions as well as regulatory functions are based on base pair complementarity.

As used herein, a DNA or RNA nucleotide sequence as recited refers to a polynucleotide molecule comprising the indicated bases in a 5' to 3' direction, from left to right.

The term "CRISPR/Cas" or "clustered regularly interspaced short palindromic repeats" or "CRISPR" refers to DNA loci containing short repetitions of base sequences followed by short segments of spacer DNA from previous exposures to a virus or plasmid. Bacteria and archaea have evolved adaptive immune defenses termed CRISPR/CRISPR-associated (Cas) systems that use short RNA to direct degradation of foreign nucleic acids. In bacteria, the CRISPR system provides acquired immunity against invading foreign DNA via. RNA-guided DNA cleavage.

The "CRISPR/Cas" system or "CRISPR/Cas-mediated gene editing" refers to a CRISPR/Cas system that has been modified for genome editing/engineering. For a type II CRISPR/Cas system, it is typically comprised of a "guide" RNA (gRNA) and a non-specific CRISPR-associated endonuclease (Cas9). "Guide RNA (gRNA)" is used interchangeably herein with "short guide RNA (sgRNA)" or "single guide RNA" (sgRNA). The sgRNA is a short synthetic RNA composed of a "scaffold" sequence necessary for Cas9-binding and a user-defined ~20 nucleotide "spacer" or "targeting" sequence which defines the genomic target to be modified. The genomic target of Cas9 can be modified by changing the targeting sequence present in the sgRNA.

The term "cleavage" refers to the breakage of covalent bonds, such as in the backbone of a nucleic acid molecule or the hydrolysis of peptide bonds. Cleavage can be initiated by a variety of methods, including, but not limited to, enzymatic or chemical hydrolysis of a phosphodiester bond. Both single-stranded cleavage and double-stranded cleavage are possible. Double-stranded cleavage can occur as a result of two distinct single-stranded cleavage events. DNA cleavage can result in the production of either blunt ends or staggered ends. In certain embodiments, fusion polypeptides can be used for targeting cleaved double-stranded DNA.

A "disease" is a state of health of an animal wherein the animal cannot maintain homeostasis, and wherein if the disease is not ameliorated then the animal's health continues to deteriorate. In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

"Effective amount" or "therapeutically effective amount" are used interchangeably herein, and refer to an amount of a compound, formulation, material, or composition, as described herein effective to achieve a particular biological result or provides a therapeutic or prophylactic benefit. Such results may include, but are not limited to, anti-tumor activity as determined by any means suitable in the art.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

As used herein "endogenous" refers to any material from or produced inside an organism, cell, tissue or system.

The term "expression" as used herein is defined as the transcription and/or translation of a particular nucleotide sequence driven by its promoter.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., Sendai viruses, lentiviruses, retroviruses, adenoviruses, and adeno-associated viruses) that incorporate the recombinant polynucleotide.

"Homologous" as used herein, refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

The term "antibody," as used herein, refers to an immunoglobulin molecule that binds with an antigen. Antibodies can be intact immunoglobulins derived from natural sources or from recombinant sources, and can be immunoreactive portions of intact immunoglobulins. Antibodies are typically tetramers of immunoglobulin molecules. The antibody may exist in a variety of forms where the antibody is expressed as part of a contiguous polypeptide chain including, for example, a single domain antibody fragment (sdAb), a single chain antibody (scFv) and a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426).

The term "high affinity" as used herein refers to high specificity in binding or interacting or attraction of one molecule to a target molecule.

The term "antigen" or "Ag" as used herein is defined as a molecule that provokes an immune response. This immune response may involve either antibody production, or the activation of specific immunologically competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample. Such a biological sample can include, but is not limited to a tissue sample, a tumor sample, a cell or a biological fluid.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies are human immunoglobulins (recipient antibody) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, humanized antibodies can comprise residues which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin sequence. The humanized antibody optimally also will comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human," in the context of an immunoglobulin, refers to an immunoglobulin, such as an antibody, where the whole molecule is of human origin or consists of an amino acid sequence identical to a human form of the antibody.

"Identity" as used herein refers to the subunit sequence identity between two polymeric molecules particularly between two amino acid molecules, such as, between two polypeptide molecules. When two amino acid sequences have the same residues at the same positions; e.g., if a position in each of two polypeptide molecules is occupied by an Arginine, then they are identical at that position. The identity or extent to which two amino acid sequences have the same residues at the same positions in an alignment is often expressed as a percentage. The identity between two amino acid sequences is a direct function of the number of matching or identical positions; e.g., if half (e.g., five positions in a polymer ten amino acids in length) of the positions in two sequences are identical, the two sequences are 50% identical; if 90% of the positions (e.g., 9 of 10), are matched or identical, the two amino acids sequences are 90% identical.

The term "immune response" as used herein is defined as a cellular response to an antigen that occurs when lymphocytes identify antigenic molecules as foreign and induce the formation of antibodies and/or activate lymphocytes to remove the antigen.

As used herein, the term "autologous" is meant to refer to any material derived from the same individual to which it is later to be re-introduced into the individual.

"Allogeneic" refers to a graft derived from a different animal of the same species.

"Xenogeneic" refers to a graft derived from an animal of a different species.

"Chimeric antigen receptor" or "CAR" refers to an engineered receptor that is expressed on a T cell or any other effector cell type capable of cell-mediated cytotoxicity. The CAR comprises an extracellular domain having an antigen binding domain that is specific for a ligand or receptor. The CAR optionally also includes a transmembrane domain, and a costimulatory signaling domain. In some embodiments, the CAR comprises a hinge. In some embodiments, the antigen binding domain is specific for EGFRvIII. In some embodiments, the costimulatory signaling domain is a 4-1BB signaling domain. In some embodiments, the CAR further comprises a CD3 zeta signaling domain. A CAR-T cell is a T cell engineered to express a CAR.

"Costimulatory ligand," as the term is used herein, includes a molecule on an antigen presenting cell (e.g., an aAPC, dendritic cell, B cell, and the like) that specifically binds a cognate costimulatory molecule on a T cell, thereby providing a "second" signal which, in addition to the primary signal provided by, for instance, binding of a TCR/CD3 complex with an WIC molecule loaded with peptide, mediates a T cell response, including, but not limited to, proliferation, activation, differentiation, and the like.

A "costimulatory molecule" refers to the cognate binding partner on a T cell that specifically binds with a costimulatory ligand, thereby mediating a costimulatory response by the T cell, such as, but not limited to, proliferation. Costimulatory molecules include, but are not limited to CD28, CD27, and OX40.

As used herein, an "instructional material" includes a publication, a recording, a diagram, or any other medium of expression that can be used to communicate the usefulness of the compositions and methods of the invention. The instructional material of the kit of the invention may, for example, be affixed to a container that contains the nucleic acid, peptide, and/or composition of the invention or be shipped together with a container which contains the nucleic acid, peptide, and/or composition. Alternatively, the instructional material may be shipped separately from the container with the intention that the instructional material and compound be used cooperatively by the recipient.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "knockdown" as used herein refers to a decrease in gene expression of one or more genes.

The term "knockout" as used herein refers to the ablation of gene expression of one or more genes.

A "lentivirus" as used herein refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. Vectors derived from lentiviruses offer the means to achieve significant levels of gene transfer in vivo.

By the term "modified" as used herein, is meant a changed state or structure of a molecule or cell of the invention. Molecules may be modified in many ways, including chemically, structurally, and functionally. Cells may be modified through the introduction of nucleic acids.

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

A "mutation" as used herein is a change in a DNA sequence resulting in an alteration from a given reference sequence (which may be, for example, an earlier collected DNA sample from the same subject). The mutation can comprise deletion and/or insertion and/or duplication and/or substitution of at least one deoxyribonucleic acid base such as a purine (adenine and/or thymine) and/or a pyrimidine (guanine and/or cytosine). Mutations may or may not produce discernible changes in the observable characteristics (phenotype) of an organism (subject).

By "nucleic acid" is meant any nucleic acid, whether composed of deoxyribonucleosides or ribonucleosides, and whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil).

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "oligonucleotide" typically refers to short polynucleotides, generally no greater than about 60 nucleotides. It will be understood that when a nucleotide sequence is represented by a DNA sequence (i.e., A, T, G, C), this also includes an RNA sequence (i.e., A, U, G, C) in which "U" replaces "T".

"Parenteral" administration of an immunogenic composition includes, e.g., subcutaneous (s.c.), intravenous (i.v.), intramuscular (i.m.), or intrasternal injection, or infusion techniques.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means. Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

As used herein, the terms "polypeptide," "peptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "promoter" as used herein is defined as a DNA sequence recognized by the synthetic machinery of the cell, or introduced synthetic machinery, required to initiate the specific transcription of a polynucleotide sequence.

A "sample" or "biological sample" as used herein means a biological material from a subject, including but is not limited to organ, tissue, exosome, blood, plasma, saliva, urine and other body fluid. A sample can be any source of material obtained from a subject.

As used herein, the terms "sequencing" or "nucleotide sequencing" refer to determining the order of nucleotides (base sequences) in a nucleic acid sample, e.g. DNA or RNA. Many techniques are available such as Sanger sequencing and high-throughput sequencing technologies (also known as next-generation sequencing technologies) such as Illumina's HiSeq and MiSeq platforms or the GS FLX platform offered by Roche Applied Science.

"Single chain antibodies" refer to antibodies formed by recombinant DNA techniques in which immunoglobulin heavy and light chain fragments are linked to the Fv region via an engineered span of amino acids. Various methods of generating single chain antibodies are known, including those described in U.S. Pat. No. 4,694,778; Bird (1988) Science 242:423-442; Huston et al. (1988) Proc. Natl. Acad. Sci. USA 85:5879-5883; Ward et al. (1989) Nature 334: 54454; Skerra et al. (1988) Science 242:1038-1041.

By the term "specifically binds," as used herein with respect to an antibody, is meant an antibody which recognizes a specific antigen, but does not substantially recognize or bind other molecules in a sample. For example, an antibody that specifically binds to an antigen from one species may also bind to that antigen from one or more species. But, such cross-species reactivity does not itself alter the classification of an antibody as specific. In another example, an antibody that specifically binds to an antigen may also bind to different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

The term "subject" is intended to include living organisms in which an immune response can be elicited (e.g., mammals). A "subject" or "patient," as used therein, may be a human or non-human mammal. Non-human mammals include, for example, livestock and pets, such as ovine, bovine, porcine, canine, feline and murine mammals. Preferably, the subject is human.

A "target site" or "target sequence" refers to a genomic nucleic acid sequence that defines a portion of a nucleic acid to which a binding molecule may specifically bind under conditions sufficient for binding to occur.

As used herein, the term "T cell receptor" or "TCR" refers to a complex of membrane proteins that participate in the activation of T cells in response to the presentation of antigen. The TCR is responsible for recognizing antigens bound to major histocompatibility complex molecules. TCR is composed of a heterodimer of an alpha ($\alpha$) and beta ($\beta$) chain, although in some cells the TCR consists of gamma and delta ($\gamma/\delta$) chains. TCRs may exist in $\alpha/\beta$ and $\gamma/\delta$ forms, which are structurally similar but have distinct anatomical locations and functions. Each chain is composed of two extracellular domains, a variable and constant domain. In some embodiments, the TCR can be modified on any cell comprising a TCR, including, for example, a helper T cell, a cytotoxic T cell, a memory T cell, regulatory T cell, natural killer T cell, and/or gamma delta T cell.

The term "therapeutic" as used herein means a treatment and/or prophylaxis. A therapeutic effect is obtained by suppression, remission, or eradication of a disease state.

The term "transfected" or "transformed" or "transduced" as used herein refers to a process by which exogenous nucleic acid is transferred or introduced into the host cell. A "transfected" or "transformed" or "transduced" cell is one that has been transfected, transformed or transduced with exogenous nucleic acid. The cell includes the primary subject cell and its progeny.

To "treat" a disease as the term is used herein, means to reduce the frequency or severity of at least one sign or symptom of a disease or disorder experienced by a subject.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, Sendai viral vectors, adenoviral vectors, adeno-associated virus vectors, retroviral vectors, lentiviral vectors, and the like.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

Description

The present invention provides compositions and methods for treating cancer, including glioblastoma (GBM), and/or enhancing CD8$^+$ T cell anti-tumor activity in a subject in need thereof.

Membrane-bound proteins are most amenable to monoclonal antibody (mAb)-based therapies, thus representing a class of prime targets for clinical translatability. Thus, the present study focused on the identification of membrane targets for enhancement of CD8$^+$ T cell activity against GBM. A focused CRISPR library, which only targets surface protein encoding genes, was designed, cloned, and packaged. Then regulators of CD8$^+$ T cells that modulate anti-tumor activities in GBM were screened for. Multiple previously undocumented genes (Mgat5, Pdia3, and Emp1) were identified and validated. Knockouts of these genes in CD8$^+$ T cells enhanced the survival of GBM-bearing mice with adoptive transfer across several models, providing promising novel targets for enhancing T cell based immunotherapy efficacy against GBM.

Compositions

In one aspect, the invention includes a genetically modified cell wherein at least one gene selected from the group consisting of Mgat5, Pdia3, Lag3, Emp1 has been mutated in the cell. The cell can be any type of cell including but not limited to CD8$^+$, CD4$^+$, T regulatory (Treg) cells, and CAR-T cells. In some embodiments, the cell is a CD8$^+$ T cell. The genetically modified cell can be for use in treating cancer and/or enhancing CD8$^+$ T cell anti-tumor activity, and can be generated by the methods described herein. Additional genes can be mutated in the cell. In other words, the invention includes a cell wherein a single gene or multiple genes are mutated.

The invention also includes two sgRNA libraries. In some embodiments, one of the sgRNA libraries (mmSurf) comprises a plurality of nucleic acids comprising a nucleotide sequence selected from the group consisting of SEQ ID NOs. 1-6,628. In further embodiments, the library further comprises the a nucleotide sequence selected from the group consisting of SEQ ID NOs. 6,629-7,628. In some embodiments, the sgRNA library comprises a plurality of nucleic acids consisting of the nucleotide sequences of SEQ ID NOs. 1-6,628. In further embodiments, the library further comprises a plurality of nucleic acids consisting of nucleotide sequences of SEQ ID NOs. 6,629-7,628. In some embodiments, the sgRNA library comprises a plurality of nucleic acids comprising at least one nucleotide sequence selected from the group consisting of SEQ ID NOs: 1-6,628. In some embodiments, one of the sgRNA libraries (mSURFEOME2) comprises a plurality of nucleic acids comprising a nucleotide sequence selected from the group consisting of SEQ ID NOs. 7,837-64,747. In further embodiments, the library further comprises the nucleotide sequence selected from the group consistent of SEQ ID NOs. 64,748-69,747. In some embodiments, the sgRNA library comprises a plurality of nucleic acids consisting of the nucleotide sequences of SEQ ID NOs. 7,837-64,747. In further embodiments, the library further comprises a plurality of nucleic acids consisting of nucleotide sequences of SEQ ID NOs. 64,748-69,747. In some embodiments, the sgRNA library comprises a plurality of nucleic acids comprising at least one nucleotide sequence selected from the group consisting of SEQ ID NOs. 7,837-64,747.

In certain embodiments, the library can be packaged into a vector. Any vector known to one of ordinary skill in the art can be used, including but not limited to lentiviral vectors, adenoviral vectors, and adeno-associated viral (AAV) vectors.

Another aspect of the invention includes an AAV library, e.g. an AAV-Surf library. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-6,628. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-7,628. In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs: 7,837-64,747. In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs: 7,837-69,747. In some embodiments, at least one of the vectors comprises SEQ ID NO: 69,821.

The invention also includes a kit comprising an AAV library, wherein the AAV library comprises a plurality of vectors, wherein each vector comprises an expression cassette for an sgRNA comprising a nucleotide sequence selected from the group consisting of SEQ ID NOs: 1-6,628. In some embodiments, the AAV library in the kit comprises a plurality of vectors, wherein each vector comprises an expression cassette for an sgRNA comprising a nucleotide sequence selected from the group consisting of SEQ ID NOs: 1-7,628. In some embodiments, the AAV library in the kit comprises a plurality of vectors, wherein each vector comprises an expression cassette for an sgRNA comprising a nucleotide sequence selected from the group consisting of SEQ ID NOs: 7,837-64,747. In some embodiments, the AAV library in the kit comprises a plurality of vectors, wherein each vector comprises an expression cassette for an sgRNA comprising a nucleotide sequence selected from the group consisting of SEQ ID NOs: 7,837-69,747. The kit also includes instructional material for use thereof. Instructional material can include directions for using the kit as well as information on interpreting results generated from the kit. In some embodiments, at least one of the vectors comprises SEQ ID NO: 69,821.

Another aspect of the invention includes an AAV-CRISPR T cell vector for efficient gene editing and high-throughput screen in T cells. The vector comprises an antibiotic resistance sequence, two ITRs, two sleeping beauty (SB) IR/DR repeats, a RNA polIII promoter (e.g. U6), an sgRNA (spacer and tracrRNA backbone), a promoter (EFS), a Thy1.1 selection marker, an SB100x transposase, and a short poly A. In some embodiments, the vector comprises SEQ ID NO: 69,821.

With regard to any of the sgRNA libraries or AAV libraries comprising the SEQ ID NOs. 1-6,628 and/or 6,629-7,628, it should be understood by one of ordinary skill in the art that the invention is construed to encompass every individual SEQ ID NO. in the range(s) and all combinations thereof. With regard to any of the sgRNA libraries or AAV libraries comprising the SEQ ID NOs. 7,837-64,747 and/or 64,748-69,747, it should be understood by one of ordinary skill in the art that the invention is construed to encompass every individual SEQ ID NO. in the range(s) and all combinations thereof.

In some embodiments, the sgRNA library comprises about 100 or more sequences. In some embodiments, the library comprises about 1,000 or more sequences. In some embodiments, the library comprises about 10,000 or more sequences. In further embodiments, the library comprises about 20,000 or more sequences. In yet further embodiments, the library comprises about 30,000 or more sequences. In yet further embodiments, the library comprises about 40,000 or more sequences.

Methods

In one aspect, the invention includes a method of treating a disease, disorder, or condition in a subject in need thereof. In some embodiments, the disease is cancer. Another aspect includes a method of enhancing CD8$^+$ T cell anti-tumor activity in a subject in need thereof. In certain embodiments, the method comprises administering to a subject in need thereof a genetically modified cell wherein a gene selected from the group consisting of Mgat5, Pdia3, Lag3, and Emp1 has been targeted in the cell. Types of modified cells that can be used in the invention include, but are not limited to, T cells, primary immune cells, hematopoietic stem cells (HSC), macrophages, natural killer (NK) cells, and dendritic cells (DC).

Additional genes can be targeted by the methods of the invention. Examples of these genes include, but are not limited to, Cdh11, Hfe2, Slc29a1, Pld3, Xc3cl1, P4ha1, Rnpep, Man2a1, Tmem123, Vpreb1, Tspan3, Eprs, Chrna4, Ctlc, Ly9, Epha3, Lgals3bp, Plat, Lrrc8b, Crhr1, Vpreb1, Upk1a, Rnpep, Fgb, Vegfa or Kdr.

The gene or genes that are targeted can be transcriptionally repressed and/or translationally repressed and/or undergo targeted degradation and/or targeted by other targeting methods. Other targeting methods include, but are not limited to, dCas9 coupled with transcriptional repressors, antibodies, small molecule inhibitors, and the like.

In another aspect, the invention includes a method of stimulating a T cell comprising mutating at least one gene selected from the group consisting of Mgat5, Pdia3, and Emp1 in the T cell. In some embodiments, stimulating the T cell results in increased interferon-gamma production by the T cell and/or in increased cytotoxicity of the T cell.

Another aspect of the invention includes a method of stimulating a T cell comprising contacting the T cell with a therapeutically effective amount of an inhibitor of at least one gene selected from the group consisting of Mgat5, Pdia3, and Emp1. In certain embodiments, the inhibitor is selected from the group consisting of an antibody, an siRNA, and a CRISPR system. In certain embodiments the CRISPR system comprises a Cas9, and at least one sgRNA complementary to Mgat5, Pdia3, or Emp1.

In another aspect, the invention includes a method of performing genome editing and screening of a T cell for a mutation in vitro. The method comprises contacting the T cell with Cas9 and an AAV library. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-6,628. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-7,628.

In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs. 7,837-64,747. In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs. 7,837-69,747.

The T cell undergoes genome editing and is then screened for a mutation in vitro.

Another aspect of the invention includes a method of performing genome editing and screening of a T cell for a mutation in vivo. The method comprises contacting the T cell with Cas9 and an AAV library. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-6,628. In some embodiments, the AAV library (AAV-mmSurf) comprises a plurality of vectors, wherein each vector comprises an expression cassette for an sgRNA comprising a nucleotide sequence selected from the group consisting of SEQ ID NOs: 1-7,628.

In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs. 7,837-64,747. In some embodiments, the AAV library (AAV-mSURFEOME2) comprises a plurality of vectors, wherein each vector comprises an expression cassette for an sgRNA comprising a nucleotide sequence selected from the group consisting of SEQ ID NOs. 7,837-69,747.

The modified T cell is administered to a subject and the T cell is screened for a mutation in vivo.

The invention also includes a method of generating a genetically modified T cell. The method comprises administering to a naïve T cell Cas9 and a vector. In some embodiments, the vector comprises an expression cassette for an sgRNA comprising a nucleotide sequence selected from the group consisting of SEQ ID NOs: 1-6,628. In some embodiments, the vector comprises an expression cassette for an sgRNA comprising a nucleotide sequence selected from the group consisting of SEQ ID NOs. 7,837-64,747.

In some embodiments, the sgRNA targets a gene selected from the group consisting of Mgat5, Pdia3, and Emp1.

The T cell of the present invention can be of any subset of T cells, including but not limited to a CD8$^+$ cell, a CD4$^+$ cell, a T regulatory (Treg) cell, a Th1 cell, a Th2 cell, a Th17 cell, a follicular helper T cell (Tfh), a T memory cell, a T effector cell, a T effector memory cell, an engineered T cell, and a chimeric antigen receptor (CAR) T cell. In certain embodiments of the method, the T cell can be further isolated and/or enriched.

In certain embodiments, the subject is a human. In certain embodiments, the subject has glioblastoma (GBM). The cells of the present invention may be administered by any means known to one of ordinary skill in the art. In some embodiments, the cells are administered by intracranial injection. In some embodiments, the cells are injected into the lateral ventricle.

The method can further comprise administering an additional treatment to the subject. Additional treatments include but are not limited to chemotherapy, radiation, surgery, any immune checkpoint inhibitor, any PD-1 inhibitor, and any CTLA-4 inhibitor.

In any of the cells or methods of the present invention, a gene can be mutated by a CRISPR method. CRISPR methods are known to those of ordinary skill in the art and are discussed in detail elsewhere herein. In one non-limiting example, the T cell of the invention is mutated by administration of Cas9 and an AAV library comprised of a plurality of vectors, wherein each vector comprises an expression cassette for an sgRNA comprising a nucleotide sequence selected from the group consisting of SEQ ID NOs: 1-6,628. In one non-limiting example, the T cell of the invention is mutated by administration of Cas9 and an AAV library comprised of a plurality of vectors, wherein each vector comprises an expression cassette for an sgRNA comprising a nucleotide sequence selected from the group consisting of SEQ ID NOs. 7,837-64,747.

In certain embodiments, additional genes are mutated in the T cell.

In certain embodiments, screening T cells after the AAV library has been administered to the subject provides information about the specific genes involved in a condition afflicting the subject. Any condition can be screened for. In some embodiments, the condition is cancer. In some embodiments, the cancer is GBM. Screening T cells can comprise any method commonly known to one of ordinary skill in the art including but not limited to methods of nucleotide sequencing, sgRNA PCR, and/or flow cytometry.

Nucleotide sequencing or "sequencing", as it is commonly known in the art, can be performed by standard methods commonly known to one of ordinary skill in the art. In certain embodiments of the invention sequencing is performed via next-generation sequencing. Next-generation sequencing (NGS), also known as high-throughput sequencing, is used herein to describe a number of different modern sequencing technologies that allow sequencing of DNA and RNA much more quickly and cheaply than the previously used Sanger sequencing (Metzker, 2010, Nature Reviews Genetics 11.1: 31-46). It is based on micro- and nanotechnologies to reduce the size of sample, the reagent costs, and to enable massively parallel sequencing reactions. It can be highly multiplexed which allows simultaneous sequencing and analysis of millions of samples. NGS includes first, second, third as well as subsequent Next Generations Sequencing technologies. Data generated from NGS can be analyzed via a broad range of computational tools. The wide variety of analysis can be appreciated and performed by those skilled in the art.

Genome editing can include introducing mutations throughout the genome of the cell. The mutations introduced can be any combination of insertions or deletions, including but not limited to a single base insertion, a single base deletion, a frameshift, a rearrangement, and an insertion or deletion of 2, 3, 4, 5, 6, 7, 8, 9, 10, 15, 20, 25, 30, 40, 50, 60, 70, 80, 90, 100, 150, 200, 250, 300, any and all numbers in between, bases. The mutation can occur in a gene or in a non-coding region.

Cancer and Other Diseases, Disorders or Conditions

Certain embodiments of the invention include compositions and methods for treating a disease, disorder or condition. Any disease, disorder or condition that can be targeted by a $CD8^+$ T cell and/or wherein binding to the cognate antigen causes degranulation in the $CD8^+$ T cell can be treated with the compositions of the present invention. Diseases, disorders or conditions that can be treated include but are not limited to autoimmune diseases, inflammation, neuroimmune disorders, and other immune system disorders.

Immune system disorders include, but are not limited to: 22q11.2 deletion syndrome, Achondroplasia and severe combined immunodeficiency, Adenosine Deaminase 2 deficiency, Adenosine deaminase deficiency, Adult-onset immunodeficiency with anti-interferon-gamma autoantibodies, Agammaglobulinemia, non-Bruton type, Aicardi-Goutieres syndrome, Aicardi-Goutieres syndrome type 5, Allergic bronchopulmonary aspergillosis, Alopecia areata, Alopecia totalis, Alopecia universalis, Amyloidosis AA, Amyloidosis familial visceral, Ataxia telangiectasia, Autoimmune lymphoproliferative syndrome, Autoimmune lymphoproliferative syndrome due to CTLA4 haploinsufficiency, Autoimmune polyglandular syndrome type 1, Autosomal dominant hyper IgE syndrome, Autosomal recessive early-onset inflammatory bowel disease, Autosomal recessive hyper IgE syndrome, Bare lymphocyte syndrome 2, Barth syndrome, Blau syndrome, Bloom syndrome, Bronchiolitis obliterans, C1q deficiency, Candidiasis familial chronic mucocutaneous, autosomal recessive, Cartilage-hair hypoplasia, CHARGE syndrome, Chediak-Higashi syndrome, Cherubism, Chronic atypical neutrophilic dermatosis with lipodystrophy and elevated temperature, Chronic graft versus host disease, Chronic granulomatous disease, Chronic Infantile Neurological Cutaneous Articular syndrome, Chronic mucocutaneous candidiasis (CMC)-Not a rare disease, Cohen syndrome, Combined immunodeficiency with skin granulomas, Common variable immunodeficiency, Complement component 2 deficiency, Complement component 8 deficiency type 1, Complement component 8 deficiency type 2, Congenital pulmonary alveolar proteinosis, Cryoglobulinemia, Cutaneous mastocytoma, Cyclic neutropenia, Deficiency of interleukin-1 receptor antagonist, Dendritic cell, monocyte, B lymphocyte, and natural killer lymphocyte deficiency, Dyskeratosis congenital, Dyskeratosis congenita autosomal dominant, Dyskeratosis congenita autosomal recessive, Dyskeratosis congenita X-linked, Epidermodysplasia verruciformis, Familial amyloidosis, Finnish type, Familial cold autoinflammatory syndrome, Familial Mediterranean fever, Familial mixed cryoglobulinemia, Felty's syndrome, Glycogen storage disease type 1B, Griscelli syndrome type 2, Hashimoto encephalopathy, Hashimoto's syndrome-Not a rare disease, Hemophagocytic lymphohistiocytosis, Hennekam syndrome, Hepatic venoocclusive disease with immunodeficiency, Hereditary folate malabsorption, Hermansky Pudlak syndrome 2, Herpes simplex encephalitis, Hoyeraal Hreidarsson syndrome, Hyper IgE syndrome, Hyper-IgD syndrome, ICF syndrome, Idiopathic acute eosinophilic pneumonia, Idiopathic CD4 positive T-lymphocytopenia, IL12RB1 deficiency, Immune defect due to absence of thymus, Immune dysfunction with T-cell inactivation due to calcium entry defect 1, Immune dysfunction with T-cell inactivation due to calcium entry defect 2, Immunodeficiency with hyper IgM type 1, Immunodeficiency with hyper IgM type 2, Immunodeficiency with hyper IgM type 3, Immunodeficiency with hyper IgM type 4, Immunodeficiency with hyper IgM type 5, Immunodeficiency with thymoma, Immunodeficiency without anhidrotic ectodermal dysplasia, Immunodysregulation, polyendocrinopathy and enteropathy X-linked, Immunoglobulin A deficiency 2, Intestinal atresia multiple, IRAK-4 deficiency, Isolated growth hormone deficiency type 3, Kawasaki disease, Large granular lymphocyte leukemia, Leukocyte adhesion deficiency type 1, LRBA deficiency, Lupus—Not a rare disease, Lymphocytic hypophysitis, Majeed syndrome, Melkersson-Rosenthal syndrome, MEW class 1 deficiency, Muckle-Wells syndrome, Multifocal fibrosclerosis, Multiple sclerosis, MYD88 deficiency, Neonatal systemic lupus erythematosus, Netherton syndrome, Neutrophil-specific granule deficiency, Nijmegen breakage syndrome, Omenn syndrome, Osteopetrosis autosomal recessive 7, Palindromic rheumatism, Papillon Lefevre syndrome, Partial androgen insensitivity syndrome, PASLI disease, Pearson syndrome, Pediatric multiple sclerosis, Periodic fever, aphthous stomatitis, pharyngitis and adenitis, PGM3-CDG, Poikiloderma with neutropenia, Pruritic urticarial papules plaques of pregnancy, Purine nucleoside phosphorylase deficiency, Pyogenic arthritis, pyoderma gangrenosum and acne, Relapsing polychondritis, Reticular dysgenesis, Sarcoidosis, Say Barber Miller syndrome, Schimke immunoosseous dysplasia, Schnitzler syndrome, Selective IgA deficiency, Selective IgM deficiency, Severe combined immunodeficiency, Severe combined immunodeficiency due to complete RAG1/2 deficiency, Severe combined immunodeficiency with sensitivity to ionizing radiation, Severe combined immunodeficiency, atypical, Severe congenital neutropenia autosomal recessive 3, Severe congenital neutropenia X-linked, Shwachman-Diamond syndrome, Singleton-Merten syndrome, SLC35C1-CDG (CDG-IIc), Specific antibody deficiency, Spondyloenchondrodysplasia, Stevens-Johnson syndrome, T-cell immunodeficiency, congenital alopecia and nail dystrophy, TARP syndrome, Trichohepatoenteric syndrome, Tumor necrosis factor receptor-associated periodic syndrome, Twin to twin transfusion syndrome, Vici syndrome, WHIM syndrome, Wiskott Aldrich syndrome, Woods Black Norbury syndrome, X-linked agammaglobulinemia, X-linked lymphoproliferative syndrome, X-linked lymphoproliferative syndrome 1, X-linked lymphoproliferative syndrome 2, X-linked magnesium deficiency with Epstein-Barr virus infection and neoplasia, X-linked severe combined immunodeficiency, and ZAP-70 deficiency.

Autoimmune diseases (not mutually exclusive with list of immune system disorders) include but are not limited to Achalasia, Addison's disease, Adult Still's disease, Agammaglobulinemia, Alopecia areata, Amyloidosis, Ankylosing spondylitis, Anti-GBM/Anti-TBM nephritis, Antiphospholipid syndrome, Autoimmune angioedema, Autoimmune dysautonomia, Autoimmune encephalomyelitis, Autoimmune hepatitis, Autoimmune inner ear disease (AIED), Autoimmune myocarditis, Autoimmune oophoritis, Autoimmune orchitis, Autoimmune pancreatitis, Autoimmune retinopathy, Autoimmune urticaria, Axonal & neuronal neuropathy (AMAN), Baló disease, Behcet's disease, Benign mucosal pemphigoid, Bullous pemphigoid, Castleman disease (CD), Celiac disease, Chagas disease, Chronic inflammatory demyelinating polyneuropathy (CIDP), Chronic recurrent multifocal osteomyelitis (CRMO), Churg-Strauss Syndrome (CSS) or Eosinophilic Granulomatosis (EGPA), Cicatricial pemphigoid, Cogan's syndrome, Cold agglutinin disease, Congenital heart block, Coxsackie myocarditis, CREST syndrome, Crohn's disease, Dermatitis herpetiformis, Dermatomyositis, Devic's disease (neuromyelitis optica), Discoid lupus, Dressler's syndrome, Endometriosis, Eosinophilic esophagitis (EoE), Eosinophilic fasciitis, Erythema nodosum, Essential mixed cryoglobulinemia, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis, Graves' disease, Guillain-Barre syndrome, Hashimoto's thyroiditis, Hemolytic anemia, Henoch-Schonlein purpura (HSP), Herpes gestationis or pemphigoid gestationis (PG), Hidradenitis Suppurativa (HS) (Acne Inversa), Hypogammalglobulinemia, IgA Nephropathy, IgG4-related sclerosing disease, Immune thrombocytopenic purpura (ITP), Inclusion body myositis (IBM), Interstitial cystitis (IC), Juvenile arthritis, Juvenile diabetes (Type 1 diabetes), Juvenile myositis (JM), Kawasaki disease, Lambert-Eaton syndrome, Leukocytoclastic vasculitis, Lichen planus, Lichen sclerosus, Ligneous conjunctivitis, Linear IgA disease (LAD), Lupus, Lyme disease chronic, Meniere's disease, Microscopic polyangiitis (MPA), Mixed connective tissue disease (MCTD), Mooren's ulcer, Mucha-Habermann disease, Multifocal Motor Neuropathy (MMN) or MMNCB, Multiple sclerosis, Myasthenia gravis, Myositis, Narcolepsy, Neonatal Lupus, Neuromyelitis optica, Neutropenia, Ocular cicatricial pemphigoid, Optic neuritis, Palindromic rheumatism (PR), PANDAS, Paraneoplastic cerebellar degeneration (PCD), Paroxysmal nocturnal hemoglobinuria (PNH), Parry Romberg syndrome, Pars planitis (peripheral uveitis), Parsonnage-Turner syndrome, Pemphigus, Peripheral neuropathy, Perivenous encephalomyelitis, Pernicious anemia (PA), POEMS syndrome, Polyarteritis nodosa, Polyglandular syndromes type I, II, III, Polymyalgia rheumatica, Polymyositis, Postmyocardial infarction syndrome, Postpericardiotomy syndrome, Primary biliary cirrhosis, Primary sclerosing cholangitis, Progesterone dermatitis, Psoriasis, Psoriatic arthritis, Pure red cell aplasia (PRCA), Pyoderma gangrenosum, Raynaud's phenomenon, Reactive Arthritis, Reflex sympathetic dystrophy, Relapsing polychondritis, Restless legs syndrome (RLS), Retroperitoneal fibrosis, Rheumatic fever, Rheumatoid arthritis, Sarcoidosis, Schmidt syndrome, Scleritis, Scleroderma, Sjögren's syndrome, Sperm & testicular autoimmunity, Stiff person syndrome (SPS), Subacute bacterial endocarditis (SBE), Susac's syndrome, Sympathetic ophthalmia (SO), Takayasu's arteritis, Temporal arteritis/Giant cell arteritis, Thrombocytopenic purpura (TTP), Tolosa-Hunt syndrome (THS), Transverse myelitis, Type 1 diabetes, Ulcerative colitis (UC), Undifferentiated connective tissue disease (UCTD), Uveitis, Vasculitis, Vitiligo, Vogt-Koyanagi-Harada Disease, and Wegener's granulomatosis (or Granulomatosis with Polyangiitis (GPA)).

The invention includes compositions and methods for treating cancer. Types of cancer that can be treated include, but are not limited to, Acute Lymphoblastic Leukemia (ALL), Acute Myeloid Leukemia (AML), Adrenocortical Carcinoma, AIDS-Related Cancers, Kaposi Sarcoma, AIDS-Related Lymphoma, Primary CNS Lymphoma, Anal Cancer, Appendix Cancer (Gastrointestinal Carcinoid Tumors), Astrocytomas, Atypical Teratoid/Rhabdoid Tumor, Brain Cancer, Basal Cell Carcinoma of the Skin, Bile Duct Cancer, Bladder Cancer, Bone Cancer (includes Ewing Sarcoma and Osteosarcoma and Malignant Fibrous Histiocytoma), Brain Tumors, Breast Cancer, Bronchial Tumors, Burkitt Lymphoma, Non-Hodgkin Lymphoma, Carcinoid Tumors, Carcinoma of Unknown Primary, Cardiac (Heart) Tumors, Embryonal Tumors, Germ Cell Tumor, Primary CNS Lymphoma, Cervical Cancer, Cholangiocarcinoma, Chordoma, Chronic Lymphocytic Leukemia (CLL), Chronic Myelogenous Leukemia (CIVIL), Chronic Myeloproliferative Neoplasms, Colorectal Cancer, Craniopharyngioma, Cutaneous T-Cell Lymphoma (Mycosis Fungoides and Sézary Syndrome), Ductal Carcinoma In Situ (DCIS), Endometrial Cancer, Ependymoma, Esophageal Cancer, Esthesioneuroblastoma, Ewing Sarcoma, Extracranial Germ Cell Tumor, Eye Cancer, Intraocular Melanoma, Fallopian Tube Cancer, Fibrous Histiocytoma of Bone, Osteosarcoma, Gallbladder Cancer, Gastric Cancer, Stomach Cancer, Gastrointestinal Carcinoid Tumor, Gastrointestinal Stromal Tumors (GIST), Central Nervous System Germ Cell Tumors, Extracranial Germ Cell Tumors, Extragonadal Germ Cell Tumors, Ovarian Germ Cell Tumors, Testicular Cancer, Gestational Trophoblastic Disease, Hairy Cell Leukemia, Head and Neck Cancer, Heart Tumors, Hepatocellular (Liver) Cancer, Histiocytosis (Langerhans Cell), Hodgkin Lymphoma, Hypopharyngeal Cancer, Intraocular Melanoma, Islet Cell Tumors, Pancreatic Neuroendocrine Tumors, Kidney Cancer, Renal Cell Cancer, Langerhans Cell Histiocytosis, Laryngeal Cancer, Leukemia, Lip and Oral Cavity Cancer, Liver Cancer, Lung Cancer (Non-Small Cell and Small Cell), Lymphoma, Male Breast Cancer, Malignant Fibrous Histiocytoma of Bone and Osteosarcoma, Melanoma, Intraocular (Eye) Melanoma, Merkel Cell Carcinoma (Skin Cancer), Malignant Mesothelioma, Metastatic Cancer, Metastatic Squamous Neck Cancer with Occult Primary, Midline Tract Carcinoma With NUT Gene Changes, Mouth Cancer, Multiple Endocrine Neoplasia Syndromes, Multiple Myeloma/Plasma Cell Neoplasms, Mycosis Fungoides (Lymphoma), Myelodysplastic Syndromes, Myelodysplastic/Myeloproliferative Neoplasms, Nasal Cavity and Paranasal Sinus Cancer, Nasopharyngeal Cancer, Neuroblastoma, Non-Small Cell Lung Cancer, Oral Cancer, and Oropharyngeal Cancer, Ovarian Cancer, Pancreatic Cancer, Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Plasma Cell Neoplasm/Multiple Myeloma, Pleuropulmonary Blastoma, Primary Central Nervous System (CNS) Lymphoma, Primary Peritoneal Cancer, Prostate Cancer, Rectal Cancer, Recurrent Cancer, Retinoblastoma, Rhabdomyosarcoma, Salivary Gland Cancer, Sarcoma, Vascular Tumors, Uterine Sarcoma, Sézary Syndrome (Lymphoma), Small Cell Lung Cancer, Small Intestine Cancer, Soft Tissue Sarcoma, Squamous Cell Carcinoma, Stomach (Gastric) Cancer, Throat Cancer, Thymoma, Thymic Carcinoma, Thyroid Cancer, Transitional Cell Cancer of the Renal Pelvis and Ureter, Carcinoma of Unknown Primary, Ureter and Renal Pelvis, Transitional Cell Cancer, Urethral Cancer, Uterine Cancer, Vaginal Cancer, Vulvar Cancer, Wilms Tumor, and combinations thereof.

In certain embodiments, the subject can be administered an additional treatment. For example, the subject can be administered a combination of a composition of the present invention and an additional treatment. Examples of additional treatments include but are not limited to, chemotherapy, radiation, surgery, medication, immune checkpoint inhibitors, immune checkpoint blockade (ICB) antibodies, immune checkpoint inhibitors that block CTLA-4 or PD1, anti-CTLA4 monoclonal antibody, anti-PD1 monoclonal antibody, anti-PD-L1 monoclonal antibody, adoptive cell transfer, human recombinant cytokines, cancer vaccines, immunotherapy, targeted therapy, hormone therapy, stem cell transplant, precision medicine, non-specific immunotherapy (e.g. cytokines and chemokines, such as IL-2, IFNa, IFNb, IFNg), oncolytic virus therapy, T-cell therapy (e.g. adoptive transfer of TILs, CAR-T therapy), cancer vaccines (e.g. conventional DC vaccine), Ipilimumab (Yervoy), Nivolumab (Opdivo), Pembrolizumab (Keytruda), Atezolizumab (Tecentriq), Avelumab (Bavencio), Durvalumab (Imfinzi), Anti-LAG-3, anti-TIM1, Anti-TIM3, Anti-CSF-R, IDO inhibitor, OX-40 agonist, GITR agonist, CD80 agonist, CD86 agonist, ICOS agonist, ICOSLG agonist, CD276 agonist, VTCN1 agonist, TNFSF14 agonist, TNFSF9 agonist, TNFSF4 agonist, CD70 agonist, CD40 agonist, LGALS9 agonist, CD80 inhibitor, CD86 inhibitor, ICOS inhibitor, ICOSLG inhibitor, CD276 inhibitor, VTCN1 inhibitor, TNFSF14 inhibitor, TNFSF9 inhibitor, TNFSF4 inhibitor, CD70 inhibitor, CD40 inhibitor, LGALS9 inhibitor, TLR9 agonist, CD20 antibody, CD80 antibody, TIGIT antibody, B7-H1 antibody, B7-H2 antibody, B7-H3 antibody, B7-H4 antibody, CD28 antibody, CD47 antibody, anti-BTLA, anti-Galetin9, anti-IL15R, anti-GD2. In some embodiments the monoclonal antibody is fully human, humanized or chimeric.

CRISPR/Cas9

The CRISPR/Cas9 system is a facile and efficient system for inducing targeted genetic alterations. Target recognition by the Cas9 protein requires a 'seed' sequence within the guide RNA (gRNA) and a conserved dinucleotide containing protospacer adjacent motif (PAM) sequence upstream of the gRNA-binding region. The CRISPR/Cas9 system can thereby be engineered to cleave virtually any DNA sequence by redesigning the gRNA in cell lines (such as 293T cells), primary cells, and CAR T cells. The CRISPR/Cas9 system can simultaneously target multiple genomic loci by co-expressing a single Cas9 protein with two or more gRNAs, making this system uniquely suited for multiple gene editing or synergistic activation of target genes.

The Cas9 protein and guide RNA form a complex that identifies and cleaves target sequences. Cas9 is comprised of six domains: REC I, REC II, Bridge Helix, PAM interacting, HNH, and RuvC, The Red domain binds the guide RNA, while the Bridge helix binds to target DNA. The HNH-14 and RuvC domains are nuclease domains. Guide RNA is engineered to have a 5' end that is complementary to the target DNA sequence. Upon binding of the guide RNA to the Cas9 protein, a conformational change occurs activating the protein. Once activated, Cas9 searches for target DNA by binding to sequences that match its protospacer adjacent motif (PAM) sequence. A PAM is a two or three nucleotide base sequence within one nucleotide downstream of the region complementary to the guide RNA. In one non-limiting example, the PAM sequence is 5'-NGG-3'. When the Cas9 protein finds its target sequence with the appropriate PAM, it melts the bases upstream of the PAM and pairs them with the complementary region on the guide RNA. Then the RuvC and HMI nuclease domains cut the target DNA after the third nucleotide base upstream of the P.I.

One non-limiting example of a CRISPR/Cas system used to inhibit gene expression, CRISPRi, is described in U.S. Patent Appl. Publ. No. US20140068797. CRISPRi induces permanent gene disruption that utilizes the RNA-guided Cas9 endonuclease to introduce DNA double stranded breaks, which trigger error-prone repair pathways to result in frame shift mutations. A catalytically dead Cas9 lacks endonuclease activity. When coexpressed with a guide RNA, a DNA recognition complex is generated that specifically interferes with transcriptional elongation, RNA polymerase binding, or transcription factor binding. This CRISPRi system efficiently represses expression of targeted genes.

CRISPR/Cas gene disruption occurs when a guide nucleotide sequence specific for a target gene and a Cas endonuclease are introduced into a cell and form a complex that enables the Cas endonuclease to introduce a double strand break at the target gene. In certain embodiments, the CRISPR/Cas system comprises an expression vector, such as, but not limited to, an pAd5F35-CRISPR vector. In other embodiments, the Cas expression vector induces expression of Cas9 endonuclease. Other endonucleases may also be used, including but not limited to, T7, Cas3, Cas8a, Cas8b, Cas10d, Cse1, Csy1, Csn2, Cas4, Cas10, Csm2, Cmr5, Fok1, other nucleases known in the art, and any combinations thereof.

In certain embodiments, inducing the Cas expression vector comprises exposing the cell to an agent that activates an inducible promoter in the Cas expression vector. In such embodiments, the Cas expression vector includes an inducible promoter, such as one that is inducible by exposure to an antibiotic (e.g., by tetracycline or a derivative of tetracycline, for example doxycycline). However, it should be appreciated that other inducible promoters can be used. The inducing agent can be a selective condition (e.g., exposure to an agent, for example an antibiotic) that results in induction of the inducible promoter. This results in expression of the Cas expression vector.

In certain embodiments, guide RNA(s) and Cas9 can be delivered to a cell as a ribonucleoprotein (RNP) complex. RNPs are comprised of purified Cas9 protein complexed with gRNA and are well known in the art to be efficiently delivered to multiple types of cells, including but not limited to stem cells and immune cells (Addgene, Cambridge, MA, Mirus Bio LLC, Madison, WI).

The guide RNA is specific for a genomic region of interest and targets that region for Cas endonuclease-induced double strand breaks. The target sequence of the guide RNA sequence may be within a loci of a gene or within a non-coding region of the genome. In certain embodiments, the guide nucleotide sequence is at least 10, 11, 12, 13, 14, 15, 16, 17, 18, 19, 20, 21, 22, 23, 24, 25, 26, 27, 30, 31, 32, 33, 34, 35, 36, 37, 38, 39, 40 or more nucleotides in length.

Guide RNA (gRNA), also referred to as "short guide RNA" or "sgRNA", provides both targeting specificity and scaffolding/binding ability for the Cas9 nuclease. The gRNA can be a synthetic RNA composed of a targeting sequence and scaffold sequence derived from endogenous bacterial crRNA and tracrRNA. gRNA is used to target Cas9 to a specific genomic locus in genome engineering experiments. Guide RNAs can be designed using standard tools well known in the art.

In the context of formation of a CRISPR complex, "target sequence" refers to a sequence to which a guide sequence is designed to have some complementarity, where hybridization between a target sequence and a guide sequence promotes the formation of a CRISPR complex. Full complementarity is not necessarily required, provided there is sufficient complementarity to cause hybridization and promote formation of a CRISPR complex. A target sequence may comprise any polynucleotide, such as a DNA or a RNA polynucleotide. In certain embodiments, a target sequence is located in the nucleus or cytoplasm of a cell. In other embodiments, the target sequence may be within an organelle of a eukaryotic cell, for example, mitochondrion or nucleus. Typically, in the context of an endogenous CRISPR system, formation of a CRISPR complex (comprising a guide sequence hybridized to a target sequence and complexed with one or more Cas proteins) results in cleavage of one or both strands in or near (e.g., within about 1, 2, 3, 4, 5, 6, 7, 8, 9, 10, 20, 50 or more base pairs) the target sequence. As with the target sequence, it is believed that complete complementarity is not needed, provided this is sufficient to be functional.

In certain embodiments, one or more vectors driving expression of one or more elements of a CRISPR system are introduced into a host cell, such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In certain embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g., each in a different intron, two or more in at least one intron, or all in a single intron).

In certain embodiments, the CRISPR enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Additional domains that may form part of a fusion protein comprising a CRISPR enzyme are described in U.S. Patent Appl. Publ. No. US20110059502, which is incorporated herein by reference. In certain embodiments, a tagged CRISPR enzyme is used to identify the location of a target sequence.

Conventional viral and non-viral based gene transfer methods can be used to introduce nucleic acids in mammalian and non-mammalian cells or target tissues. Such methods can be used to administer nucleic acids encoding components of a CRISPR system to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell (Anderson, 1992, Science 256:808-813; and Yu, et al., 1994, Gene Therapy 1:13-26).

In certain embodiments, the CRISPR/Cas is derived from a type II CRISPR/Cas system. In some embodiments, the CRISPR/Cas system is derived from a Cas9 protein. The Cas9 protein can be from *Streptococcus pyogenes, Streptococcus thermophilus*, or other species.

In general, Cas proteins comprise at least one RNA recognition and/or RNA binding domain. RNA recognition and/or RNA binding domains interact with the guiding RNA. Cas proteins can also comprise nuclease domains (i.e., DNase or RNase domains), DNA binding domains, helicase domains, RNAse domains, protein-protein interaction domains, dimerization domains, as well as other domains. The Cas proteins can be modified to increase nucleic acid binding affinity and/or specificity, alter an enzymatic activity, and/or change another property of the protein. In certain embodiments, the Cas-like protein of the fusion protein can be derived from a wild type Cas9 protein or fragment thereof. In other embodiments, the Cas can be derived from modified Cas9 protein. For example, the amino acid sequence of the Cas9 protein can be modified to alter one or more properties (e.g., nuclease activity, affinity, stability, and so forth) of the protein. Alternatively, domains of the Cas9 protein not involved in RNA-guided cleavage can be eliminated from the protein such that the modified Cas9 protein is smaller than the wild type Cas9 protein. In general, a Cas9 protein comprises at least two nuclease (i.e., DNase) domains. For example, a Cas9 protein can comprise a RuvC-like nuclease domain and a HNH-like nuclease domain. The RuvC and HNH domains work together to cut single strands to make a double-stranded break in DNA. (Jinek, et al., 2012, Science, 337:816-821). In certain embodiments, the Cas9-derived protein can be modified to contain only one functional nuclease domain (either a RuvC-like or a HNH-like nuclease domain). For example, the Cas9-derived protein can be modified such that one of the nuclease domains is deleted or mutated such that it is no longer functional (i.e., the nuclease activity is absent). In some embodiments in which one of the nuclease domains is inactive, the Cas9-derived protein is able to introduce a nick into a double-stranded nucleic acid (such protein is termed a "nickase"), but not cleave the double-stranded DNA. In any of the elsewhere herein-described embodiments, any or all of the nuclease domains can be inactivated by one or more deletion mutations, insertion mutations, and/or substitution mutations using well-known methods, such as site-directed mutagenesis, PCR-mediated mutagenesis, and total gene synthesis, as well as other methods known in the art.

In one non-limiting embodiment, a vector drives the expression of the CRISPR system. The art is replete with suitable vectors that are useful in the present invention. The vectors to be used are suitable for replication and, optionally, integration in eukaryotic cells. Typical vectors contain transcription and translation terminators, initiation sequences, and promoters useful for regulation of the expression of the desired nucleic acid sequence. The vectors of the present invention may also be used for nucleic acid standard gene delivery protocols. Methods for gene delivery are known in the art (U.S. Pat. Nos. 5,399,346, 5,580,859 & 5,589,466, incorporated by reference herein in their entireties).

Further, the vector may be provided to a cell in the form of a viral vector. Viral vector technology is well known in the art and is described, for example, in Sambrook et al. (4$^{th}$ Edition, Molecular Cloning: A Laboratory Manual, Cold Spring Harbor Laboratory, New York, 2012), and in other virology and molecular biology manuals. Viruses, which are useful as vectors include, but are not limited to, retroviruses, adenoviruses, adeno-associated viruses, herpes viruses, Sindbis virus, gammaretrovirus and lentiviruses. In general, a suitable vector contains an origin of replication functional in at least one organism, a promoter sequence, convenient restriction endonuclease sites, and one or more selectable markers (e.g., WO 01/96584; WO 01/29058; and U.S. Pat. No. 6,326,193).

Sources of T Cells

Prior to genetic modification, T cells (e.g., autologous or allogeneic T cells) are obtained from a subject. Examples of subjects include humans, dogs, cats, mice, rats, and transgenic species thereof. T cells can be obtained from a number of sources, including skin, peripheral blood mononuclear cells, bone marrow, lymph node tissue, cord blood, thymus tissue, tissue from a site of infection, ascites, pleural effusion, spleen tissue, and tumors. In certain embodiments of the present invention, T cells can be obtained from a unit of blood collected from a subject using any number of techniques known to the skilled artisan, such as Ficoll™ separation. In certain embodiments, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the cells collected by apheresis may be washed to remove the plasma fraction and to place the cells in an appropriate buffer or media for subsequent processing steps. In some embodiments of the invention, the cells are washed with phosphate buffered saline (PBS). In an alternative embodiment, the wash solution lacks calcium and may lack magnesium or may lack many if not all divalent cations. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

In some embodiments, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as CD3$^+$, CD28$^+$, CD4$^+$, and CD8$^+$ T cells, can be further isolated by positive or negative selection techniques. The skilled artisan would recognize that multiple rounds of selection can also be used in the context of this invention. In certain embodiments, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4$^+$ cells by negative selection, a monoclonal antibody cocktail typically includes antibodies to CD14, CD20, CD11b, CD16, HLA-DR, and CD8. In certain embodiments, it may be desirable to enrich for or positively select for regulatory T cells which typically express CD4$^+$, CD25$^+$, CD62L$^+$, GITR$^+$, and FoxP3$^+$. Alternatively, in certain embodiments, T regulatory cells are depleted by anti-CD25 conjugated beads or other similar method of selection. In other embodiments, subpopulation of T cells, such as, but not limited to, cells positive or expressing high levels of one or more surface markers e.g. CD28$^+$, CD8$^+$, CCR7$^+$, CD27$^+$, CD127$^+$, CD45RA$^+$, and/or CD45RO$^+$ T cells, can be isolated by positive or negative selection techniques.

For isolation of a desired population of cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads. For example, in some embodiments, a concentration of 2 billion cells/ml is used. In some embodiments, a concentration of 1 billion cells/ml is used. In a further embodiment, greater than 100 million cells/ml is used. In a further embodiment, a concentration of cells of 10, 15, 20, 25, 30, 35, 40, 45, or 50 million cells/ml is used. In yet some embodiments, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (i.e., leukemic blood, tumor tissue, etc.). Such populations of cells may have therapeutic value and would be desirable to obtain. For example, using high concentration of cells allows more efficient selection of CD8$^+$ T cells that normally have weaker CD28 expression.

In a related embodiment, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4$^+$ T cells express higher levels of CD28 and are more efficiently captured than CD8$^+$ T cells in dilute concentrations. In certain embodiments, the concentration of cells used is $5 \times 10^6$/ml. In other embodiments, the concentration used can be from about $1 \times 10^5$/ml to $1 \times 10^6$/ml, and any integer value in between.

Introduction of Nucleic Acids

Methods of introducing nucleic acids into a cell include physical, biological and chemical methods. Physical methods for introducing a polynucleotide, such as RNA, into a host cell include calcium phosphate precipitation, lipofection, particle bombardment, microinjection, electroporation, and the like. RNA can be introduced into target cells using commercially available methods which include electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany). RNA can also be introduced into cells using cationic liposome mediated transfection using lipofection, using polymer encapsulation, using peptide mediated transfection, or using biolistic particle delivery systems such as "gene guns" (see, for example, Nishikawa, et al. Hum Gene Ther., 12(8):861-70 (2001).

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present invention, in order to confirm the presence of the nucleic acids in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

It should be understood that the method and compositions that would be useful in the present invention are not limited to the particular formulations set forth in the examples. The following examples are put forth so as to provide those of ordinary skill in the art with a complete disclosure and description, and are not intended to limit the scope of what the inventors regard as their invention.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, Molecular Cloning: A Laboratory Manual", fourth edition (Sambrook et al. (2012) Molecular Cloning, Cold Spring Harbor Laboratory); "Oligonucleotide Synthesis" (Gait, M. J. (1984). Oligonucleotide synthesis. IRL press); "Culture of Animal Cells" (Freshney, R. (2010). Culture of animal cells. Cell Proliferation, 15(2.3), 1); "Methods in Enzymology" "Weir's Handbook of Experimental Immunology" (Wiley-Blackwell; 5 edition (Jan. 15, 1996); "Gene Transfer Vectors for Mammalian Cells" (Miller and Carlos, (1987) Cold Spring Harbor Laboratory, New York); "Short Protocols in Molecular Biology" (Ausubel et al., Current Protocols; 5 edition (Nov. 5, 2002)); "Polymerase Chain Reaction: Principles, Applications and Troubleshooting", (Babar, M., VDM Verlag Dr. Muller (Aug. 17, 2011)); "Current Protocols in Immunology" (Coligan, John Wiley & Sons, Inc. Nov. 1, 2002).

Those skilled in the art will recognize, or be able to ascertain using no more than routine experimentation, numerous equivalents to the specific procedures, embodiments, claims, and examples described herein. Such equivalents were considered to be within the scope of this invention and covered by the claims appended hereto. For example, it should be understood, that modifications in reaction conditions, including but not limited to reaction times, reaction size/volume, and experimental reagents, such as solvents, catalysts, pressures, atmospheric conditions, e.g., nitrogen atmosphere, and reducing/oxidizing agents, with art-recognized alternatives and using no more than routine experimentation, are within the scope of the present application.

It is to be understood that wherever values and ranges are provided herein, all values and ranges encompassed by these values and ranges, are meant to be encompassed within the scope of the present invention. Moreover, all values that fall within these ranges, as well as the upper or lower limits of a range of values, are also contemplated by the present application.

Humanized Antibodies

Humanized forms of non-human murine) antibodies are genetically engineered chimeric antibodies or antigen binding fragments thereof having preferably minimal portions derived from non-human antibodies. Humanized antibodies include antibodies in which CDRs of a human antibody (recipient antibody) are replaced by residues from a CDR region of a non-human species (donor antibody) such as mouse, rat or rabbit having the desired functionality. In some embodiments, Fv framework residues of the human antibody are replaced by corresponding nonhuman residues. Humanized antibodies may also comprise residues that are found neither in the recipient antibody nor in the imported CDR or framework (FR) sequences. In some embodiments, the humanized antibody may comprise substantially all of at least one, typically two, variable domains domains in which all or substantially all of the framework regions correspond to those of a relevant human consensus sequence. Humanized antibodies may also include at least a portion of an antibody constant region, such as an Fc region, typically derived from a human antibody (see, for example, Jones et al., 1986. *Nature* 321:522-525; Riechmann et al., 1988. *Nature* 332:323-329; Presta, 1992, *Curr. Op. Struct. Biol.* 2:593-596).

In order to retain high binding affinity, amino acids in the human acceptor sequence may be replaced by the corresponding amino acids from the donor sequence, for example where: (1) the amino acid is in a CDR; (2) the amino acid is in a human framework region (e.g., the amino acid is immediately adjacent to one of the CDRs). See, U.S. Pat. Nos. 5,530,101 and 5,585,089, incorporated herein by reference, which provide detailed instructions for construction of humanized antibodies.

Although humanized antibodies often incorporate all six CDRs (e.g, as defined by Kabat, but often also including hypervariable loop H1 as defined by Chothia) from a mouse antibody, they can also be made with fewer mouse CDRs and/or less than complete mouse CDR sequence(s) (e.g., a functional fragment of a CDR) (e.g., Pascalis et al. *J. Immunol.* 169:3076, 2002; Vajdos et al., *Journal of Molecular Biology*, 320:415-428, 2002; Iwahashi et al., *Mol. Immunol.* 36:1079-1091, 1999; Tamura et al., *Journal of Immunology*, 164:1432-1441, 2000).

A humanized antibody has one or more amino acid residues introduced into it from a source which is nonhuman. These nonhuman amino acid residues are often referred to as "import" residues, which are typically taken from an "import" variable domain. Thus, humanized antibodies comprise one or more CDRs from nonhuman immunoglobulin molecules and framework regions from human. Humanization of antibodies is well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816, 567; 6,331,415; 5,225,539; 5,530,101; 5,585,089; 6,548, 640, the contents of which are incorporated herein by reference herein in their entirety). In such humanized chimeric antibodies, substantially less than an intact human variable domain has been substituted by the corresponding sequence from a nonhuman species. In practice, humanized antibodies are typically human antibodies in which some CDR residues and possibly some FR residues are substituted by residues from analogous sites in rodent antibodies. Humanization of antibodies can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (Carter et al., Proc. Natl. Acad. Sci. USA, 89:4285 (1992); Presta et al., J. Immunol., 151:2623 (1993), the contents of which are incorporated herein by reference herein in their entirety).

Antibodies can be humanized with retention of high affinity for the target antigen and other favorable biological properties. According to one aspect of the invention, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind the target antigen. In this way, FR residues can be selected and combined from the recipient and import sequences so that the desired antibody characteristic, such as increased affinity for the target antigen, is achieved. In general, the CDR residues are directly and most substantially involved in influencing antigen binding.

A "humanized" antibody retains a similar antigenic specificity as the original antibody. However, using certain methods of humanization, the affinity and/or specificity of binding of the antibody for human CD3 antigen may be increased using methods of "directed evolution," as described by Wu et al., J. Mol. Biol., 294:151 (1999), the contents of which are incorporated herein by reference herein in their entirety.

In some embodiments, the antibody is a synthetic antibody, human antibody, a humanized antibody, single chain variable fragment, single domain antibody, an antigen binding fragment thereof, and any combination thereof.

Pharmaceutical Compositions

The pharmaceutical compositions according to the present invention are formulated according to the mode of administration to be used. In cases where pharmaceutical compositions are injectable pharmaceutical compositions, they are sterile, pyrogen free and particulate free. An isotonic formulation is preferably used. Generally, additives for isotonicity can include sodium chloride, dextrose, mannitol, sorbitol and lactose. In some cases, isotonic solutions such as phosphate buffered saline are preferred. Stabilizers include gelatin and albumin. In some embodiments, a vasoconstriction agent is added to the formulation.

It will be appreciated by a person skilled in the art that the antibody or antigen binding fragment may be administered in admixture with a suitable pharmaceutical excipient diluent or carrier selected with regard to the intended route of administration and standard pharmaceutical practice. For example, see *Remington: The Science and Practice of Pharmacy*, 19th edition, 1995, Ed. Alfonso Gennaro, Mack Publishing Company, Pennsylvania, USA.

In some embodiments, the antibody or antigen binding fragment may be administered orally, bucally or sublingually in the form of tablets, capsules, ovules, elixirs, solutions or suspensions, which may contain flavoring or coloring agents, for immediate, delayed or controlled-release applications. The antibody or antigen binding fragment may also be administered via intracavernosal injection.

The antibody or antigen binding fragment may also be administered parenterally. In some embodiments, the antibody or antigen binding fragment may be administered intravenously, intra-articularly, intraperitoneally, intrathecally, intraventricularly, intrasternally, intracranially, intramuscularly or subcutaneously. In some embodiments, the antibody or antigen binding fragment is administered by infusion techniques.

In some embodiments, the antibody or antigen binding fragment is used in the form of a sterile aqueous solution that may contain other substances, for example, sufficient salts or glucose (or other sugars) to make the solution isotonic with blood. The aqueous solution should be suitably buffered (preferably to a pH of from 3 to 9), if necessary. The preparation of suitable parenteral formulations under sterile conditions is readily accomplished by standard pharmaceutical techniques well known to a person of skill in the art.

Formulations suitable for parenteral administration include aqueous and non-aqueous sterile injection solutions which may contain anti-oxidants, buffers, bacteriostats and solutes which render the formulation isotonic with blood. Suitable formulations for parenteral administration also include aqueous and non-aqueous suspensions which may include suspending agents and thickening agents. The formulations may be presented in unit-dose or multi-dose containers.

For oral, parenteral or other routes of administration to human patients, the daily dosage level of the antibody or antigen binding fragment that binds MGAT5 or PDIA3 will usually be from 1 to 1000 mg per adult (i.e., from about 0.015 to 15 mg/kg), administered in single or multiple or divided doses.

In some embodiments, the dosage level may be from about 0.5 mg/kg to about 10 mg/kg. In further embodiments, the dosage level may be from about 2 to about 6 mg/kg.

In some embodiments, the antibody or antigen binding fragment is administered intranasally or by inhalation. The antibody or antigen binding fragment may be delivered in the form of a dry powder inhaler or an aerosol spray from a pressurized container, pump, spray or nebulizer with the use of a propellant.

In some embodiments, the antibody or antigen binding fragment is administered by DNA injection and electroporation of the DNA encoded antibody into muscle or skin.

Methods of Treatment Comprising Antibodies or Antigen Binding Fragments

Provided is a method of treating a disease, disorder or condition in a subject in need thereof, comprising administering to the subject an effective amount of any one of the antibody or antigen binding fragments described herein. In some embodiments, the subject is human. In some embodiments, the antibody or antigen binding fragment is provided in a pharmaceutical composition.

In some embodiments, the disease, disorder or condition is as described elsewhere herein.

In some embodiments, the disease is cancer. In further embodiments, the cancer is a cancer from Table 6 or any cancer described elsewhere herein.

In some embodiments, the disease is an autoimmune disease.

In some embodiments, the disorder is an immune system disorder.

The following examples further illustrate aspects of the present invention. However, they are in no way a limitation of the teachings or disclosure of the present invention as set forth herein.

EXPERIMENTAL EXAMPLES

The invention is now described with reference to the following Examples. These Examples are provided for the purpose of illustration only, and the invention is not limited to these Examples, but rather encompasses all variations that are evident as a result of the teachings provided herein.

The materials and methods employed in these experiments are now described.

Mice: Rosa26-Cas9-2A-EGFP constitutive expressed mice (Cas9(3 mice), OT-1 TCR transgenic mice, $Rag1^{-/-}$, and C57BL/6J mice were used in this study. For OT-1; Cas9β mice, which were generated by breeding OT-1 and Cas9 mice, both female and male, aged 8-12 weeks were used for naïve $CD8^+$ T cell isolation. For the lateral ventricle (LV) injections, 8 week-old C57BL/6J or 7-9 week-old $Rag1^{-/-}$ mice were used. Mice were randomly classified into different groups.

Design and Synthesis of Surface Protein CRISPR Knockout Libraries:

mmSurf library: A total of 1,657 surface protein genes were selected to make a surface protein-specific single-strand RNA (sgRNA) library. Four sgRNAs were designed for each gene, a total of 7,628 sgRNAs were designed including 1,000 non-targeting controls (NTCs) (Table 1: SEQ ID NOs. 1-7,628). The surface protein library was synthesized by massively parallel oligo array synthesis and pooled (CustomArray).

mSURFEOME2 library: A list of proteins in the human surface proteome was obtained (Bausch-Fluck, et al. (2018) *Proceedings of the National Academy of Sciences*, 46: E10988-E10997). The corresponding human genes were mapped to their mouse orthologous counterparts, for a total of 2,867 genes. Exonic sequences for these mouse genes were obtained through Ensembl Biomart based on the mm10 genome assembly. Candidate Cas9 sgRNAs were then identified using FlashFry (McKenna and Shendure, (2018) *BMC Biology* 16: 74), following default settings and using the scoring metrics "deonch2014ontarget", "rank", "minot", "doench2016cfd", and "dangerous". With the resultant scoring matrix, sgRNAs were first filtered for those that did not have high GC content, no polyT tracts, and exactly one match in the mm10 genome. The sgRNAs targeting a given gene were then ranked by using the "doench2014ontarget" and "doench2016cfd" scores, by first converting each score to nonparametric ranks where high "doench2014ontarget" scores correspond to high ranks, while low "doench2016cfd" scores correspond to high ranks. The two nonparametric ranks were then added together, weighting the "doench2014ontarget" rank twice as heavily as the "doench2016cfd" rank. For final library design, all of the sgRNAs that are contained in the Brie library (Doench et al. (2016) *Nature Biotechnology*, 34: 184-191) were first selected, then the composite ranks described elsewhere herein were used to choose the top scoring sgRNAs, up to a total of 20 sgRNAs per gene. The final set of on-target sgRNAs was composed of 56,911 sgRNAs targeting 2863 murine genes. A set of non-targeting control sgRNAs was designed by generating 500,000 random 20 nt sequences, followed by sgRNA scoring in FlashFry. The top 5000 non-targeting control sgRNAs were selected by choosing sgRNAs with a "doench2016cfd" score<0.2 and <100 total potential off-targets (maximum 4 mismatches). These 5000 control sgRNAs were added to the library, for a total of 61,911 sgRNAs.

Generation of AAV-CRISPR vector and AAV-Surf library for primary T cell editing and screening: An AAV vector for targeting primary mouse T cells (AAV-SB100x) was constructed by gBlock fragments (IDT) followed by Gibson assembly (NEB) (SEQ ID NO: 69,821). The synthesized library was PCR amplified, then the sgRNAs cloned into double Bbs I sites of AAV-CRISPR vector by the Gibson assembly (NEB). The Gibson assembly products were transformed into high efficiency competent cells (Endura) by electroporation methods. An estimated library coverage of ≥60× was observed after electroporation. The cloned library was PCR amplified using barcoded primers to ensure proper representation. The cloned library was named AAV-Surf pLY017SB_pAAV-U6sg(BbsI)-EFS-Thy1
(SEQ ID NO: 69,821)

```
   1 cctgcaggca gctgcgcgct cgctcgctca ctgaggccgc
     ccgggcaaag cccgggcgtc
  61 gggcgacctt tggtcgcccg gcctcagtga gcgagcgagc
     gcgcagagag ggagtggcca
 121 actccatcac taggggttcc tgcggccgca cgcgttctag
     aCTATACAGT TGAAGTCGGA
 181 AGTTTACATA CACTTAAGTT GGAGTCATTA AAACTCGTTT
     TTCAACTACT CCACAAATTT
 241 CTTGTTAACA AACAATAGTT TTGGCAAGTC AGTTAGGACA
     TCTACTTTGT GCATGACACA
 301 AGTCATTTTT CCAACAATTG TTTACAGACA GATTATTTCA
     CTTATAATTC ACTGTATCAC
 361 AATTCCAGTG GGTCAGAAGT TTACATACAC TAAGTTGACT
     GTGCCTTTAA ACAGCTTGGA
 421 AAATTCCAGA AAATGATGTC ATGGCTTTAG agaggatccg
     agggcctatt tcccatgatt
 481 ccttcatatt tgcatatacg atacaaggct gttagagaga
     taattagaat taatttgact
 541 gtaaacacaa agatattagt acaaaatacg tgacgtagaa
     agtaataatt tcttgggtag
 601 tttgcagttt taaaattatg ttttaaaatg gactatcata
     tgcttaccgt aacttgaaag
 661 tatttcgatt tcttggcttt atatatcttG TGGAAAGGAC
     GAAACACCGg GTCTTCgaGA
 721 AGACctgttt tagagctaGA AAtagcaagt taaaataagg
     ctagtccgtt atcaacttga
 781 aaaagtggca ccgagtcggt gcTTTTTTgg ctagctGGCC
     GCGTTTAAAC GTCGACtagg
 841 tcttgaaagg agtgggaatt ggctccggtg cccgtcagtg
     ggcagagcgc acatcgccca
 901 cagtccccga gaagttgggg ggaggggtcg gcaattgatc
     cggtgcctag agaaggtggc
 961 gcggggtaaa ctgggaaagt gatgtcgtgt actggctccg
     cctttttccc gagggtgggg
1021 gagaaccgta tataagtgca gtagtcgccg tgaacgttct
     ttttcgcaac gggtttgccg
1081 ccagaacaca ggCTCGAGAT GAACCCAGCC ATCAGCGTCG
     CTCTCCTGCT CTCAGTCTTG
1141 CAGGTGTCCC GAGGGCAGAA GGTGACCAGC CTGACAGCCT
     GCCTGGTGAA CCAAAACCTT
1201 CGCCTGGACT GCCGCCATGA GAATAACACC AAGGATAACT
     CCATCCAGCA TGAGTTCAGC
1261 CTGACCCGAG AGAAGAGGAA GCACGTGCTC TCAGGCACCC
     TTGGGATACC CGAGCACACG
1321 TACCGCTCCC GCGTCACCCT CTCCAACCAG CCCTATATCA
     AGGTCCTTAC CCTAGCCAAC
1381 TTCACCACCA AGGATGAGGG CGACTACTTT TGTGAGCTTC
     GCGTgTCGGG CGCGAATCCC
1441 ATGAGCTCCA ATAAAAGTAT CAGTGTGTAT AGAGACAAGC
     TGGTCAAGTG TGGCGGCATA
1501 AGCCTGCTGG TTCAGAACAC ATCCTGGATG CTGCTGCTGC
     TGCTTTCCCT CTCCCTCCTC
1561 CAAGCCCTGG ACTTCATTTC TCTGGGCAGT GGAGAGGGCA
     GAGGAAGTCT GCTAACATGC
1621 GGTGACGTCG AGGAGAATCC TGGCCCAATG GGAAAATCAA
     AAGAAATCAG CCAAGACCTC
1681 AGAAAAAGAA TTGTAGACCT CCACAAGTCT GGTTCATCCT
     TGGGAGCAAT TTCCAAACGC
1741 CTGGCGGTAC CACGTTCATC TGTACAAACA ATAGTACGCA
     AGTATAAACA CCATGGGACC
1801 ACGCAGCCGT CATACCGCTC AGGAAGGAGA CGCGTTCTGT
     CTCCTAGAGA TGAACGTACT
1861 TTGGTGCGAA AAGTGCAAAT CAATCCCAGA ACAACAGCAA
     AGGACCTTGT GAAGATGCTG
1921 GAGGAAACAG GTACAAAAGT ATCTATATCC ACAGTAAAAC
     GAGTCCTATA TCGACATAAC
1981 CTGAAAGGCC ACTCAGCAAG GAAGAAGCCA CTGCTCCAAA
     ACCGACATAA GAAAGCCAGA
2041 CTACGGTTTG CAACTGCACA TGGGGACAAA GATCGTACTT
     TTTGGAGAAA TGTCCTCTGG
2101 TCTGATGAAA CAAAAATAGA ACTGTTTGGC CATAATGACC
     ATCGTTATGT TTGGAGGAAG
2161 AAGGGGGAGG CTTGCAAGCC GAAGAACACC ATCCCAACCG
     TGAAGCACGG GGGTGGCAGC
2221 ATCATGTTGT GGGGGTGCTT TGCTGCAGGA GGGACTGGTG
     CACTTCACAA AATAGATGGC
2281 ATCATGGACG CGGTGCAGTA TGTGGATATA TTGAAGCAAC
     ATCTCAAGAC ATCAGTCAGG
2341 AAGTTAAAGC TTGGTCGCAA ATGGGTTTTC CAACACGACA
     ATGACCCCAA GCATACTTCC
2401 AAAGTTGTGG CAAAATGGCT TAAGGACAAC AAAGTCAAGG
     TATTGGAGTG GCCATCACAA
2461 AGCCCTGACC TCAATCCTAT AGAAAATTTG TGGGCAGAAC
     TGAAAAAGCG TGTGCGAGCA
2521 AGGAGGCCTA CAAACCTGAC TCAGTTACAC CAGCTCTGTC
     AGGAGGAATG GGCCAAAATT
2581 CACCCAAATT ATTGTGGGAA GCTTGTGAA GGCTACCCGA
     AACGTTTGAC CCAAGTTAAA
2641 CAATTTAAAG GCAATGCTAC CAAATACTAG GGGCCCTAAC
     CGCGGGAATA AAAGATCTTT
2701 ATTTTCATTA GATCTGTGTG TTGGTTTTTT GTGTGAATTC
     TTGAGTGTAT GTAAACTTCT
```

-continued

```
2761 GACCCACTGG GAATGTGATG AAAGAAATAA AAGCTGAAAT
     GAATCATTCT CTCTACTATT

2821 ATTCTGATAT TTCACATTCT TAAAATAAAG TGGTGATCCT
     AACTGACCTA AGACAGGGAA

2881 TTTTTACTAG GATTAAATGT CAGGAATTGT GAAAAAGTGA
     GTTTAAATGT ATTTGGCTAA

2941 GGTGTATGTA AACTTCCGAC TTCAACTGTA TAGgcatgcg
     gtaaccacgt gcggaccgag 3001 cggccgcagg aacccctagt gatggagttg gccactccct
     ctctgcgcgc tcgctcgctc 3061 actgaggccg ggcgaccaaa ggtcgcccga cgcccgggct
     ttgcccgggc ggcctcagtg 3121 agcgagcgag cgcgcagctg cctgcagggg cgcctgatgc
     ggtattttct ccttacgcat 3181 ctgtgcggta tttcacaccg catacgtcaa agcaaccata
     gtacgcgccc tgtagcgggc g 3241 cattaagcgc ggcgggtgtg gtggttacgc gcagcgtgac
     cgctacactt gccagcgccc 3301 tagcgcccgc tcctttcgct ttcttccctt cctttctcgc
     cacgttcgcc ggctttcccc 3361 gtcaagctct aaatcggggg ctcccttag ggttccgatt
     tagtgcttta cggcacctcg 3421 accccaaaaa acttgatttg ggtgatggtt cacgtagtgg
     gccatcgccc tgatagacgg 3481 tttttcgccc tttgacgttg gagtccacgt tctttaatag
     tggactcttg ttccaaactg 3541 gaacaacact caaccctatc tcgggctatt cttttgattt
     ataagggatt ttgccgattt 3601 cggcctattg gttaaaaaat gagctgattt aacaaaaatt
     taacgcgaat tttaacaaaa 3661 tattaacgtt tacaatttta tggtgcactc tcagtacaat
     ctgctctgat gccgcatagt 3721 taagccagcc ccgacacccg ccaacacccg ctgacgcgcc
     ctgacgggct tgtctgctcc 3781 cggcatccgc ttacagacaa gctgtgaccg tctccgggag
     ctgcatgtgt cagaggtttt 3841 caccgtcatc accgaaacgc gcgagacgaa agggcctcgt
     gatacgccta ttttttatagg 3901 ttaatgtcat gataataatg gtttcttaga cgtcaggtgg
     cacttttcgg ggaaatgtgc 3961 gcggaacccc tatttgttta tttttctaaa tacattcaaa
     tatgtatccg ctcatgagac 4021 aataaccctg ataaatgctt caataatatt gaaaaaggaa
     gagtatgagt attcaacatt 4081 tccgtgtcgc ccttattccc ttttttgcgg catttttgcct
     tcctgttttt gctcacccag 4141 aaacgctggt gaaagtaaaa gatgctgaag atcagttggg
     tgcacgagtg ggttacatcg 4201 aactggatct caacagcggt aagatccttg agagttttcg
     ccccgaagaa cgttttccaa 4261 tgatgagcac ttttaaagtt ctgctatgtg gcgcggtatt
     atcccgtatt gacgccggc 4321 aagagcaact cggtcgccgc atacactatt ctcagaatga
     cttggttgag tactcaccag
```

-continued

```
4381 tcacagaaaa gcatcttacg gatggcatga cagtaagaga
     attatgcagt gctgccataa 4441 ccatgagtga taacactgcg gccaacttac ttctgacaac
     gatcggagga ccgaaggagc 4501 taaccgcttt tttgcacaac atggggggatc atgtaactcg
     ccttgatcgt tgggaaccgg 4561 agctgaatga agccatacca aacgacgagc gtgacaccac
     gatgcctgta gcaatggcaa 4621 caacgttgcg caaactatta actggcgaac tacttactct
     agcttcccgg caacaattaa 4681 tagactggat ggaggcggat aaagttgcag gaccacttct
     gcgctcggcc cttccggctg 4741 gctggtttat tgctgataaa tctggagccg gtgagcgtgg
     gtctcgcggt atcattgcag 4801 cactggggcc agatggtaag ccctcccgta tcgtagttat
     ctacacgacg gggagtcagg 4861 caactatgga tgaacgaaat agacagatcg ctgagatagg
     tgcctcactg attaagcatt 4921 ggtaactgtc agaccaagtt tactcatata tactttagat
     tgatttaaaa cttcattttt 4981 aatttaaaag gatctaggtg aagatccttt ttgataatct
     catgaccaaa atcccttaac 5041 gtgagttttc gttccactga gcgtcagacc ccgtagaaaa
     gatcaaagga tcttcttgag 5101 atcctttttt tctgcgcgta atctgctgct tgcaaacaaa
     aaaaccaccg ctaccagcgg 5161 tggtttgttt gccggatcaa gagctaccaa ctctttttcc
     gaaggtaact ggcttcagca 5221 gagcgcagat accaaatact gtccttctag tgtagccgta
     gttaggccac cacttcaaga 5281 actctgtagc accgcctaca tacctcgctc tgctaatcct
     gttaccagtg gctgctgcca 5341 gtggcgataa gtcgtgtctt accgggttgg actcaagacg
     atagttaccg gataaggcgc 5401 agcggtcggg ctgaacgggg ggttcgtgca cacagcccag
     cttggagcga acgacctaca 5461 ccgaactgag atacctacag cgtgagctat gagaaagcgc
     cacgcttccc gaagggagaa 5521 aggcggacag gtatccggta agcggcaggg tcggaacagg
     agagcgcacg agggagcttc 5581 caggggggaaa cgcctggtat ctttatagtc ctgtcgggtt
     tcgccacctc tgacttgagc 5641 gtcgatttttt gtgatgctcg tcagggggggc ggagcctatg
     gaaaaacgcc agcaacgcgg 5701 ccttttttacg gttcctggcc ttttgctggc cttttgctca
     catgt
```

The AAV plasmid library was packaged similarly to a previously described approach (Chow, R. D., et al. (2017) *Nat Neurosci*). Low-passage HEK293FT cells were used for AAV production. Briefly, 2 h before transfection, D10 medium was replaced by pre-warmed DMEM (FBS-free). For each 15 cm-plate, HEK293FT cells were transiently transfected with 5.2 μg transfer (AAV-Surf), 8.9 μg serotype (AAV9) and 10.4 μg packaging (pDF6) plasmids using 130 μL PEI. After 6-12 h of transfection, DMEM was replaced with 20 mL pre-warmed D10 medium. Cells were dislodged and transferred to 50 mL Falcon tubes after 72 h post-transfection. For AAV purification, 1/10 volume of pure chloroform was added and incubated at 37° C. with vigorously shaking for 1 h. NaCl was added to a final concentration of 1 M, shaking the mixture until all NaCl was dissolved, then pelleted at 20,000×g at 4° C. for 15 min. The aqueous layer was gently transferred to another clean tube and the chloroform layer discarded. 10% (w/v) of PEG8000 was added and the tubes shaken until dissolved. The mixture was incubated on ice for 1 h followed by centrifugation at 20,000×g at 4° C. for 15 min. The supernatant was discarded and the pellet was resuspended with 5-15 mL PBS containing $MgCl_2$ and benzonase (Sigma), then incubated at 37° C. for at least 30 min. One volume of chloroform was added, shaken vigorously and spun down at 15,000×g at 4° C. for 15 min. The aqueous fraction was collected carefully and concentrated using AmiconUltra 100 kD ultracentrifugation units (Millipore). Virus was aliquoted and stored in −80° C. To measure the virus titer, RT-qPCR was performed using Taqman assays (ThermoFisher) targeted to human U6 promoter.

Cell culture for cell lines and primary T cells: HEK293FT, U87, GL261, and GL261 cell lines were obtained from the American Type Culture Collection (Manassas, VA) and cultured in DMEM (Gibco) medium supplemented with 10% FBS (Sigma) and 200 U/mL penicillin-streptomycin (Gibco), named D10 medium. Cells were typically passaged every 1-2 d at a split ratio of 1:2 or 1:4. Cells were usually passaged when the confluency reached 80%. Naïve $CD8^+$ T cells were cultured in RPMI-1640 (Gibco) medium supplemented with 10% FBS, 2 mM L-Glutamine, 200 U/mL penicillin-streptomycin (Gibco), and 49 µM β-mercaptoethanol (Sigma). For in vivo experiments, complete RPMI-1640 medium was supplemented with 2 ng/mL IL-2, 1 µg/mL anti-CD28, 2.5 ng/mL IL-7 and 50 ng/mL IL-15 cytokines or antibody. For in vitro experiments, media was supplemented with 2 ng/mL IL-2, 1 µg/mL anti-CD28 and 2 ng/mL IL-12p70. All cytokines and antibody were purchased from BioLegend.

Generation of stable cell lines: For GBM studies, GL261 cancer cells were infected with Firefly Luciferase (FLuc)-expressing lentivirus (with puromycin resistance). After 24 h of virus transduction, cells were selected with 6 µg/mL puromycin, until all cells died in the control group. GL261-FLuc-mCh-cOVA clonal cell lines were generated based on the GL261-FLuc cell line, where GL261-FLuc cells were transduced with mCherry-cOVA (mCh-cOVA) lentivirus, then cultured individually in 96-well plates. 2-3 weeks later, positively expanded clones were identified using fluorescence microscopy. For breast cancer studies, E0771 cancer cells were infected with mCherry-cOVA (mCh-cOVA) lentivirus, then cells were cultured individually in 96-well plates. 2-3 weeks later, positively expanded clones were identified using fluorescence microscopy. Flow cytometry was performed to ensure the purity of each clone. At least two clones from each stable cell lines were established with high purity and used in the study.

Naïve $CD8^+$ T cell isolation and culture: Mesenteric lymph nodes (mLNs) and spleens were dissected from OT-1;Cas9β or Cas9β mice, then placed into ice-cold PBS supplemented with 2% FBS. Organs were mashed through a 100 µm filter and lymphocytes were re-suspended with 2% FBS. Red blood cells (RBCs) were lysed with 2 mL ACK lysis buffer (Lonza) per 5 spleens for 1-2 min at room temperature, then lysis was stopped by adding 48 mL 2% FBS PBS. RBCs lysed lymphocyte solution was filtered with 40 µm filters to remove cell debris. Naïve $CD8a^+$ T cell purification was performed using Naïve $CD8a^+$ T cell Isolation Kits according to Miltenyi Biotec's standard procedures. Naïve $CD8a^+$ T cells were cultured at $1-2\times10^6$ cells/mL density in 2 µg/mL anti-CD3c (BioLegend) treated plates or dishes, and cRPMI medium was supplemented with 2 ng/mL IL-2, 1 µg/mL anti-CD28, 2.5 ng/mL IL-7 and 50 ng/mL IL-15 cytokines or antibody. AAV-Surf $CD8^+$ T cell screen in a syngeneic mouse model of GBM: Naïve $CD8^+$ T cells were isolated from the spleen and lymph nodes of $Cas9^+$ mice. A total of $2\times10^7$ Naïve OT-1;Cas9 $CD8^+$ T cells were transduced with $10^{11}$ AAV-Surf virus. Syngeneic mouse models of GBM were setup with intracranial injection of native or luciferase-expressing GL261 cells (GL261 and GL261-FLuc, respectively) transplanted into the lateral ventricle (LV) of C57BL/6J mice. AAV-Surf infected $CD8^+$ T cells were adoptively transferred into GBM engrafted mice at day 10 via intravenous (tail vein) injection. Two screens were performed. The one with native GL261 GBM reached endpoint sooner (all mice euthanized by 20 dpi, "shorter term screen"), and the one with luciferase-expressing GL261 cells reached endpoint later (all mice euthanized by 92 dpi, "longer term screen").

Splinkerette PCR: Sleeping beauty transposon integration was detected by splinkerette PCR (Uren, A. G. et al., (2009) *Nature Protocols*. 4,789-798). Mouse OT-I;Cas9β $CD8^+$ T cells transduced with AAV-SB-CRISPR were collected for genomic DNA extraction using QIAamp Fast DNA Tissue Kit. A total of 1 µg genomic DNA was digested with Sau3AI (NEB) for 4h, then incubated at 65° C. to inactivate enzymes for 20 min. Splinkerette adaptors were generated by mixing long-strand adaptors and short-strand adaptors, then denatured and annealed by heating to 95° C. for 5 min and then cooled at room temperature. Annealed Splinkerette adaptors were used for ligation immediately or stored at −20° C. ~150 ng digested genomic DNA was ligated with 25 µM adaptor at 4° C. overnight using T4 ligase (NEB). A nested-PCR reaction was used to amplify transposon arm and its junction genomic DNA sequence. Splink 1 and SB-Right1 primers (Table 7) were used for $1^{st}$ round PCR, Splink 2 and SB-Right 2 primers (Table 7) were used for $2^{nd}$ round PCR. PCR products were run on 2% gels, and gel purified PCR products were prepared using a Nextera kit (Illumina) before sequencing.

Splinkerette data processing and analysis: Forward and reverse FASTQ reads and their reverse complements from Splinkerette samples were concatenated to obtain pooled reads for processing. BBDuk was used for quality trimming with the following settings trimq=27 minlen=80 maq=30 qtrim=rl. Cutadapt was used with the following settings -e 0.1--overlap 15 to discard reads outside of the integrating transposon arms (and therefore corresponding to the vector), using the sequences CGCACGCGTTCTAGACTATA (SEQ ID NO: 69,839), TATAGGCATGCGGTAACCAC (SEQ ID NO: 69,840), and their reverse complements. Cutadapt was also used to trim the transposon arms using the sequence CAGTTGAAGTCGGAAGTTTA (SEQ ID NO: 69,841) and the following parameters -e 0.1 -m 15 --overlap 15. The resulting filtered reads were then mapped to the mouse genome (mm10) using BWA MEM to determine transposon integration sites. Mapped reads were converted to the BED format and intersected with reference annotations obtained from UCSC Table Browser to determine associated functional regions of integration sites.

Estimation of functional MOI of AAV-SB-CRISPR screen using single cell RT-qPCR: Mouse $CD8^+$ T cells were transduced with AAV-Surf library, with the same parameters as in the screen. T cells were cultured for 5 days, then diluted as single cells (one cell per well) in a 96-well PCR plate. Untransduced T cells (PBS group) were used as negative control. To detect sgRNA expression as a proxy for functional MOI, a Single Cell-to-CT™ Kit (Ambion) was used for quantification of sgRNA expression at a single-cell level. The fraction of single cells expressing sgRNAs out of total cells was used to estimate functional MOI. The detailed qPCR protocol was provided by the manufacturer.

GBM induction by intracranial surgery and cancer cell transplantation: Same gender mice were used in each batch experiment to ensure consistency. Mice were anesthetized by intraperitoneal injection of ketamine (100 mg/kg) and xylazine (10 mg/kg). Carprofen (5 mg/kg) was also administered intraperitoneally as a pre-emptive analgesic. Once the mice were in deep anesthesia, they were immobilized in a stereotaxic apparatus (Kopf or Stoelting) using intra-aural positioning studs and a tooth bar to immobilize the skull (similar to described in Chow, R. D., et al. (2017) *Nat Neurosci*). According to the mouse brain stereotaxic coordinates, the lateral ventricle (LV) was located at 0.6-1.0 mm caudal/posterior to bregma, 0.8-1.5 mm right-side lateral to bregma and 2.0-3.0 mm deep from the pial surface for injection (coordinates: A/P −0.6 to −1.0, M/L 0.8 to 1.5, D/V −2.0 to −3.0). A ~1 mm hole was drilled on the skull surface and $5 \times 10^4$ to $1.2 \times 10^6$ cancer cells were injected, dependent upon specific experiments. The injection rate was controlled at 2 μL/min by an UltraMicroPump 3 (World Precision Instruments). After injection, the incision was closed with tissue adhesive (3M Vetbond) and 500 μL lactated Ringer's solution was subcutaneously injected. Mice were placed under the heat lamp until they recovered.

Adoptive cell transfer: Naïve CD8$^+$ T cells were infected with virus at day 0, then T cells were cultured for 3 days before intravenous injection. For the shorter term AAV-Surf screen, $1.8 \times 10^6$ OT-1;Cas9β CD8$^+$ T cells were injected. $4 \times 10^6$ OT-1;Cas9β CD8$^+$ T cells were injected for the longer term screen. For the validation experiments, OT-1;Cas9β or Cas9β CD8$^+$ T cells were injected. The number of cancer cells and T cells injected are illustrated in the figures and figure descriptions. After T cell injection, mice were monitored every day and euthanized when signs of discomfort appeared, in accordance with the institutional guidelines (low activity, stop eating and drinking, body start dehydrate). Brains were isolated and stored at −80° C. for genomic DNA extraction and readout, or fixed in 4% PFA for hematoxylin and eosin (H&E) staining.

Organ isolation and genomic DNA extraction: Each mouse was dissected after being euthanized. Whole brains, spleens, draining lymph nodes and non-draining lymph nodes were isolated for genomic DNA extraction. Genomic DNA extraction was performed as previously described (Chen, S., et al. (2015) *Cell* 160, 1246-1260). Briefly, each brain and spleen was put in a 15 mL Falcon tube. 6 mL NK Lysis Buffer (50 mM Tris, 50 mM EDTA, 1% SDS, pH adjusted to 8.0) with 30 μL of 20 mg/mL Proteinase K (Qiagen) was added to each tube and incubated at 55° C. overnight. After the tissue disappeared, 30 μL of 10 mg/mL RNase A (Qiagen) was added to the lysed sample, and the tubes were inverted 20 times and incubated at 37° C. for 30 min. Digested tissues were cooled on ice before adding 2 mL cold 7.5 M ammonium acetate (Sigma) to precipitate the proteins. Samples were mixed thoroughly after adding ammonium acetate and vortexing for 10 s, followed by centrifuging at 4,000×g at 4° C. for 15 min. After the spin, the supernatant was removed to a new 15 mL Falcon tube and the pellet discarded. 6 mL 100% isopropanol was added and the tubes were inverted until flocculent DNA was observed. Samples were centrifuged at 4,000×g at 4° C. for 10 min. Genomic DNA pellets were washed one time with 70% ethanol, and then centrifuged at 4,000×g at 4° C. for 5 min. The supernatant was discarded and remaining ethanol removed using a pipette. Genomic DNA was air dried for 30-60 min, then resuspended in 0.5-1 mL nuclease-free $H_2O$ and incubated overnight at room temperature. The next day, the gDNA solution was transferred to eppendof tubes and concentrations were measured using a Nanodrop (Thermo Scientific). For cell pellets, 100-200 μL QuickExtract solution (Epicentre) was directly added to cells and incubated at 65° C. for 30 min. For mouse lymph nodes, QIAmp Fast DNA Tissue Kit (Qiagen) was used for gDNA extraction following the manufacturer's protocol.

SgRNA readout and deep sequencing: Two rounds of PCR were used for the sgRNA library readout, where the first PCR used enough genomic DNA (~2 μg per reaction) to ensure capture the full representation of the screen and the second PCR used 1 μL PCR #1 product and barcoded primers, each sample amplified used different barcoded primers and pooled same quantity PCR products for Illumina sequencing. For PCR #1, primer forward: 5'-aatggactatcatatgcttaccgtaacttgaaagtatttcg-3' and primer reverse: 5'-ctttagtttgtatgtctgttgctattatgtctactattctttccc-3' were used to amplify sgRNA cassette under cycling condition: 98° C. for 1 min, 25 cycles of (98° C. for 1 s, 62° C. for 5 s, 72° C. for 15 s), and 72° C. 2 min for the final extension. All PCR reactions were performed using Phusion Flash High Fidelity Master Mix or DreamTaq Green DNA Polymerase (ThermoFisher).

PCR #1 products for each biological sample were pooled and used for amplification with barcoded second PCR primers (Table 2; SEQ ID NOs: 7,629-7,644). The cycling condition of PCR #2 were: 98° C. for 30 s, 30-35 cycles of (98° C. for 1 s, 62° C. for 5 s, 72° C. for 15 s), and 72° C. 2 min for the final extension. Second PCR products were pooled and then normalized for each biological sample before combining uniquely barcoded separate biological samples. The pooled product was then gel purified from a 2% E-gel EX (Life Technologies) using the QiaQuick kit (Qiagen). The purified pooled library was then quantified with a gel-based method using the Low-Range Quantitative Ladder (Life Technologies), dsDNA High-Sensitivity Qubit (Life Technologies), BioAnalyzer (Agilent) and/or qPCR. Diluted libraries with 5-20% PhiX were sequenced with MiSeq, HiSeq 2500 or HiSeq 4000 systems (Illumina).

AAV-SB-CRISPR screen data processing: Raw single-end fastq read files were filtered and demultiplexed using Cutadapt (Langmead, B., et al. (2009) *Genome Biol* 10, R25). To remove extra sequences downstream (i.e. 3' end) of the sgRNA spacer sequences, the following settings were used: cutadapt --discard-untrimmed -a GTTTTAGAGCTAGAAATGGC (SEQ ID NO: 69,822). As the forward PCR primers used to readout sgRNA representation were designed to have a variety of barcodes to facilitate multiplexed sequencing, these filtered reads were then demultiplexed with the following settings: cutadapt -g file: fbc.fasta --no-trim, where fbc.fasta contained the 12 possible barcode sequences within the forward primers. Finally, to remove extra sequences upstream (i.e. 5' end) of the sgRNA spacers, the following settings were used: cutadapt --discard-untrimmed -g GTGGAAAGGACGAAACACCG (SEQ ID NO: 69,823). Through this procedure, the raw fastq read files could be pared down to the 20 bp sgRNA spacer sequences. The 20 bp sgRNA spacer sequences from each demulitplexed sample were then mapped and sgRNA spacers designed for the Surface library (SEQ ID NOs. 1-6,628).

A bowtie index of the sgRNA library was generated using the bowtie-build command in Bowtie 1.1.2. The filtered fastq read files were mapped to the index using the following settings: bowtie -v 1 --suppress 4,5,6,7 --chunkmbs 2000 -best. Using the resultant mapping output, the number of reads that had mapped to each sgRNA within the library was quantified.

Analysis of CRISPR screens using RIGER: For RIGER analysis of CRISPR screens, read count tables were used to calculate log fold changes for tumor versus cell samples in order to score and rank sgRNAs, with ties in rank broken by random order. This data was then used as input to a Java-based implementation of RIGER (github.com/broadinstitute/rigerj) in order to generate p-values and gene rankings based on consistent enrichment across multiple sgRNAs for identification of candidate genes (Shalem, O., et al. (2014) Science 343: 84-87). Both the second highest-ranking sgRNA and the weighted sum scoring methods were used for computation of gene rankings, and compared to ensure consistency between methods.

Analysis of CRISPR screens using MAGeCK: Model-based Analysis of Genome-wide CRISPR/Cas9 Knockout (MAGeCK) algorithm (Li, W., et al. (2014) Genome Biol 15, 554) was used as an independent method to quantify enrichment of candidate genes for both the infiltration and survival screens. For MAGeCK analysis, read count tables were used as inputs to a command-line-based tool (sourceforge.net/p/mageck/wiki/Home/). The treatment group was defined as the tumor samples and the control group was defined as the cell pellet samples. A list of non-targeting control sgRNAs were provided for normalization and generation of the null distribution of RRA. Native MAGeCK plotting functions were used for visualization of RRA score and p-value distributions and individual sgRNA read counts of selected genes.

Survival analysis: Mice with glioblastoma (GBM) rapidly deteriorated in their body condition score, which was totally different from other tumor types. Mice with observed macrocephaly and body condition score≤1 were euthanized and the euthanasia date was recorded as the last survival date. Sometimes, mice died unexpectedly because brain tumors progressed fast, so the date of death was recorded as the last survival date. For the subcutaneous and fat pad tumor modeling, once tumor volume was over 2500 mm$^3$, the mouse was euthanized and the euthanasia date was recorded as the last survival date. T cell adoptive transfer with subcutaneous tumor model in Rag1$^{-/-}$ mice: 4×10$^6$ GL261-FLuc-mCh-rOVA #2 cells were subcutaneously injected into male Rag1$^{-/-}$ mice. Seven days post-transplantation, OT-1; Cas9β CD8$^+$ T cells were isolated and transduced with AAV sgRNA. Three days later, 1×10$^6$ of CD8$^+$ T cells were intravenously injected in tumor-bearing Rag1$^{-/-}$ mice. Tumor size was measured in a blinded fashion approximately every 2-3 days after adoptive T cell transfer. Tumor volume was calculated as 7c/6×(length×width×height) of the tumor.

T cell adoptive transfer with a subcutaneous glioma tumor model in Rag1$^{-/-}$ mice: 4×10$^6$ GL261-FLuc-mCh-rOVA cells were subcutaneously injected into male Rag1$^{-/-}$ mice. 7 days post-transplantation, OT-I;Cas9β CD8$^+$ T cells were isolated and transduced with AAV-sgPdia3, 3 days later, 1×10$^6$ of CD8$^+$ T cells were intravenously injected in tumor-bearing Rag1$^{-/-}$ mice. Tumor size was measured in a blinded fashion approximately every 3-5 days after adoptive T cell transfer. Tumor volume was calculated as π/6×(length× width×height) of the tumor.

Mouse brain dissection and histology: Mice were euthanized by cervical dislocation or carbon dioxide asphyxiation. Mouse brains were carefully dissected then fixed in 4% PFA for 2-3 days. Brains were embedded in paraffin, sectioned at 4 μm and stained with hematoxylin and eosin (H&E). Slides were scanned using an Aperio digital slide scanner (Leica) to quantify tumor size.

Brain tumor monitoring and IVIS imaging: Mice were monitored for brain tumor development by observation of macrocephaly, as well as by in vivo luciferase imaging where GL261-FLuc cells were used. Mice were euthanized as poor body condition and/or macrocephaly developed. Mouse IVIS imaging was performed by intraperitoneally injecting 150 mg/kg D-Luciferin (PerkinElmer). Bioluminescence signal intensity was measured by drawing a region of interest over the brain region after 10 min of Luciferin injection. Flow cytometry: T cells were collected and washed one time using MACS buffer (0.2% BSA and 5 mM EDTA in PBS) before staining. T cells were stained on ice for 15-30 min after adding antibodies (1:200 dilution). Samples were run on a BD FACSAria cytometer, and analysis was performed using FlowJo software 9.9.4 (Threestar, Ashland, OR).

Mouse brain TIL analysis: 8-10 week-old Rag 1$^{-/-}$ mice were injected with GL261-mCh-rOVA #1 cells, OT-I;Cas9β CD8$^+$ T cells. T cells were isolated and infected with AAV-sgMgat5 and AAV-sgPdia3 virus after luciferase signal was observed in the mouse brain. 5×10$^6$/mouse OT-I;Cas9β CD8$^+$ T cells were i.v injected. Brain tumors were isolated after 5 days of i.v injection. Mice were sacrificed, and whole brains were quickly isolated and put into cold PBS with 2% FBS. After hindbrain and olfactory bulb removal, the brain tumours were crushed using two glasses with rough surface, then gently mashed into small pieces. Collagenase and dispase (Roche) were used for tissue digest at 37° C. for 1 h in the shaking block. Digested samples were quenched by adding cold RPMI-1640, then centrifuging at 500×g for 5 min. Cell pellets were resuspended with 2 mL ACK lysis buffer for 2 min followed by dilution with 2% FBS PBS, filtered with 40 μm filters to remove tissue aggregates. Ficoll density centrifugation was performed to enrich mononuclear cells. Enriched cells were stained with antibodies for 30 min on the ice, then washed with MACS buffer (0.2% BSA and 5 mM EDTA in PBS) before running on a FACS machine.

Intracellular flow cytometry: Intracellular flow cytometry was performed to detect the expression level of IFNγ. Briefly, naïve CD8 T cells were transduced with AAV after isolation. Five days after infection, T cells were transferred into a new 6-well plate without CD36 incubation, and supplemented with the new media including IL-2. After 12 h rest, T cells were re-stimulated with different concentrations of CD3c. Media was supplied with brefeldin A, 2 ng/mL IL-2, 1 μg/mL anti-CD28, and 2 ng/mL IL-12p70. T cells were incubated for 4 h in the incubator. T cells were collected and stained with anti-CD3 PE and anti-CD8 PE/cy7, after membrane protein staining, cells were fixed and permeabilized, then anti-IFNγ APC was used for intracellular IFNγ staining. RT-qPCR: Total RNA was extracted from CD8$^+$ T cells using RNasy Plus Mini Kit (Qiagen). Gene expression was quantified using Taqman Fast Universal PCR Master Mix (Thermo Fisher) and Taqman probes (Invitrogen). Relative mRNA expression was determined via the ΔΔ$C_t$ method.

T7 endonuclease I assay (T7EI): Mouse CD8$^+$ T cells infected with AAVs, or human CD8$^+$ T cells electroporated with RNPs, were collected for genomic DNA extraction using QIAmp Fast DNA Tissue Kit (Qiagen). PCR was performed using site-specific perimers with Phusion Flash High Fidelity Master Mix (ThermoFisher) under cycling condition as: 98° C. for 1 min, 35 cycles of (98° C. for 1 s, 60° C. for 5 s, 72° C. for 25 s), and 72° C. 2 min for the final extension. PCR products were gel purified using the QIA-quick Gel Extraction Kit (Qiagen). 200 ng of PCR DNA in Buffer 2 (NEB) was annealed on a thermocycler with the following setting: 95° C., 5 min, 90° C., 1 min, 85° C., 1 min, 80° C., 1 min, 75° C., 1 min, 70° C., 1 min, 65° C., 1 min, 60° C., 1 min, 55° C., 1 min, 50° C., 1 min, 45° C., 1 min, 40° C., 1 min, 35° C., 1 min, 30° C., 1 min, 25° C., 1 min, and hold at 4° C. 10 units of T7 endonuclease I (NEB) was added to digest the re-annealed DNA for 30-60 min at 37° C., then being loaded into the 2% E-gel, the gel imaging was performed using image Lab (Bio-Rad).

Detection of AAV-mediated mutagenesis by Nextera: The PCR products were used for Nextera library preparation following manufacturer protocols (Illumina). Reads were mapped to the amplicon sequences using BWA-MEM (Durbin, R. et al. (2009) Bioinformatics 25, 1754) at default settings. Indel variants were first processed with Samtools with the settings samtools mpileup -d 1000000, then piped into VarScan v2.4.1 with the settings pileup2indel --min-coverage 2 --min-reads2 2 --min-var-freq 0.00001.

Human primary $CD8^+$ T cell endogenous gene knockout: Human primary $CD8^+$ T cells were isolated from health donors. $CD8^+$ T cells were stimulated with anti-CD3/CD28 beads (Invitrogen) every 7-10 days. T cells were cultured in X-VIVO™ 15 media (Lonza) supplied with 5% human serum and IL-2. Before the electroporation, crRNA and tracrRNA were 1:1 ratio mixed (final concentration was 44 μM), heat at 95° C. for 5 min, then cool to room temperature. 0.3 μL Cas9 protein (61 μM) was mixed with 0.2 μL Buffer R (Neon Transfection Systerm Kit, Thermo Fisher), then being mixed with 0.5 μL annealed crRNA:tracrRNA duplex, incubated the mixture at room temperature for 20 min. High viability cells were collected and washed with PBS to completely remove the media. $5 \times 10^5$ of T cells were resuspended in 9 μL Buffer R per electroporation, then 1 μL RNP complex was added and mixed well using pipette. 10 μL of cell:RNP mixture was loaded into the Neon pipette without any bubbles. The tip of the loaded Neon pipette was inserted into the pipette station. The setup of the electroporation parameter was set at 1600 V, 10 ms for 3 pluses. After electroporation, cells were transferred to a 24-well plate with pre-warmed media, then cultured in a tissue culture incubator.

Mass cytometry (CyTOF): High targeting efficiency of PDIA3 was confirmed by surveyor assay and Nextera sequencing. Human $CD8^+$ T cells were collected and washed with PBS, resuspended cell to $1 \times 10^7$/mL in PBS and add Cell-ID Cisplatin (Fluidigm) to a final concentration of 5 μM. Cells were incubated at room temperature for 5 min, then washed with Maxpar Cell Staining Buffer (Fluidigm). Each replicate was aliquoted with $2 \times 10^6$ cells in a volume of 50 μL, adding 50 μL of surface marker antibody cocktail (Fluidigm or provided by the Yale CyTOF core) in each tube. The tube was gently mixed with pipette and incubated at room temperature for 30 min. Following the incubation, cells were washed with Maxpar Cell Staining Buffer two times. Cells were fixed by adding 500 μL Maxpar Fix I Buffer (Fluidigm) to each tube, and incubated for 15 min at room temperature. Cells were then washed with Maxpar Perm-S Buffer (Fluidigm) for two times. 50 μL of the cytoplasmic/secreted antibody cocktail was added into fixed cells which was resuspended in 50 μL Maxpar Cell Staining Buffer. Cells were incubated at room temperature for 30 min. After incubation, cells were washed with Maxpar Cell Staining Buffer for two times. Finally, cells were incubated in intercalation solution (Fluidigm) in a final concentration of 125 nM, then incubated overnight at 4° C. Before running on a CyTOF machine, cells were washed with Maxpar Cell Staining Buffer and adjusted cell concentration to $5-7 \times 10^5$/mL with water. All data were collected on a CyTOF Helios instrument (Fluidigm).

CyTOF data processing: CyTOF quality control pre-filtering performed by gating in FlowJo (live-dead, CD3, CD8). Channel signal values were exported as CSV and analyzed using custom scripts in R. Dimensionality reduction was performed by t-SNE (Rtsne package), followed by k-means and hierarchical clustering.

Immunoblot and TCR signaling: Human $CD8^+$ T cells electroporated with RNP were collected and washed with PBS to remove media. $3 \times 10^6$ cells were lysed with RIPA lysis buffer and incubated on the ice for 30 min, followed by centrifuging at 13,000×g for 15 min at 4° C. The supernatant was collected for protein quantification. The total protein concentration was measure by using a Bradford protein assay (Bio-Rad), a total of 10 μg protein per sample was loaded into SDS-PAGE gel (Bio-Rad), proteins in the gel were transferred into Amersham Protran 0.45 μm NC Nitrocellulose Blotting membrane (GE Healthcare) after electrophoresis. Membranes were blocked with 2% BSA in TBST for 1 h at room temperature, followed by the primary antibody incubation at 4° C. overnight.

Anti-PDIA3 antibody was from Atlas Antibodies (HPA003230). Antibody binding was detected using horseradish peroxidase-conjugated secondary antibody and ECL substrate (Bio-Rad). For the TCR signaling experiment, mouse naïve $CD8^+$ T cells were isolated from OT-I;Cas9β mice, then infected with AAV6 packaged with Mgat5, Pdia3 or Vector control sgRNAs. T cells were washed with PBS and cultured with cRPMI media without CD3ε and CD28 antibodies (resting) overnight at day 5 after AAV infection. Following resting, T cells were collected and washed with cold PBS, $3-5 \times 10^6$ cells per sample were resuspended with cold PBS containing biotin anti-mouse CD3ε (BioLegend) and Streptavidin (BioLegend) and incubated on the ice for 30 min. T cells were then re-stimulated at 37° C. after ice incubation. Following stimulation cells were lysed with RIPA lysis buffer which containing protease and phosphatase inhibitor cocktail (ThermoFisher). The standard immunoblot assay was performed as described elsewhere herein.

Single-cell RNA sequencing (scRNA-seq): Naïve $CD8^+$ T cells were isolated from OT-I;Cas9 mice, T cells were stimulated with anti-CD3ε and anti-CD28 as previously described. $CD8^+$ T cells were infected with AAV6-sgPdia3 and AAV6-Vector after being activated. At day 5 after AAV infection, T cells were collected and dead cells were removed using Dead cell removal kit (Miltenyi Biotec). T cells were resuspended in PBS in a concentration of $1 \times 10^6$/mL. 10,000 $CD8^+$ T cells per samples were used for scRNA-seq by following the protocol as 10× Genomics provided.

scRNA-seq data processing: Read count matrices from single cell RNA sequencing samples were obtained by mapping using native 10× Cell Ranger output. Samples were pooled together into a single CSV and analyzed using custom scripts in R. Reads were pre-filtered by ribosomal and mitochondrial genes, normalized by cell per 10000 reads, then log transformed. For cell percentage quantifications, cells were first pre-filtered, in order, by $Ptprc^+$, $Cd3e^+$, $Cd8a^+$, and $Cd4^-$ expression. Marker expression status on high-confidence Cd8 cells was then quantified individually for each marker of interest. Expression status for a given gene was thresholded at 0.1 normalized read value. Differential expression between sgPdia3 and AAV-vector control was performed by two-sided Wilcoxon signed-rank test by gene, with p-values adjusted by Benjamini & Hochberg. Significance was compared to differences in mean expression between populations. Dimensionality reduction was performed by t-SNE (Rtsne package), followed by k-means and hierarchical clustering. Heatmap.2 function used to show normalized gene expression for most variable genes.

Large-scale patient T cell immune signature data analysis using TIDE:The gene signatures of T cell dysfunction and prediction of cancer immunotherapy response on cancer patient data was performed using the TIDE algorithm as previously described in Jiang, P. et al. Signatures of T cell dysfunction and exclusion predict cancer immunotherapy response. *Nat Med* 24, 1550-1558 (2018). Gene expression level of PDIA3 was associated to CTL-mediated patient survival with or without checkpoint blockade treatment.

PDIA3$^{-/-}$-EGFRvIII-CAR-T cell establishment: NTC (non-targeting control crRNA electroporated T cells) and PDIA3$^{-/-}$ primary CD8$^+$ T cells were targeted with TRAC locus RNP complex, a total of ~6×10$^9$ viral genome copy of AAV6 HDR donor (LHA-EFS-EGFRvIII-CAR-RHA, SEQ ID NO: 69,749) was added into each electroporated T cell reaction (3×10$^6$ T cell/reaction) within 1 h after electroporation. See Table 8 for amplification and detection primers.

Human PDIA3$^{-/-}$-EGFRvIII-CAR-T cell co-culture (kill) assay: To sensitively detect PDIA3$^{-/-}$-EGFRvIII-CAR-T cell killing efficacy, U87-GL and U87-GLEvIII cell lines were established (using an EGFRvIII expression construct, SEQ ID NO: 69,748). 2×10$^4$ U87-GL or U87-GLEvIII cells were seeded in a 96-well white polystyrene: plate, then different T cell:cancer cell ratio (E:T ratio) co-cultures were set up. Cancer cell killing was measured after 24 h of co-culture by adding 150 µg/mL D-Luciferin (PerkinElmer) using a multichannel pipette. Luciferase intensity was measured by a Plate Reader (PerkinElmer).

Standard statistical analysis: Data between two groups were analyzed using a two-tailed unpaired t-test or non-parametric Wilcox test. Time-course data used Log-rank (Mantel-Cox) test, one-way ANOVA, two-way ANOVA, Wilcox test or Komogorov-Smirnov test as appropriate. The p values and statistically significance were estimated for all analyses. Prism (GraphPad Software Inc.) and RStudio were used for these analyses.

Phage display antibody generation: Immunoplate wells were coated with 100 µl of purified recombinant protein (5 µg/mL in coating buffer) for 2 h at room temperature or overnight at 4° C. After 5 rounds of selection, the coating protein concentration will be reduced as selection rounds increase (from 5 µg/mL to 1 µg/mL). At the same time, the same immunoplate wells were coated with 100 µl of streptavidin (5 µg/mL in coating buffer), a control plate was coated with 200 µl of cold blocking buffer (0.5% BSA in PBS), followed by incubation at room temperature shaking at 350 rpm for 2 h. After 1 h of blocking, 200 µl of blocking buffer was added to the target plate (with recombinant protein), followed by incubation at room temperature shaking at 350 rpm for 2 h. The solution in control plate was discarded, followed by washing with PT buffer (0.05% Tween 20 in PBS). 100 µl of phage library was then added to each well, followed by incubation at room temperature for 1 h shaking at 350 rpm. The target plate was then washed with PT buffer after 2 h blocking, before the phage library was transferred from control plate to target plate, and incubated at room temperature for 2 h while shaking at 350 rpm. The target plate was then washed with PT buffer, dried by shaking, then 100 µl 0.1 M HCl/well was added to elute bound phage, followed by incubation at room temperature for 5 min shaking at 350 rpm. All eluted phage was collected in 1.5 mL eppendorf tubes and had ⅛ volume of 1 M Tris-HCl added to neutralize pH. 4.5 mL Omni cells in 2YT media (O.D.=0.5-1.0) were then infected with 450 µl library "out", and 1000× KO7 helper phage was added after 30 min culture, followed by incubation at 37° C. for 45-60 min while shaking. All Omni cells infected with phage library and KO7 were pulled into a 250 mL flask containing 30 mL 2YT-Kan/Carb media, and incubated at 37° C. overnight. Omni cells were then spun down and all supernatant was transferred in a new 50 mL tube, added 1/5 volume of PEG/NaCl solution to precipitate the phage, incubated for 20 min on the ice, then centrifuged for 10 min at 13,000 rpm at 4° C. The supernatant was decanted, the remaining bound phage was resuspended with cold PBS for second round selection. Selection rounds 2-5 were performed similarly to further enrich high affinity phages. Phage ELISA was then performed to analyze binding clones. ELISA positive clones were then sequenced to confirm CDR sequence.

The results of the experiments are now described.

Figure 17A:
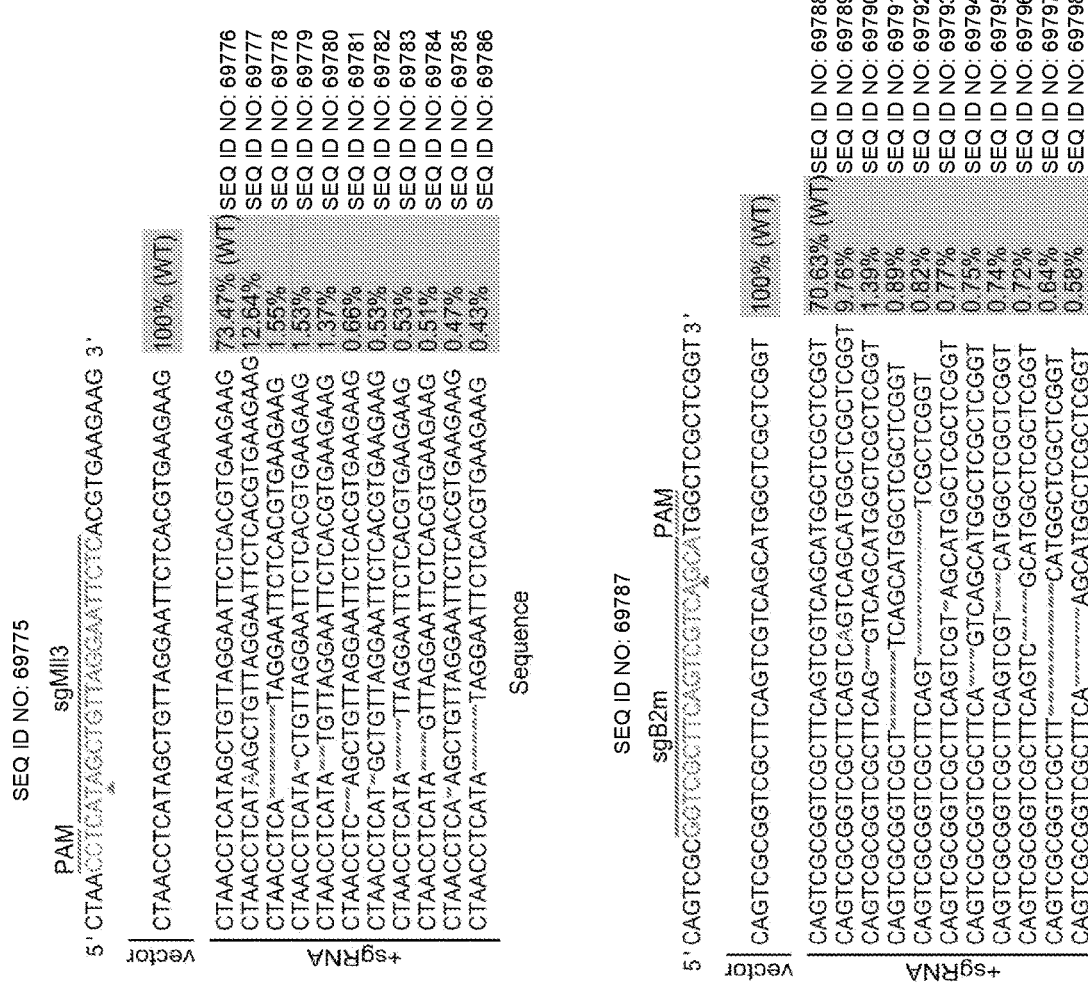
Figure 17C:
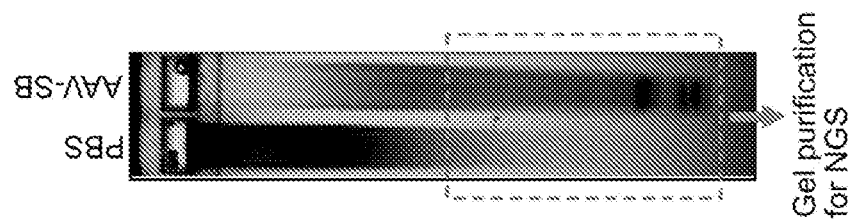
Figure 17B:
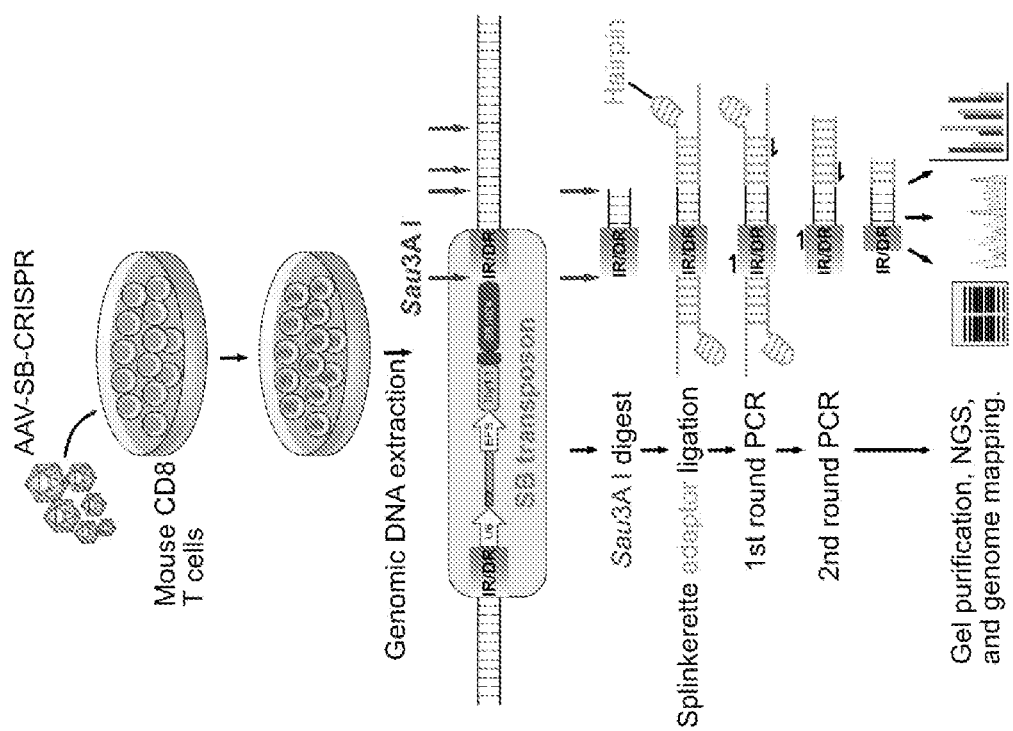

Example 1: Screening Surface Proteome Knockouts for Modulators of CD8$^+$ T Cell Infiltration into GBM A syngeneic mouse model of GBM with fully immunocompetent mice was utilized to perform a primary CD8$^+$ T cell screen in vivo. A hybrid AAV vector for CRISPR perturbation of primary T cells was created that utilizes a hyperactive Sleeping Beauty (SB) transposon system (AAV-SB100x), which enabled high efficiency transduction, efficient gene editing, and high-throughput genetic screens (SEQ ID NO: 69,821) (FIG. 1A). AAV was generated, transduced into mouse primary naïve CD8$^+$ T cells, and the genomic integration of AAV-SB100x was tested using splinkerette PCR (FIG. 17B). Electrophoresis of the splinkerette PCR amplification products from AAV-SB100x infected T cells, but not from uninfected T cells, showed multiple bands of varying intensity, indicating random genomic integration (Methods) (FIG. 17C). Sequencing of splinkerette PCR products revealed that they indeed mapped to the mouse genome with junctions to the SB transposon inverted repeats (IRs) (FIG. 17D). The genomic reads span across 18 out of 19 autosomes and both sex chromosomes (X and Y) in the mouse genome (FIG. 17E). Most of the integration sites mapped to intergenic regions and intronic regions, as compared to promoters, coding regions, or exonic untranslated regions (UTRs) (FIG. 17F), suggesting that these random integrations rarely disrupt essential coding or key functional elements.

Figure 18:
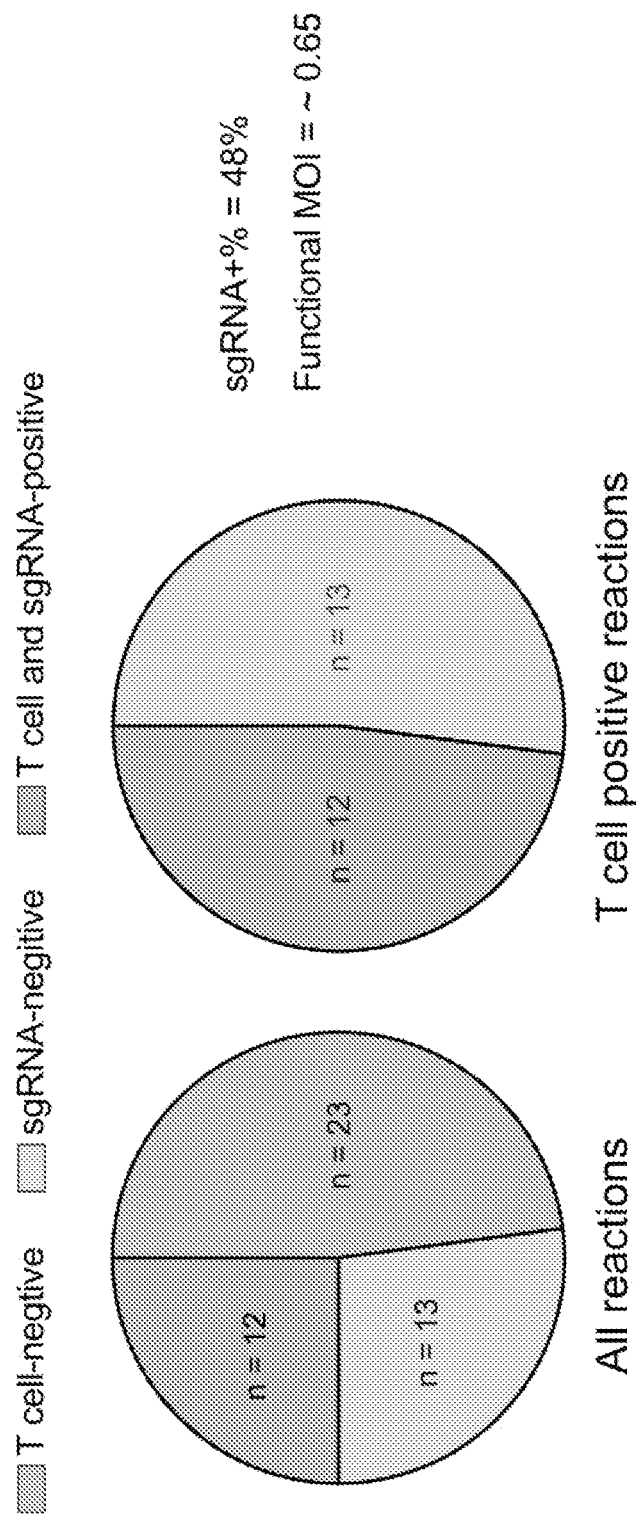
FIG. 18 is a series of graphs showing single cell RT-qPCR estimation of functional MOI of AAV-SB-CRISPR screen. Single cell RT-qPCR detection of single T cell expressing functional sgRNAs, for the estimation of functional MOI with exact transduction parameters in the AAV-Surf screen. PBS treated single T cells were used as a negative control. Numbers of wells without T cells, with sgRNA– T cells and with sgRNA$^+$ T cells were determined to estimate MOI.

To identify surface proteins that influence the CD8$^+$ T cell infiltration into GBM, two focused sgRNA libraries (surface libraries) were designed (first and second library). The libraries contained 6,628 or 61,911 sgRNAs that target 1,657 annotated surface protein encoding genes (4 sgRNAs per gene) (SEQ ID NOs. 1-6,628 and SEQ ID NOs. 7,837-64, 747), together with 1,000 or 5,000 non-targeting controls (NTCs) (SEQ ID NOs. 6,629-7,628 and SEQ ID NOs. 64,748-69,747). The surface library was cloned into the AAV-SB100x vector. Successful cloning of the AAV-surface CRISPR knockout library (AAV-Surf) was verified by sgRNA library readout followed by Illumina sequencing. AAV-Surf plasmid library was pool-packaged into a viral library at a titer of approximately 1.4×10$^{12}$ viral genome copy per milliliter (1.4×10$^{12}$ vg/mL). While AAV titer estimated by gc is often high, functional transduction can be multiple orders of magnitudes lower due to empty viral particles, defective particles, non-infectious particles, non-productive infections, and clearance by host cells. Therefore, functional multiplicity of infection (MOI) analysis was performed via single cell sgRNA qPCR of T cells, which were transduced with AAV-Surf library for 5 days. Single cells with functional sgRNA expression is estimated at 48%, or a functional MOI of 0.65 (FIG. 18).

Figure 1B:
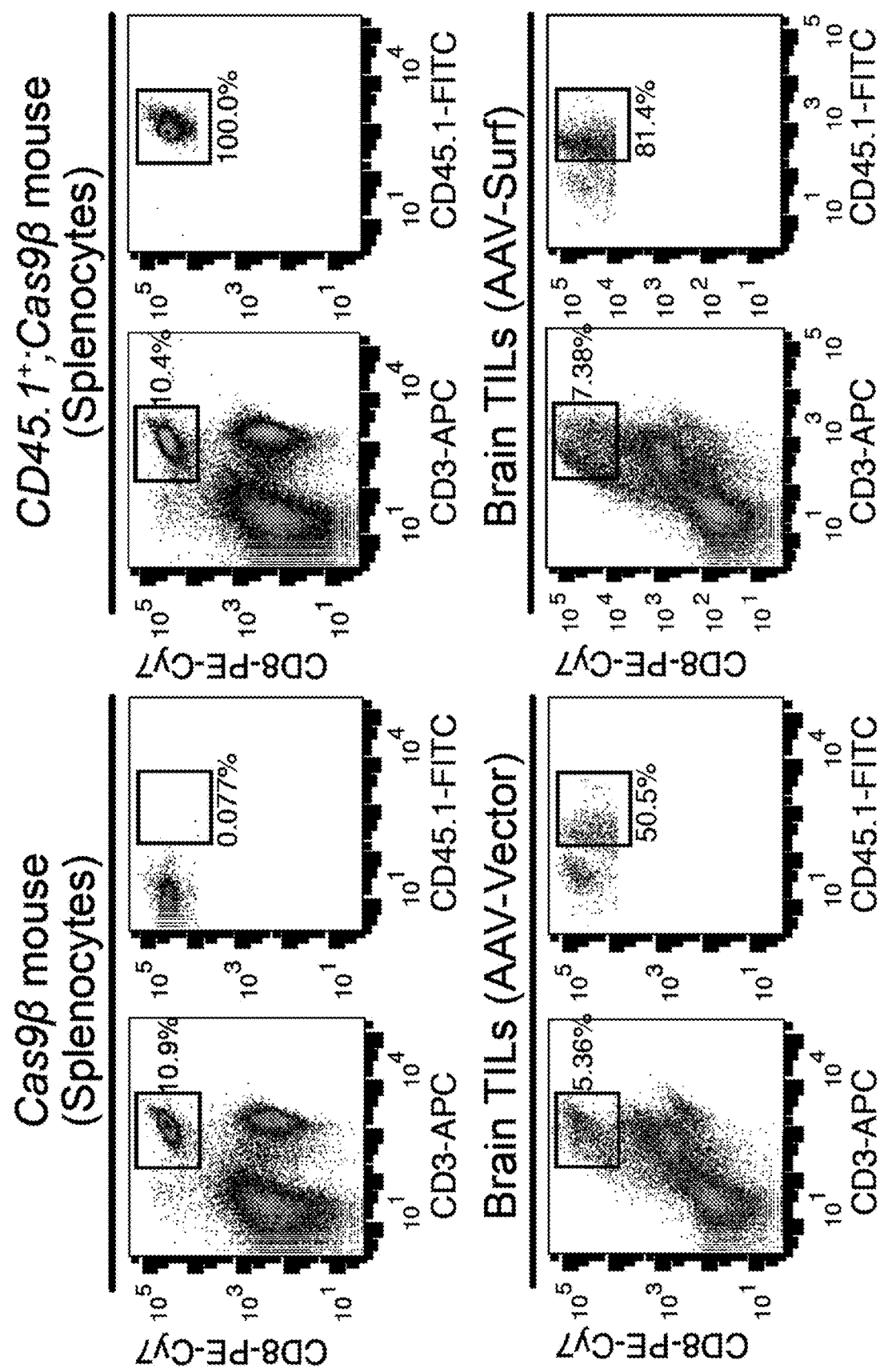
Figure 1C:
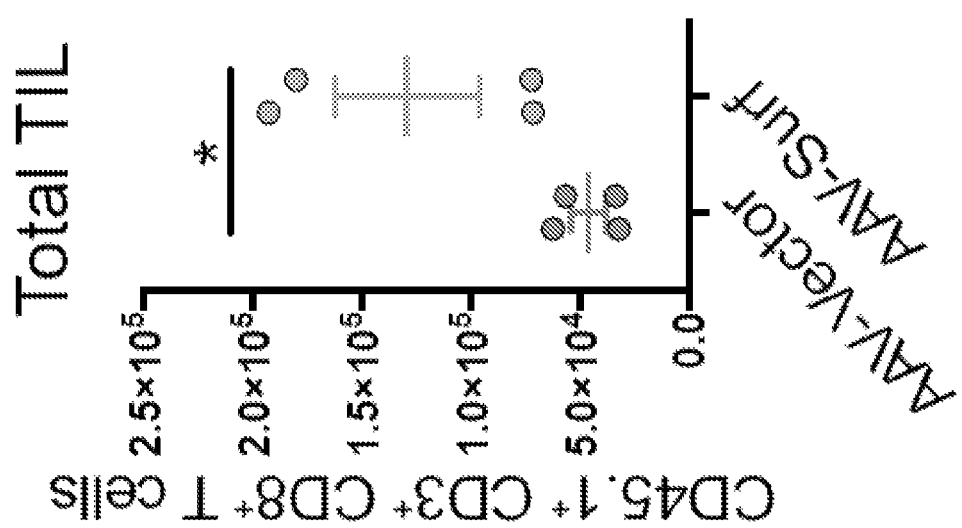
Figure 2D:
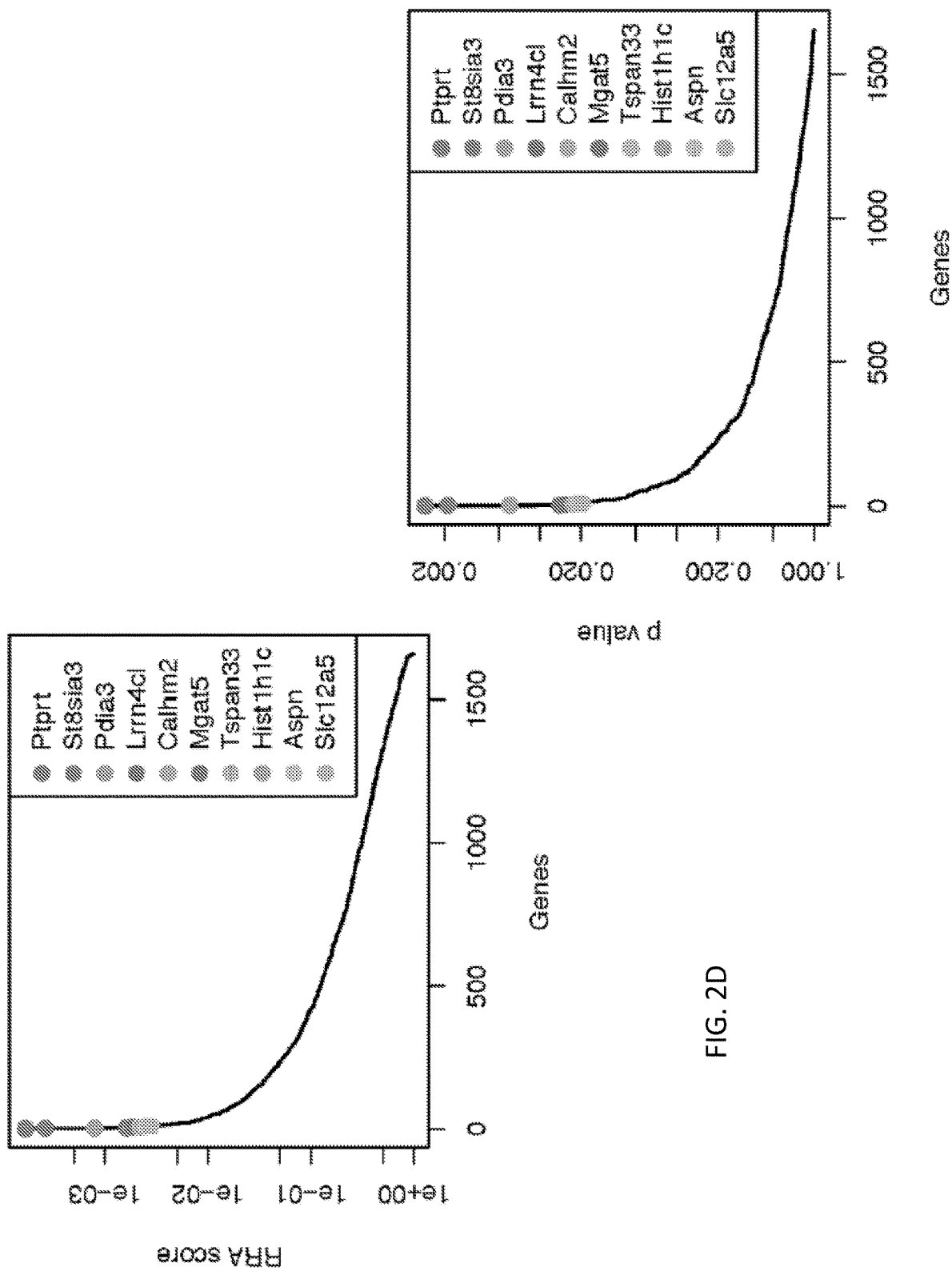
Figure 2F:
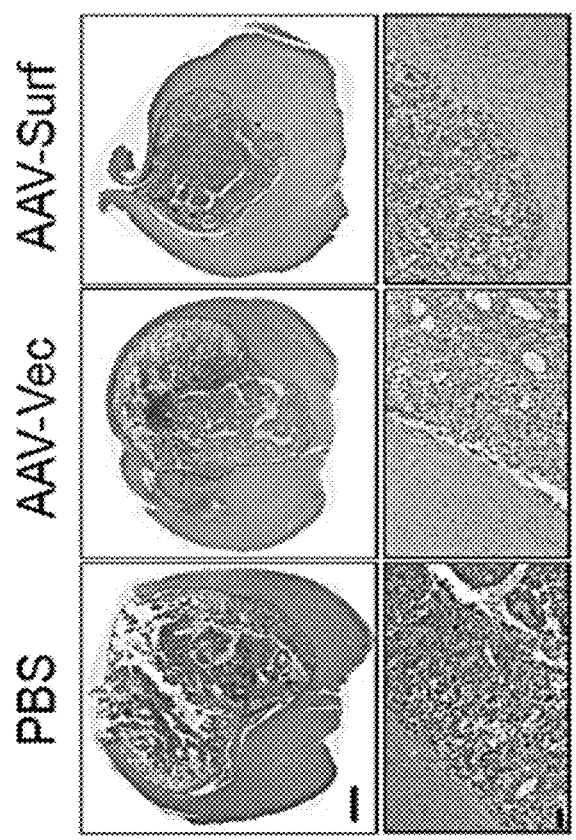
Figure 2E:
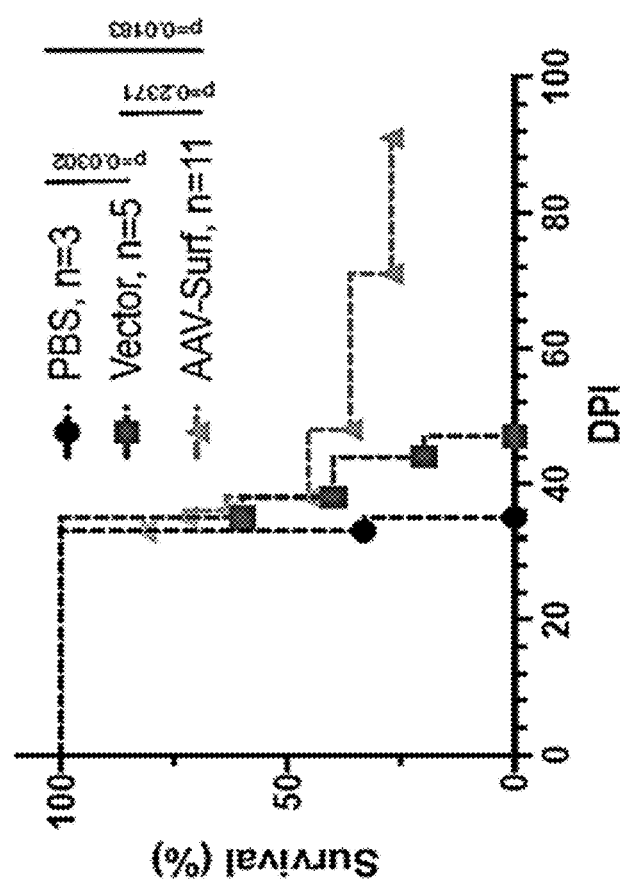
Figures 19A, 19B:
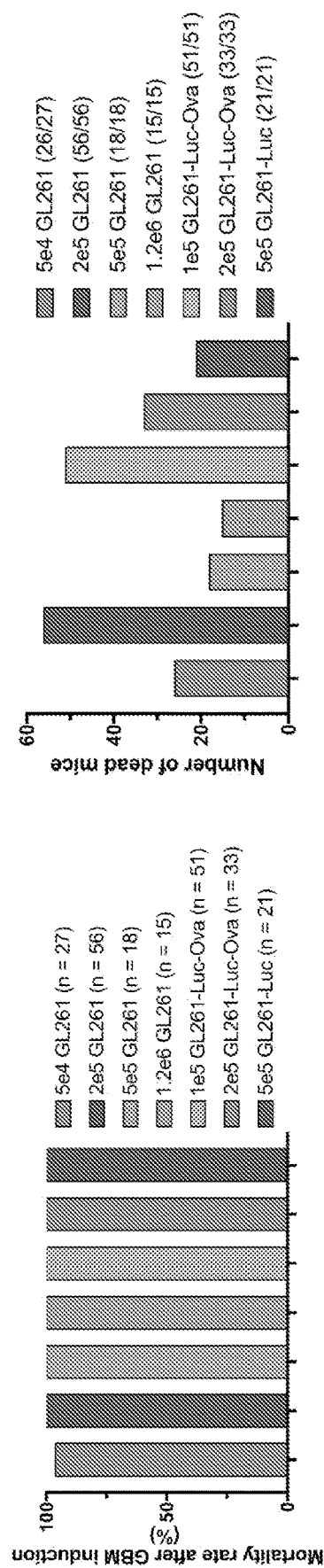
FIGS. 19A-19B are graphs showing penetrance estimation of intracranial brain tumor induction using GL261 and derivatives cell lines.
Figure 20D:
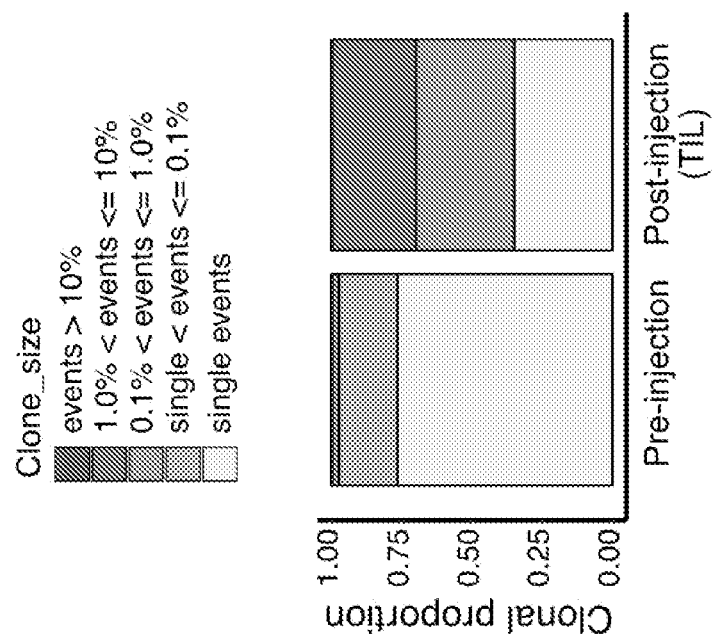
Figure 20E:
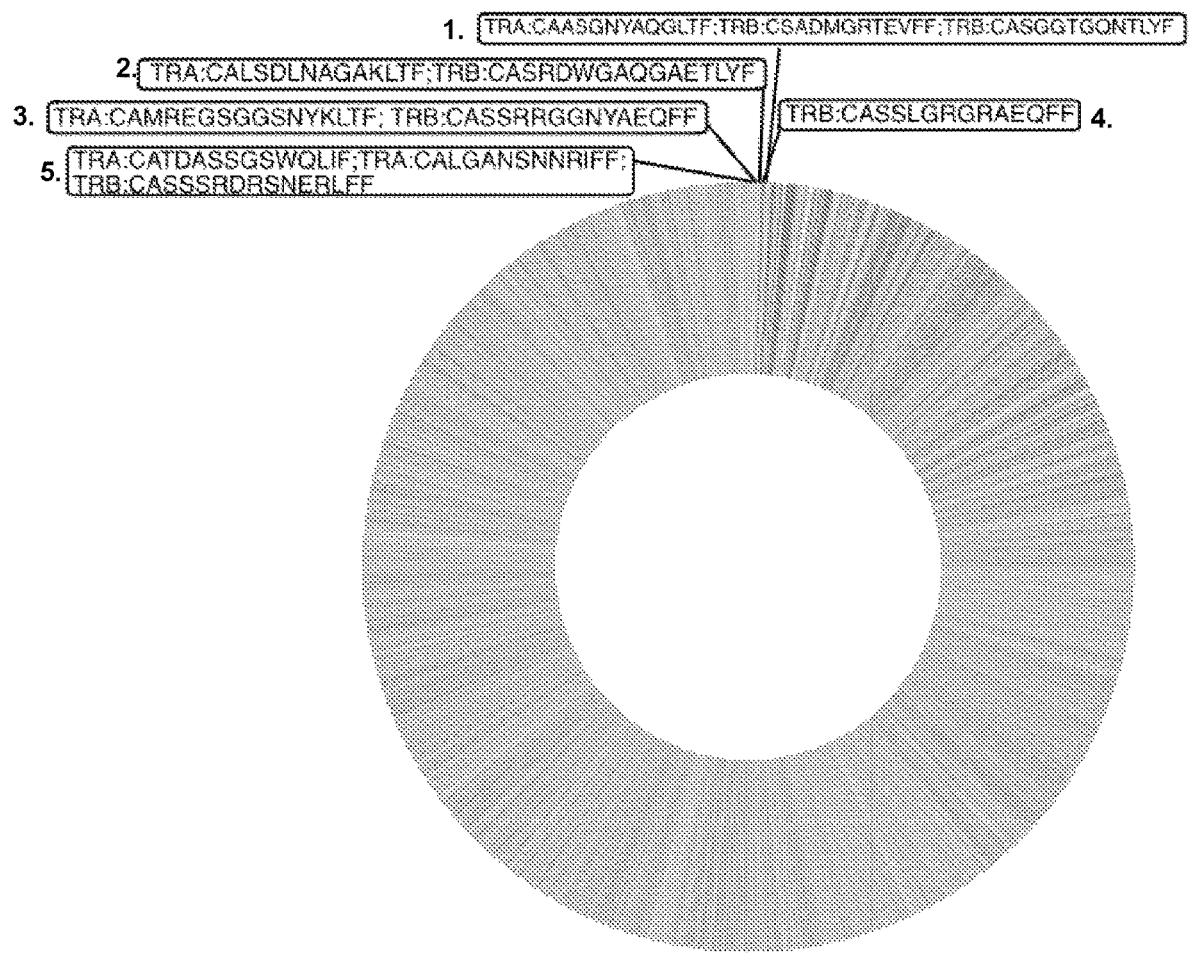
Figure 20F:
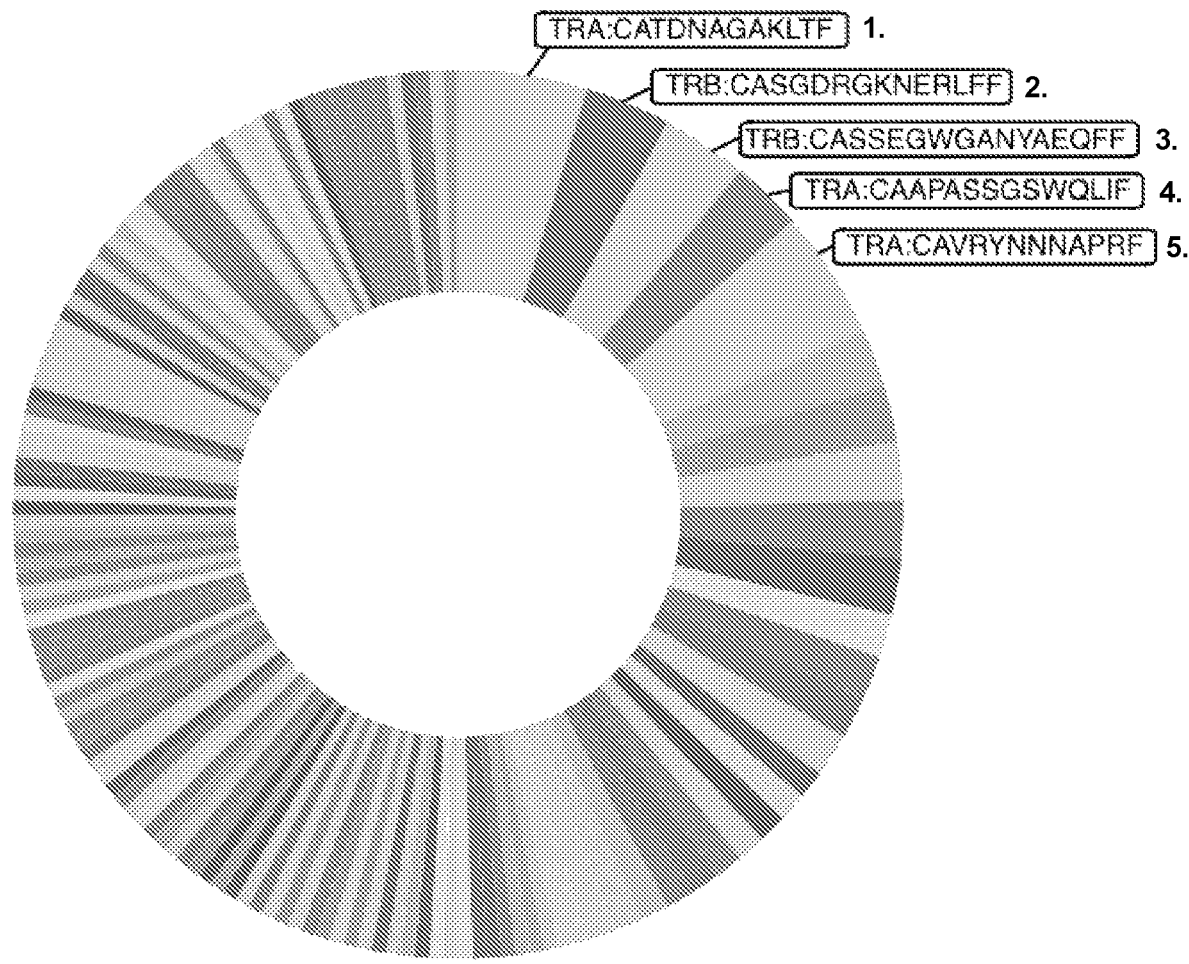

With the high titer AAV-surface library (AAV-Surf), primary T cells were screened in GBM using fully immuno-competent syngeneic models. Syngeneic mouse models were set up with native or luciferase-expressing GL261 cells (GL261 and GL261-FLuc, respectively) and transplanted into the lateral ventricles (LV) of C57BL/6J mice via intracranial injection (FIG. 1A). Intracranial injection of GL261 or its derivatives, the penetrance of brain tumor induction in untreated mice is at or near 100% (FIGS. 19A-19B). Cas9$^+$ CD8$^+$ T cells were then activated with anti-CD3c and anti-CD28, and transduced with AAV-Surf library to mutagenize the membrane proteome. CD8$^+$ T cells 5 days in culture showed no difference between AAV-Surf and AAV-Vector groups in PD-1, Lag3, or Tim-3 (FIG. 20A). Adoptive transfer of the AAV-mutagenized CD8 T cell pool was adoptively transferred into GBM engrafted mice via tail vein injection (FIG. 1A). Using CD45.1 transgenic mice, donor T cells were distinguished from those of the host (FIG. 1B). With CD8$^+$ T cells isolated from Cas9β;CD45.1 mice and transduced with AAV, the number of infiltrated donor-derived CD8$^+$ T cells was determined (FIG. 1C, FIG. 20B). Two parallel screens were also performed using CD8 T cells from T cell receptor (TCR) transgenic (OT-1) mice bred to Cas9β (FIG. 2A). Mice were monitored for brain tumor development by observation of macrocephaly, as well as by in vivo luciferase imaging where GL261-FLuc cells were used (FIG. 2B-2C). The results showed that adoptive transfer of CD8$^+$ T cells increased overall survival (Log-rank (Mantel-Cox) test, Vector vs. PBS, p=0.0302; AAV-Surf vs. PBS, p=0.0183; AAV-Surf vs. Vector, p=0.2371) (FIG. 2E). Brain tumors were found in all mice at the endpoint (FIG. 2F), except 3 mice in the AAV-Surf group that were luciferase-negative after T cell treatment. We observed that mice from the AAV-Surf group had increased numbers of infiltrating T cells, potentially linked to enhanced trafficking and/or survival of certain mutant T cells, or more complicated cell-cell interactions with a complex mutant pool. These TILs also have no difference in surface PD-1 level (FIGS. 20B-20C). TCR-seq was then performed on the pre-injection T cells and post-injection TILs, and observed a large number of different TCR clonotypes in pre-injection T cells as well as reduction of clonality in post-injection T cells, potentially due to limited number of TILs in the brain (FIGS. 20D-20F).

Figure 2H:
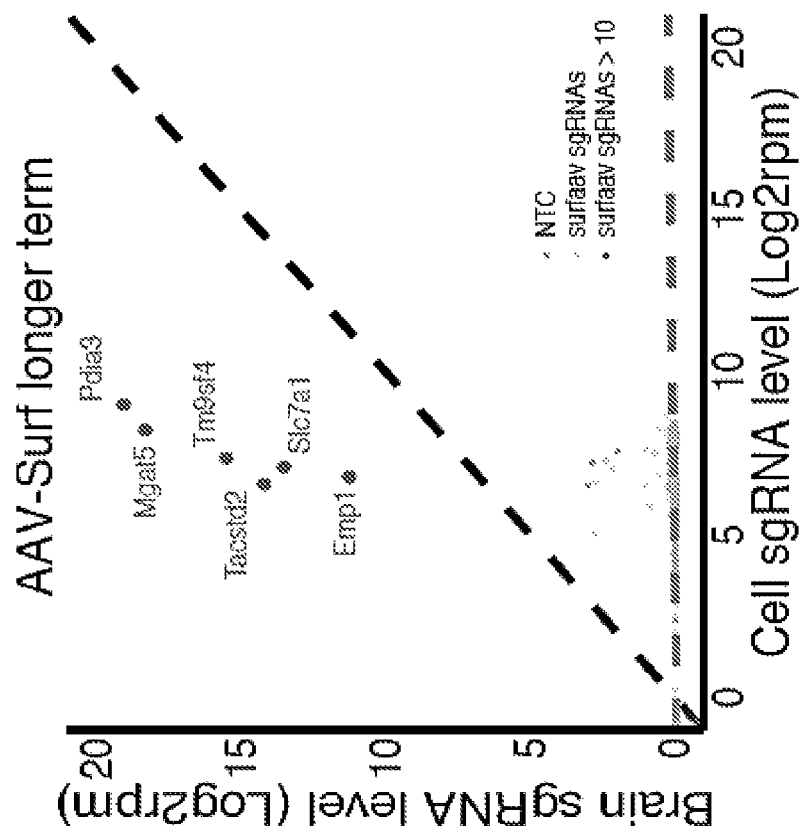
Figure 2G:
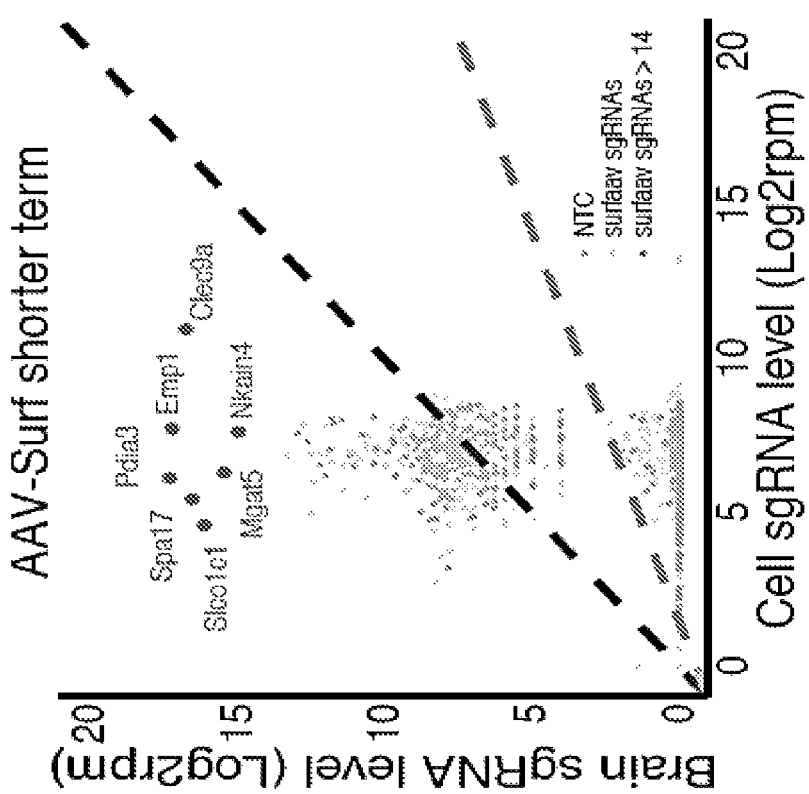

Whole brains were then collected along with spleen and cervical lymph nodes for genomic DNA preparation and sgRNA library readout using barcoded primers (SEQ ID NOs. 7,629-7,644). Deep sequencing data was analyzed within each sample to find enriched sgRNAs compared to the 1,000 NTC sgRNAs. For the shorter term screen, a set of enriched genes, Clec9a, Pdia3, Mgat5, Emp1, Slco1c1, Spa17, and Nkain4, was identified (FIG. 2G). For the longer term screen, most sgRNAs had disappeared after this extended period of selection, with the remaining highly abundant sgRNAs targeting six genes, Pdia3, Mgat5, Emp1, Tm9sf4, Tacstd2, and Slc7a1 (FIG. 2H). Notably, Pdia3, Mgat5 and Emp1 were also top hits in the shorter term screen. The MAGeCK analysis identified a list of significant genes, which include Pdia3 and Mgat5 (FIG. 2D), which implied that these two candidates might be essential genes for T cell anti-tumor activity.

The majority of the 1000 NTC sgRNAs follow a linear regression line between brain and cell pellet (FIG. 1D); whereas a fraction of sgRNAs are highly enriched in the brain suggesting expansion of these specific mutant T cells (FIG. 1D). Thirty-three significantly enriched sgRNAs targeting various membrane proteins were identified, including Mgat5, Cdh11, Emp1, Lag3, Slc29a4, Rnpep, Heft, P4ha1, Man2a1, and Pdia3 (FIG. 1D). RIGER analysis was performed for gene level significance considering multiple independent sgRNAs, which showed Mgat5, Pdia3, Pde5a, Ccdc80, Tnfrsf18, Defb26, Chrna7, Tspan13, Plat, and Lag3 as the top 10 hits (FIG. 1E). In the independent screens using OT-1:Cas9β mice, a similar list of gene hits were identified, with the top gene hits being Pdia3, Mgat5, and Emp1 (FIG. 2G-2H). qRT-PCR confirmed that most of the top hits are highly expressed in mouse CD8 T cells (FIG. 1F) suggesting that these candidate genes may modulate T cell function for anti-tumor activity against GBM.

Figure 1G:
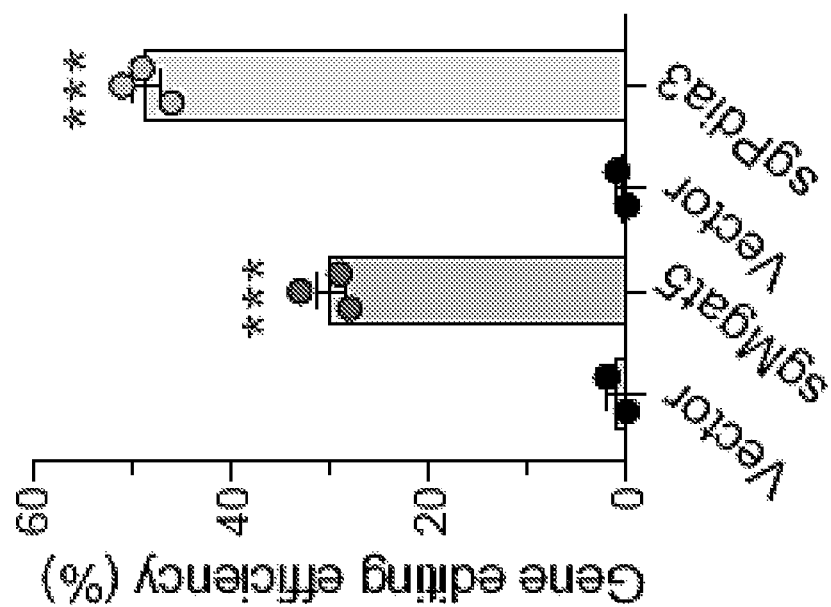
Figure 1F:
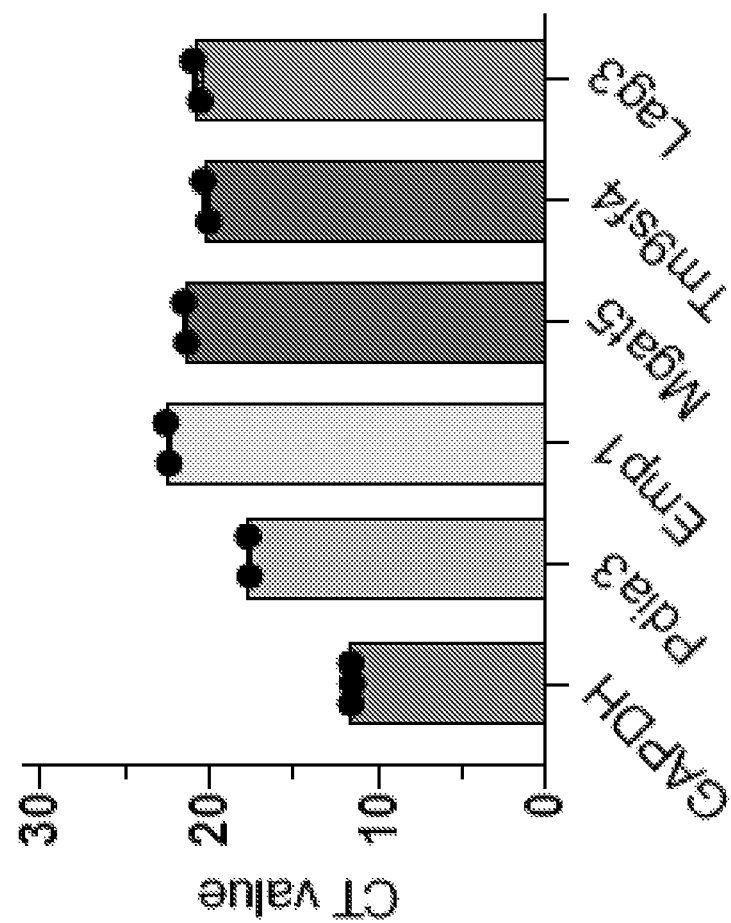
Figure 3D:
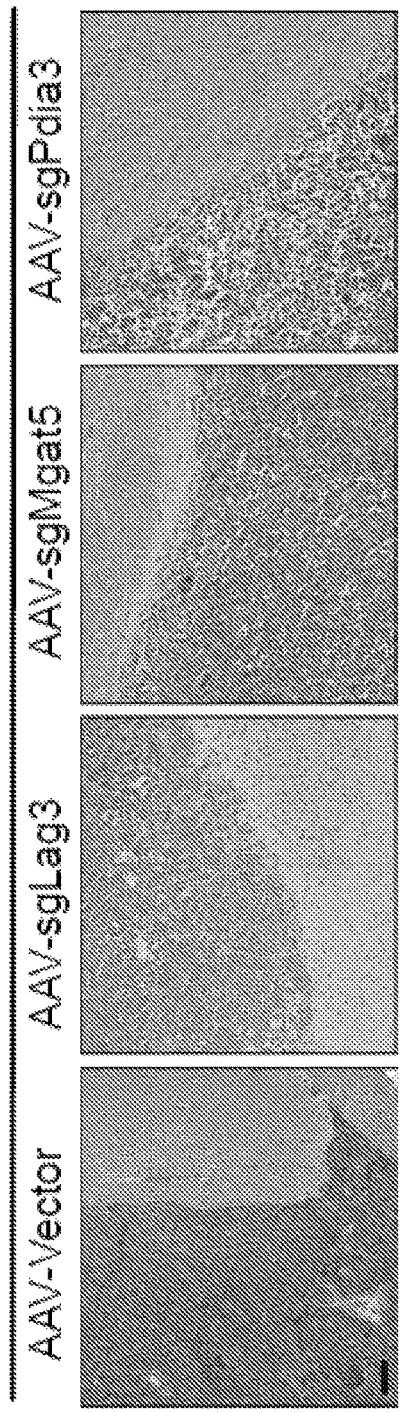
Figure 3E:

Example 2: Pre-Clinical Efficacy Testing of Top Candidates by Direct T Cell Editing and Adoptive Transfer The AAV-SB-CRISPR system can generate high-efficiency on-target gene editing in mouse primary CD8$^+$ T cells (FIG. 1G). To test whether AAV-CRISPR perturbation of these top hits can enhance the anti-tumor efficacy of T cells against GBM, Pdia3 and Mgat5 were specifically targeted, as they were the top hits most significantly enriched in all three screens, alongside with Lag3. Comparison was also performed with Lag3, a well-established immune checkpoint regulator expressed on T cells and a major emerging target of checkpoint blockade, currently with a monoclonal antibody in phase I clinical trial for GBM (NCT02658981). T7EI assays and RT-qPCR were performed on these targets and confirmed that T cells infected with AAV-SB-CRISPR carrying Pdia3 and Mgat5 sgRNAs have on-target gene editing and mRNA downregulation before T cell adoptive transfer (FIGS. 3B-3C). In a syngeneic orthotopic GBM model with GL261 intracranial implantation in C57BL/6J mice, survival analysis of GBM engrafted mice showed that the individual knockouts of each of the three genes (Lag3, Mgat5 and Pdia3) in the adoptively transferred CD8$^+$ T cells prolonged overall survival when compared to AAV-Vector control (FIGS. 3F-3G).

Figure 1H:
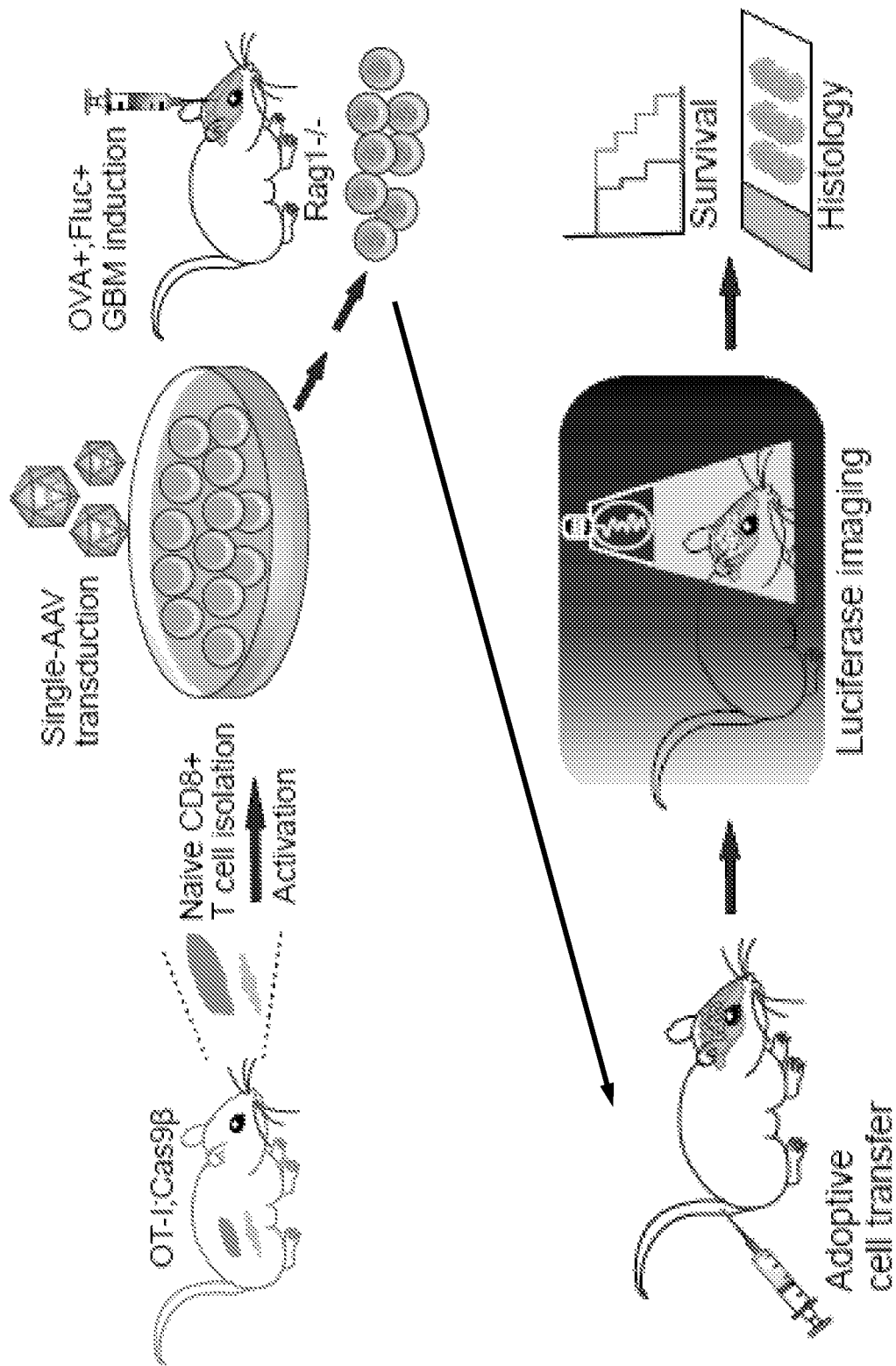
Figure 4A:
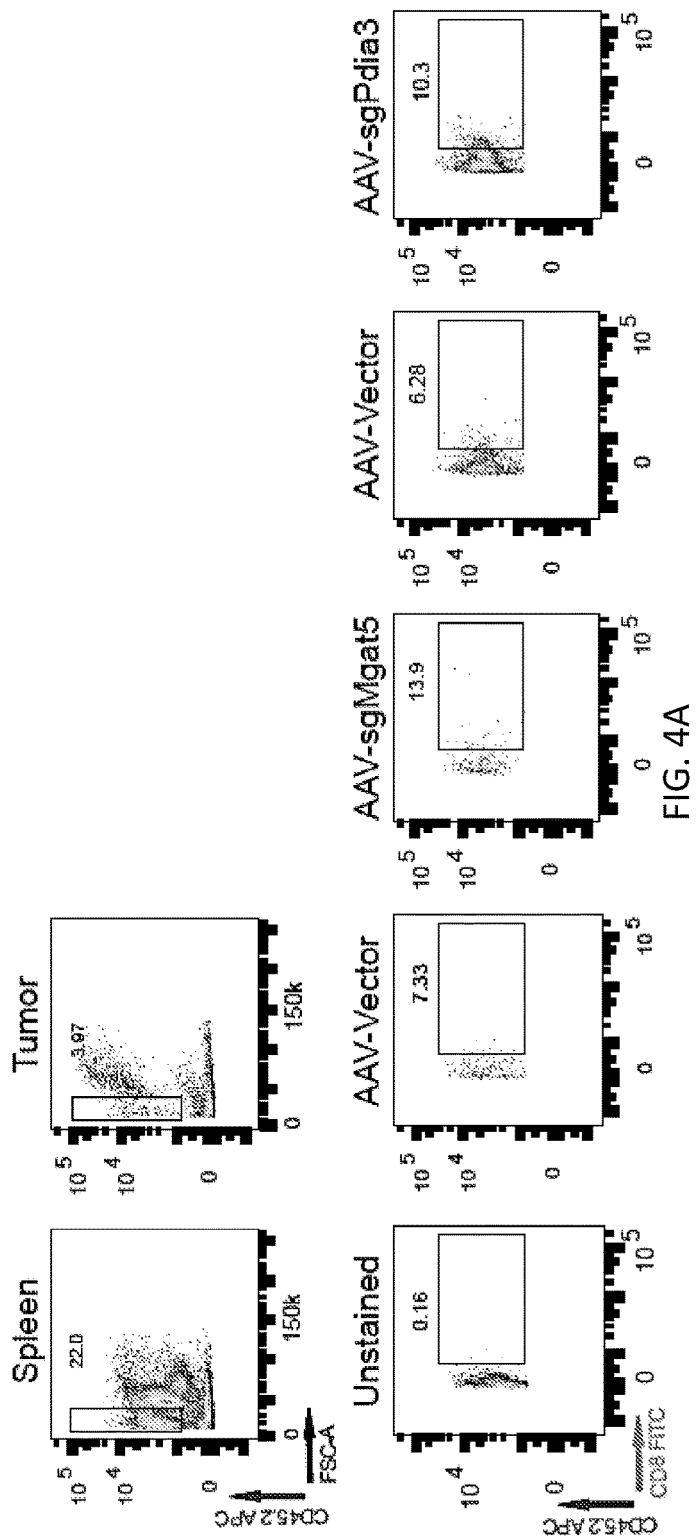
FIGS. 4A-4B show CD8$^+$ T cell infiltration analysis after Pdia3 or Mgat5 knockout using a cognate TCR-model tumor antigen system. Rag1$^{-/-}$ mice were injected with GL261-FLuc-mCh-rOVA #1 cells, OT-I;Cas9β CD8$^+$ T cells were isolated and infected with AAV-sgMgat5 and AAV-sgPdia3 virus after confirmation of brain tumor development by luciferase imaging using IVIS. $5 \times 10^6$/mouse OT-I;Cas9β CD8+ T cells were i.v. injected. Brain tumor were isolated after 5 days of i.v injection.
Figure 4B:
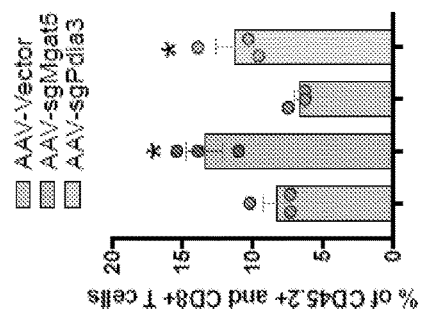

To determine if CRISPR editing of these genes would similarly garner therapeutic enhancement using an antigen-specific OT-I;Cas9β CD8$^+$ T cells against established GL261 brain tumors expressing a model antigen, chicken ovalbumin (cOVA), GL261-FLuc-mCh-cOVA cell lines were expanded from a single cell with clonal expression of cOVA (FIG. 3A). GL261-FLuc-mCh-cOVA #1 cells were transplanted into the lateral ventricle (LV) of each RagF mouse to induce GBM. CD8$^+$ T cells from OT-I;Cas9β donors were isolated, activated, and infected with single AAV construes. Ten days after tumor implantation, adoptively transferred single gene edited or control OT-I;Cas9β CD8$^+$ T cells intravenously into GBM-bearing recipient mice (FIG. 1H). Survival analysis showed that AAV-CRISPR perturbation of Mgat5, Pdia3 or Emp1 each significantly improved overall survival of GL261-cOVA GBM bearing mice when compared to AAV-Vector control (FIGS. 1I-1K). Furthermore, flow cytometry analysis of infiltrating CD45.2+;CD8+ immune cells revealed proportionally higher abundance of Mgat5 and Pdia3 knockout CD8+ T cells following adoptive transfer (FIG. 1L and FIGS. 4A-4B).

Figure 5A:
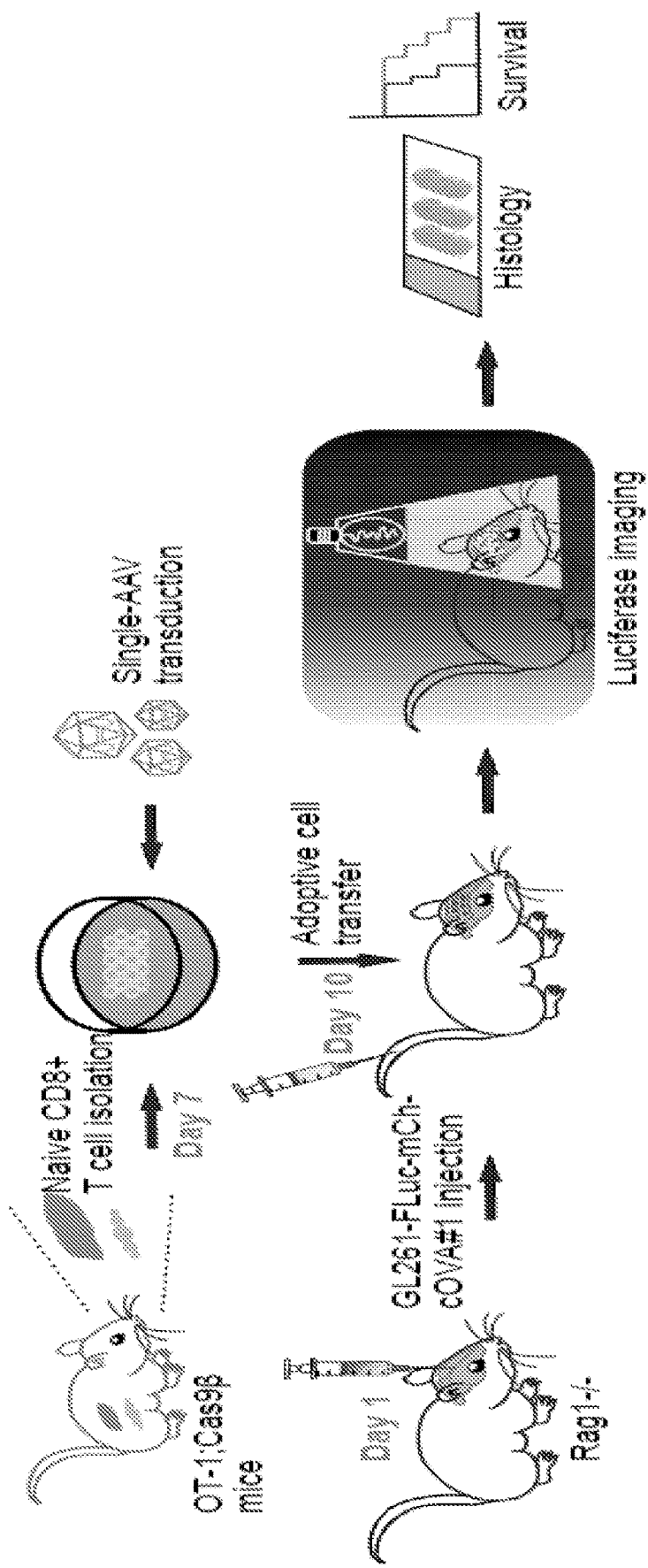
Figure 5B:
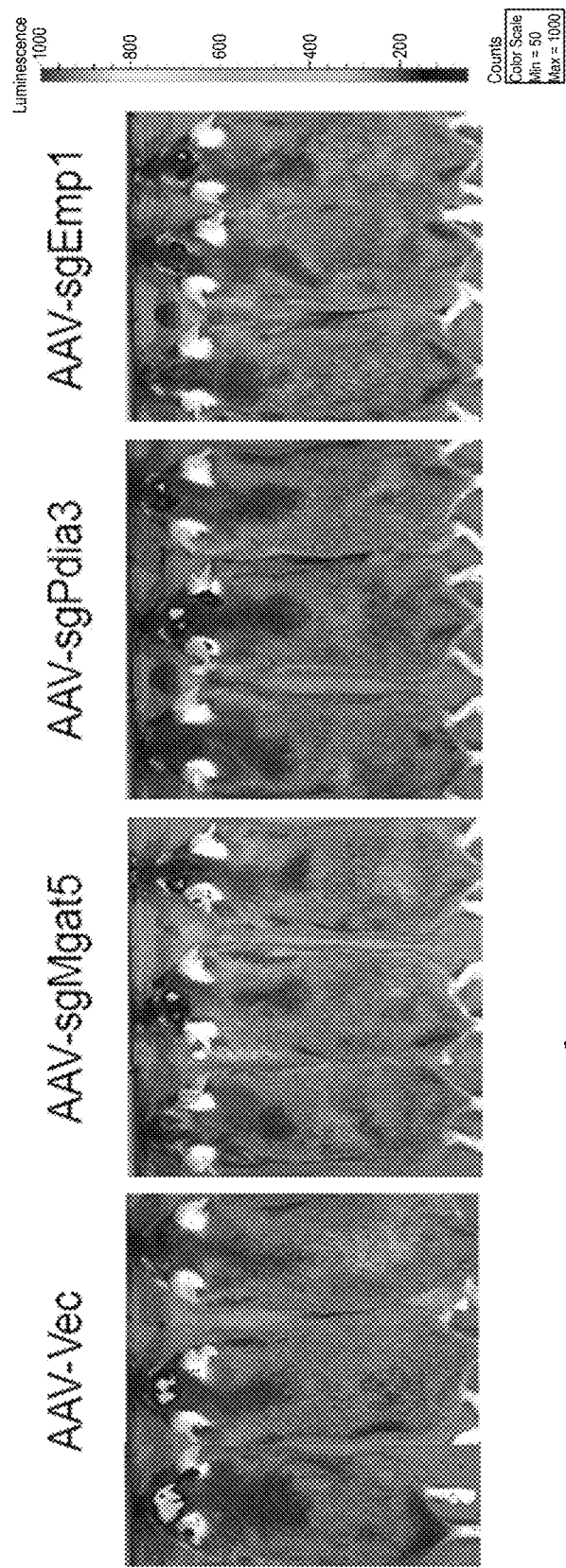
Figure 5B:
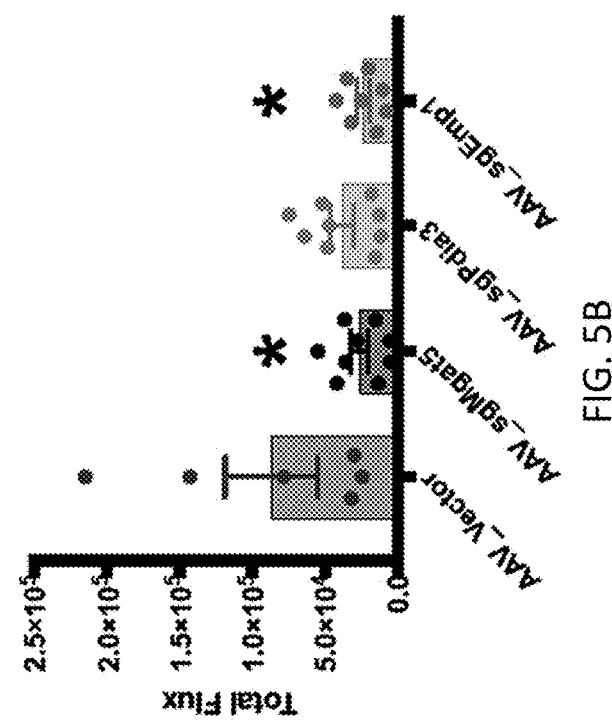

Example 3: Validation of Top Candidates Using a Cognate TCR-Model Tumor Antigen System It was next asked whether perturbation of these candidates would similarly garner therapeutic enhancement using antigen-specific OT-1; Cas9β CD8+ T cells against established GL261 brain tumors expressing a model antigen, chicken ovalbumin (cOVA). To address this, GL261-FLuc-mCh-cOVA cell lines were established, where each cell line was expanded from a single cell with clonal expression of cOVA. $1 \times 10^5$ GL261-FLuc-mCh-cOVA #1 cells were transplanted into lateral vetricles Rag1$^{-/-}$ mice. Ten days after tumor implantation, OT-1;Cas9β CD8+ T cells were adoptively transferred intravenously (FIG. 5A). Once mice in the AAV-Vector group began to show signs of body score deterioration or macrocephaly, in vivo imaging was performed to quantify the relative tumor burden among different groups (FIG. 5B). Although all mice were eventually deemed destined for euthanasia within three months due to the aggressiveness of these brain tumors (FIG. 5B), comparative analysis demonstrated that CRISPR perturbation of Mgat5 or Emp1 in the adoptively transferred T cells significantly repressed tumor growth (FIG. 5B). In addition, overall survival was significantly improved in GL261-cOVA GBM bearing mice with adoptive transfer of OT-1;Cas9β CD8+ T cells transduced with AAV-sgMgatS (Log-rank Mantel-Cox test, p=0.0475), AAV-sgPdia3 (Log-rank Mantel-Cox test, p=0.0114) and AAV-sgEmp1 (Log-rank Mantel-Cox test, p=0.0002) groups as compared to AAV-Vector control (FIGS. 5C-5E).

Figure 6A:
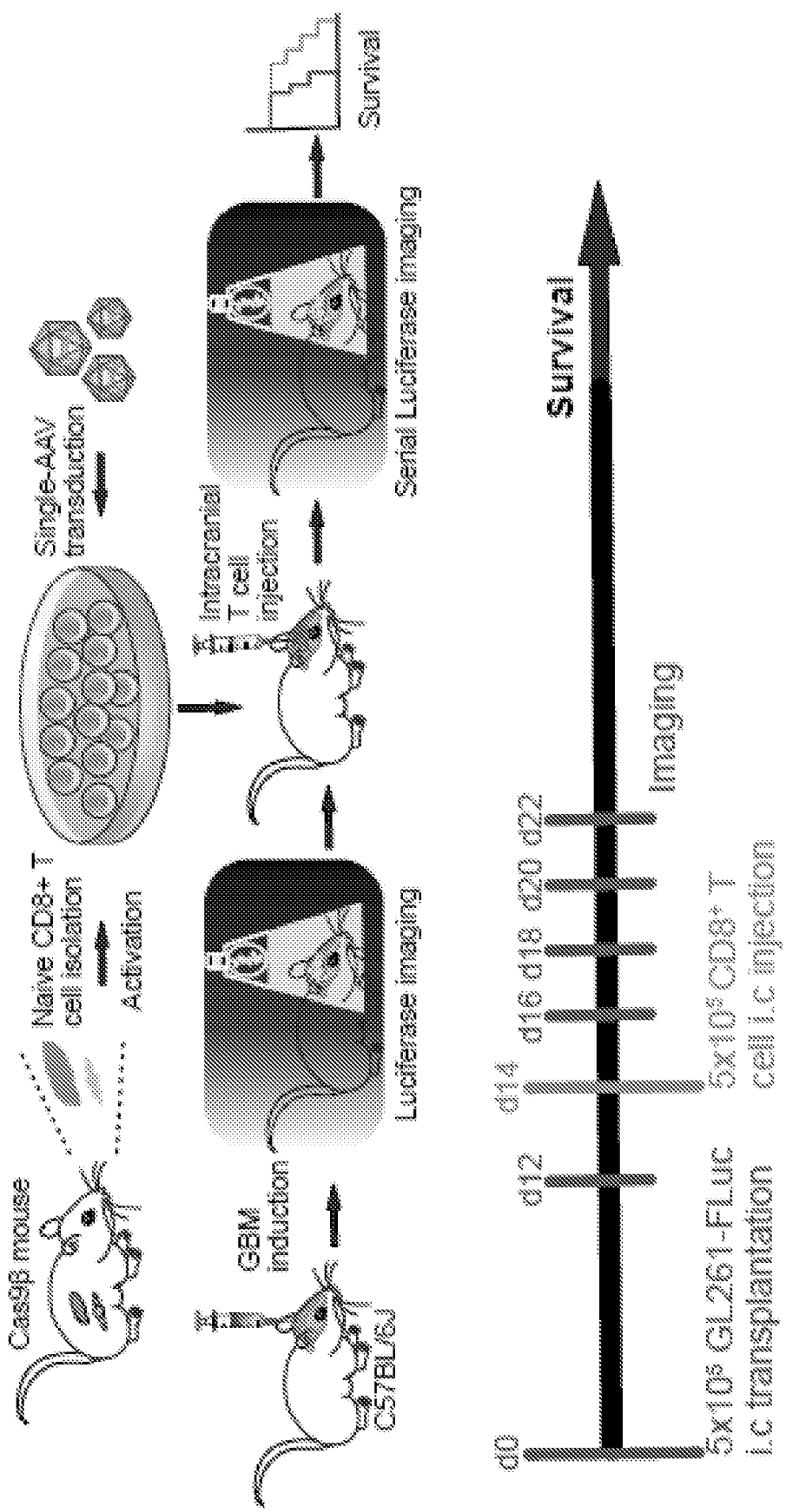
FIGS. 6A-6H describe the efficacy testing of AAV-SB-CRISPR targeting of Pdia3, Mgat5 and in combination in CD8+ T cell in a syngeneic mouse model of GBM.
Figure 6B:
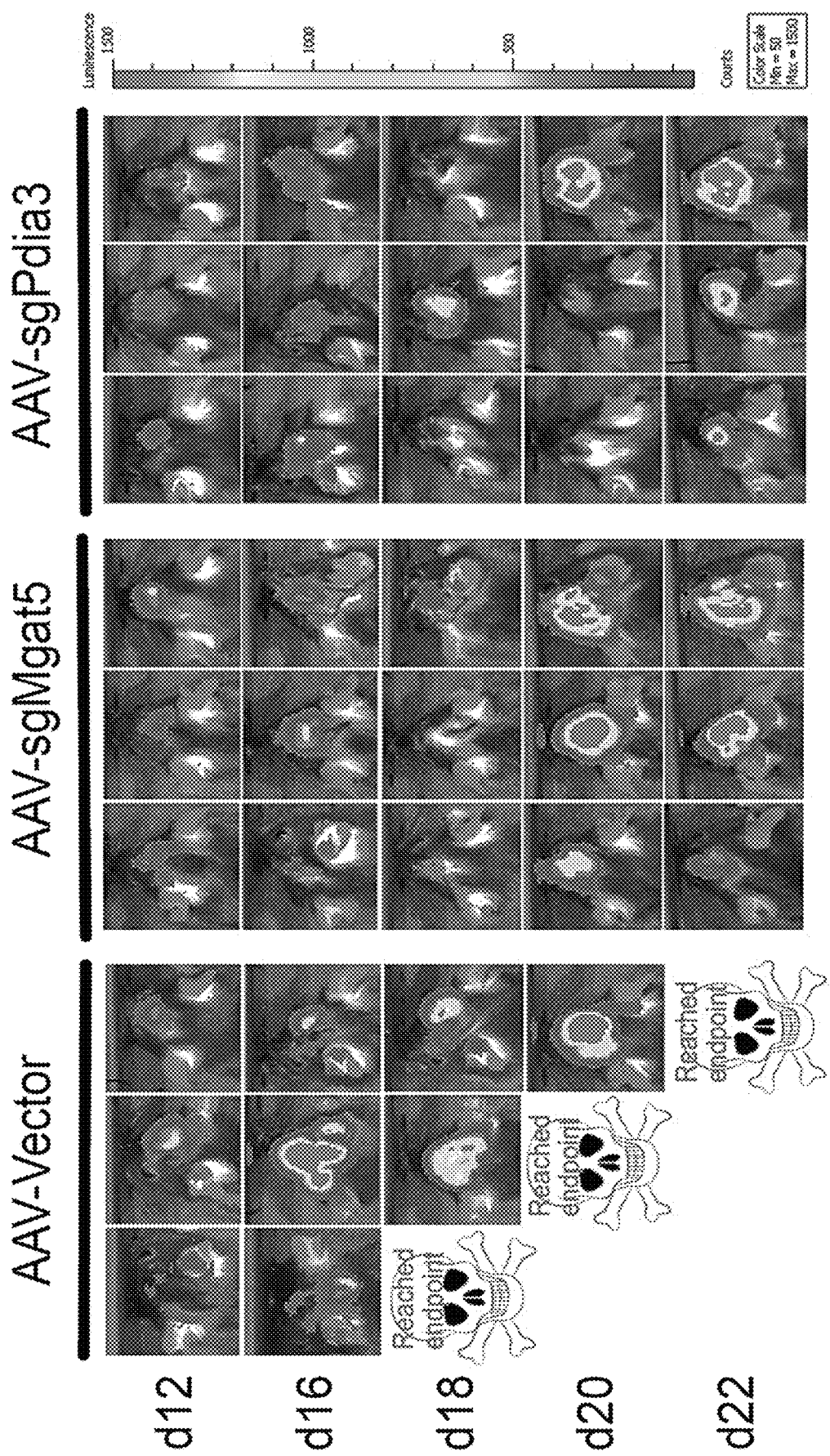
Figure 6C:
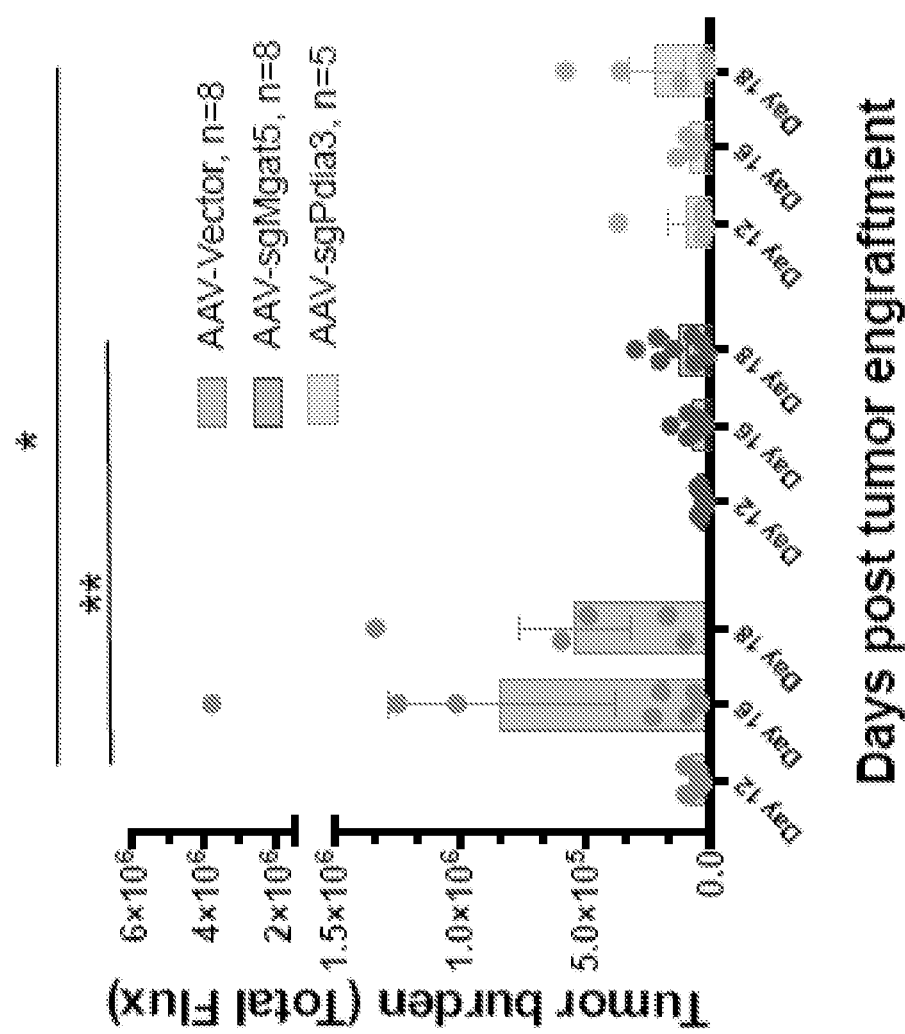
Figure 6D:
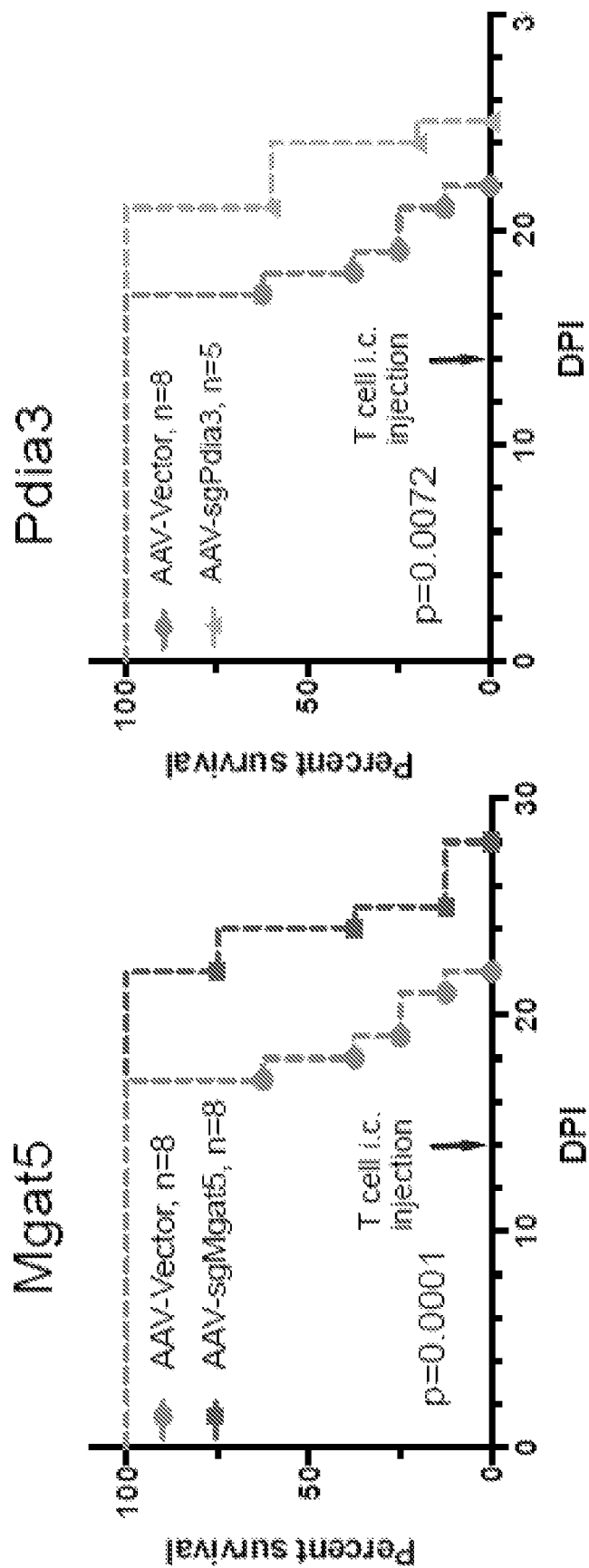
Figure 6E:
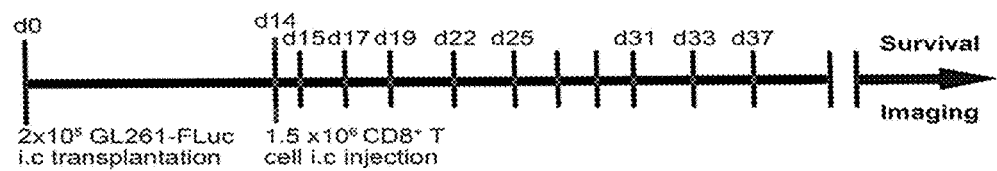
Figure 6F:
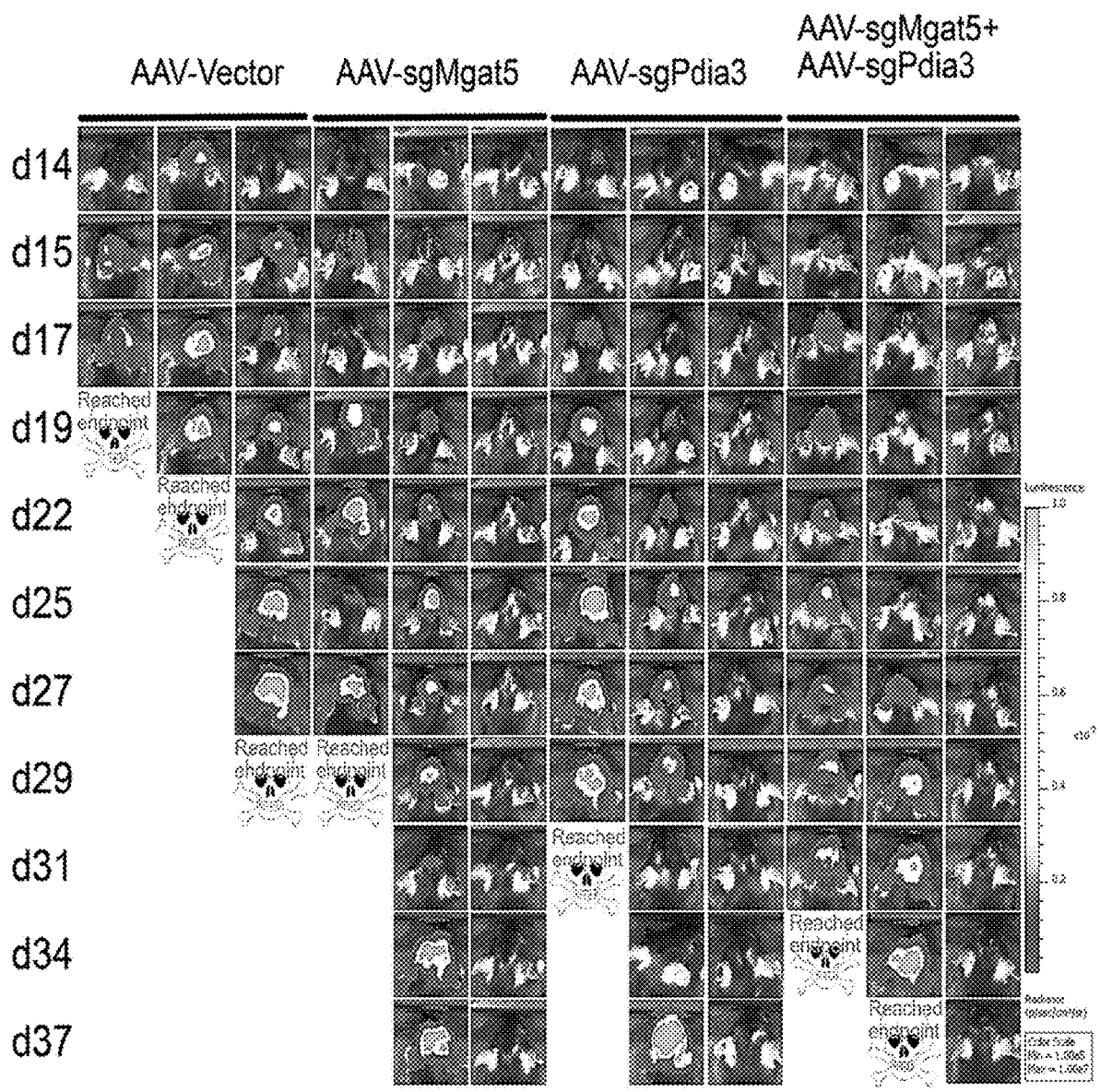
Figure 6G:
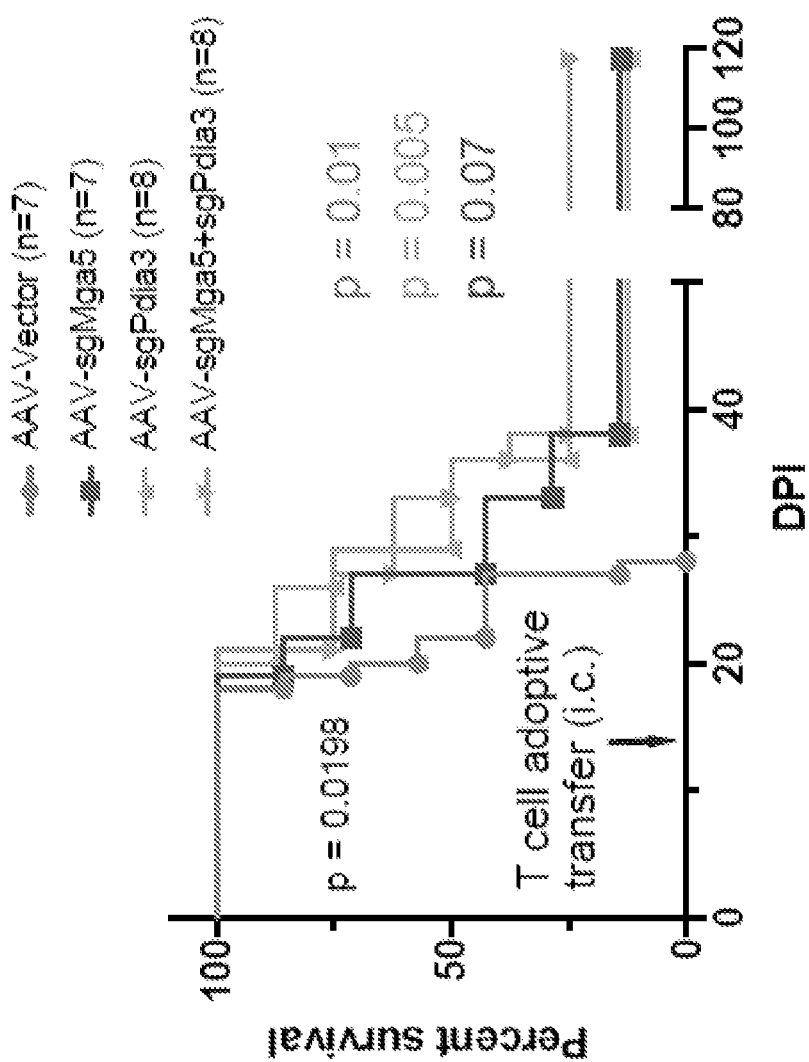
Figure 6H:
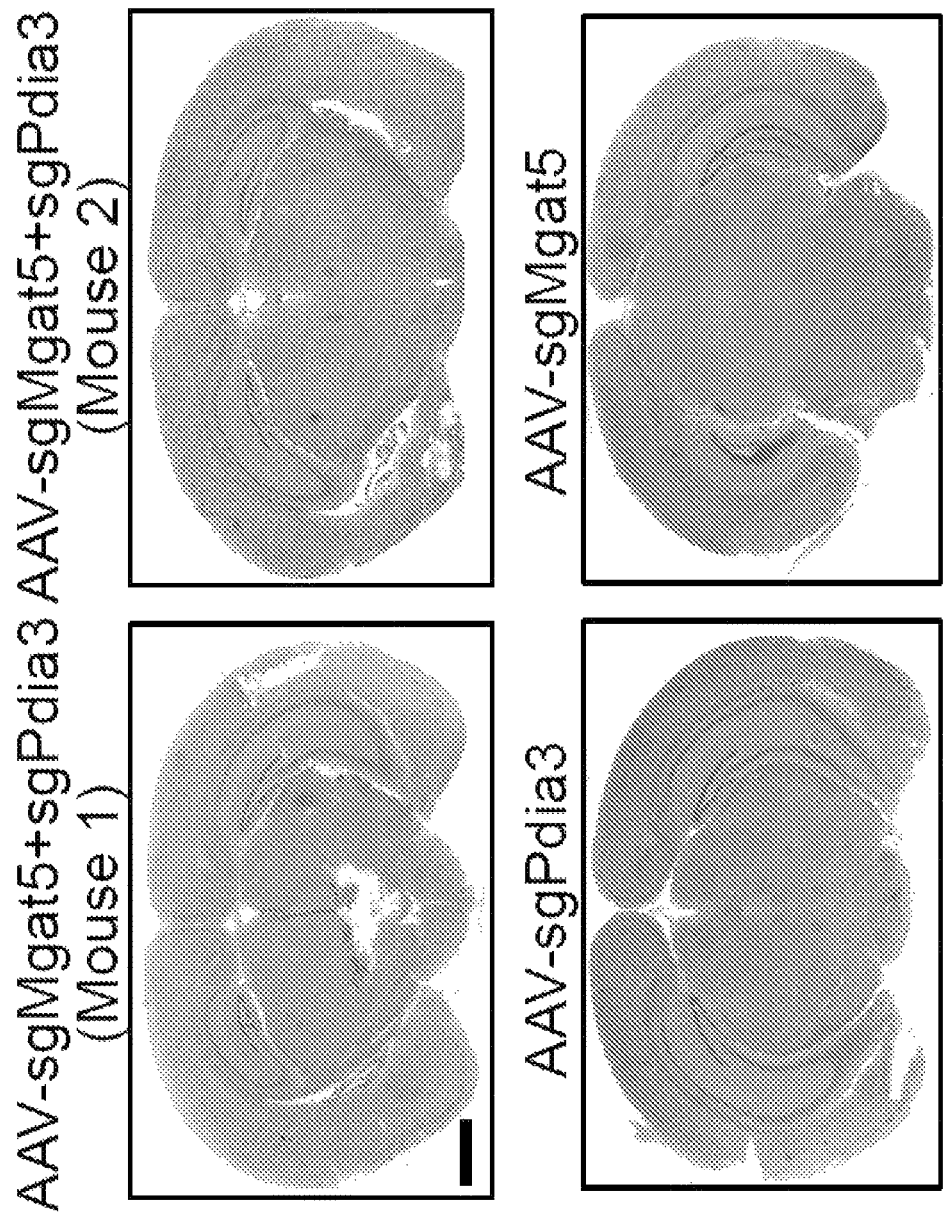
Figure 21A:
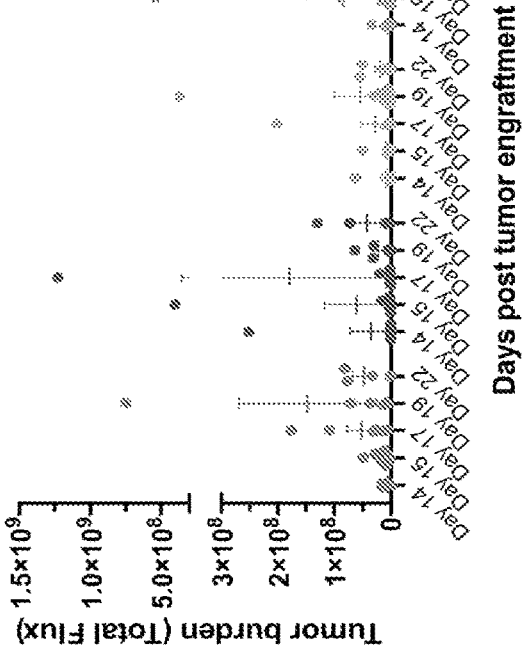
FIGS. 21A-21B show representative luciferase imaging for tumor burden quantification.
Figure 21B:
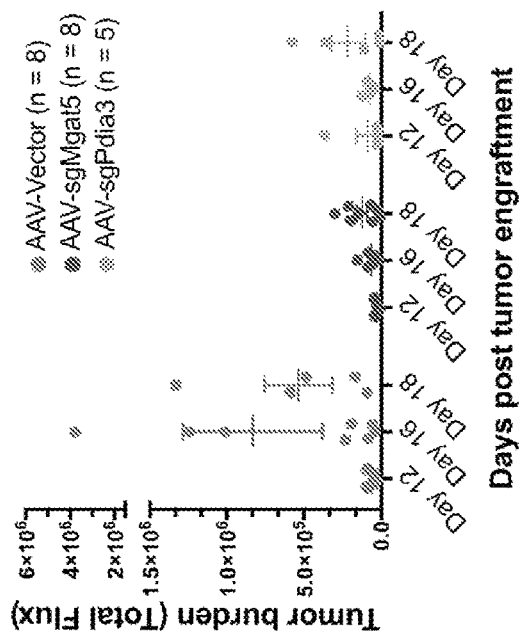

Example 4: Validating Efficacy of Pdia3 and Mgat5 Perturbation in CD8 Tcells Using an Intracranial Injection GBM Cancer Model GL261-FLuc cells were adoptively transferred via intracranial procedure to induce tumor, and IVIS bioluminescent imaging was performed to ensure each mouse had developed brain tumor. 10 days post tumor transplant, intracranial injection of AAV-sgMgatS or AAV-sgPdia3 infected CD8+ T cells at 1:1 initial seeding ratio (cancer cell:T cell) into the LV of the GL261-FLuc tumor bearing mouse brains was performed (FIG. 6A). Tumor growth was monitored closely by in vivo imaging every two days after T cell intracranial injection (FIG. 6B). Luciferase imaging results showed that mice receiving intracranial injection of Mgat5 or Pdia3 knockout CD8+ T cells had significantly lower tumor burden during early disease progression (FIGS. 6B-6C), as well as significantly improved overall survival (FIG. 2D). Intracranial adoptive T cell transfer was repeated but with a lower initial cancer cell:T cell ratio (1:7.5) (FIG. 6E). Additionally, a group of CD8+ T cells infected with both AAV-sgMgat5 and AAV-sgPdia3 was included (FIG. 6E). All mice receiving AAV-Vector infected CD8+ T cells quickly reached survival endpoints due to rapid GBM progression (FIG. 2F-2G), whereas all three AAV-CRISPR CD8+ T cell perturbation groups had prolonged survival (AAV-sgMgat5, AAV-sgPdia3, or AAV-sgMgat5+AAV-sgPdia3), with a fraction of mice become tumor-free and having long-term survival (FIG. 2E-2F; FIG. 6G). Tumor burden was quantified by luciferase flux at various timepoints (FIG. 21A-21B). The brains of long-term survivor mice were then examined by histology at 8 months (approximately 240 days) post injection and found that their brains were indeed tumor-free (FIG. 6H). These data suggested that single gene AAV-CRISPR perturbation of Mgat5, Pdia3, or their combination enhanced the efficacy of intracranial adoptive T cell transfer against GBM.

Figure 7A:
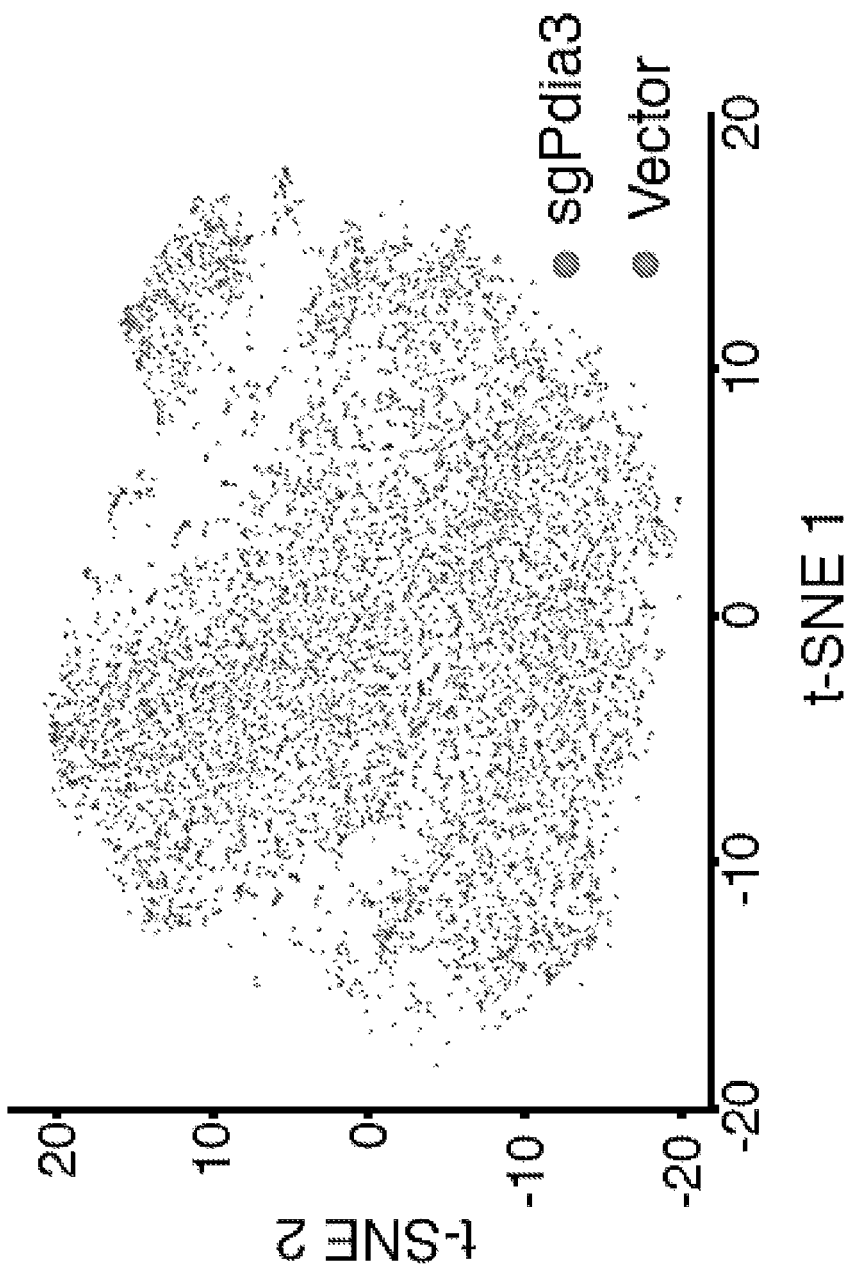
FIGS. 7A-7D illustrate single-cell RNA sequencing (scRNA-seq) analysis in Pdia3 knockout in CD8+ T cells.
Figure 7B:
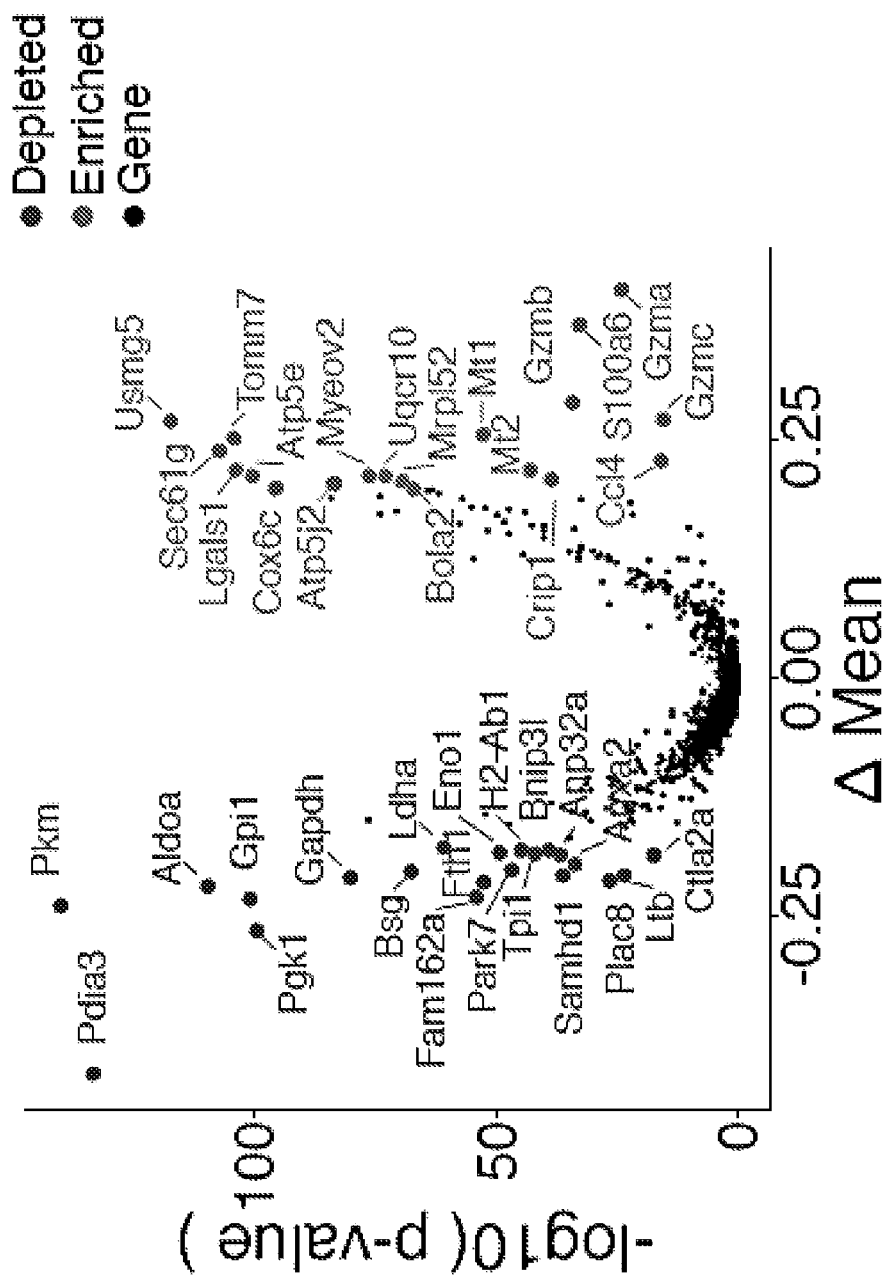
Figure 7C:
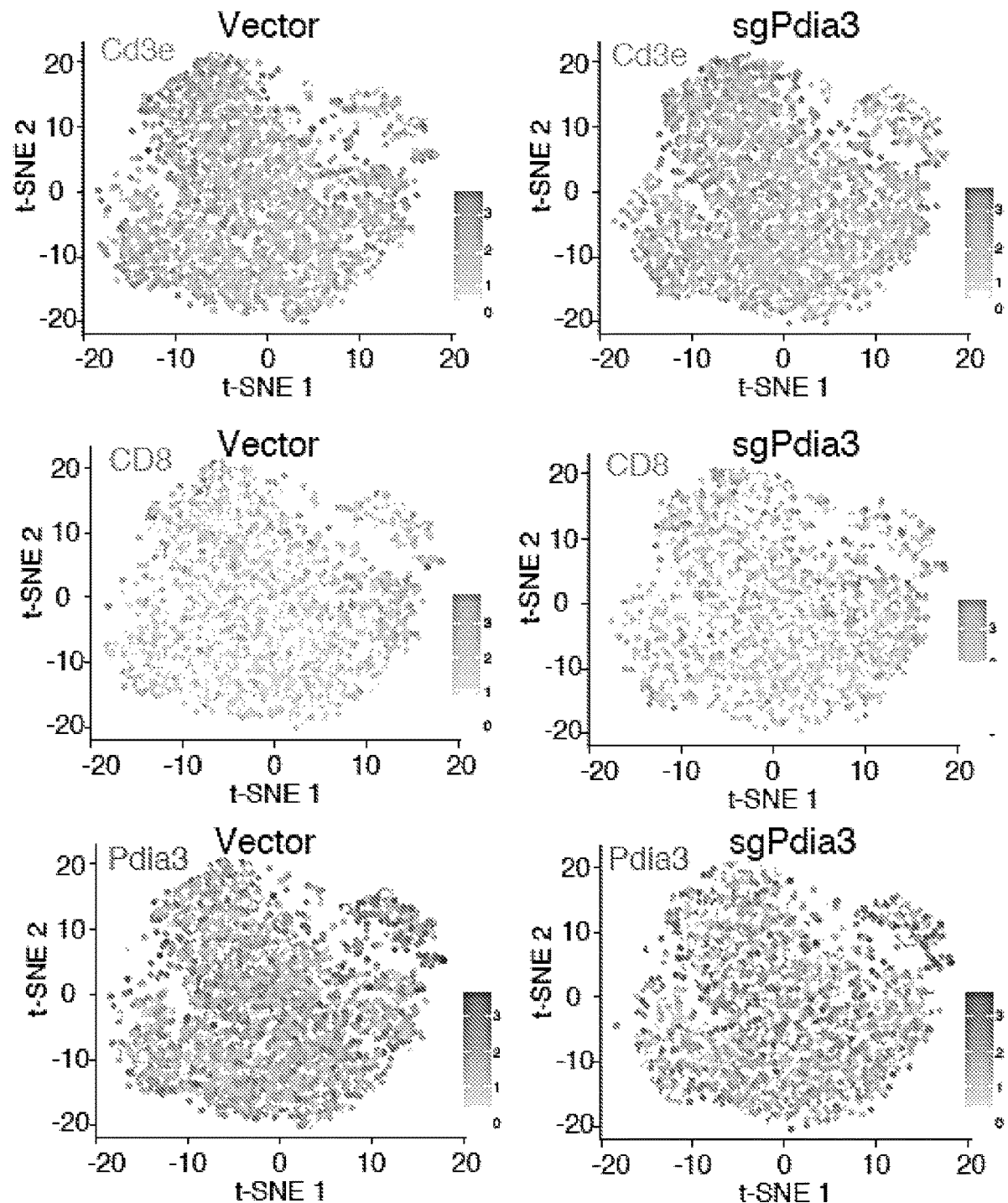
Figure 7D:
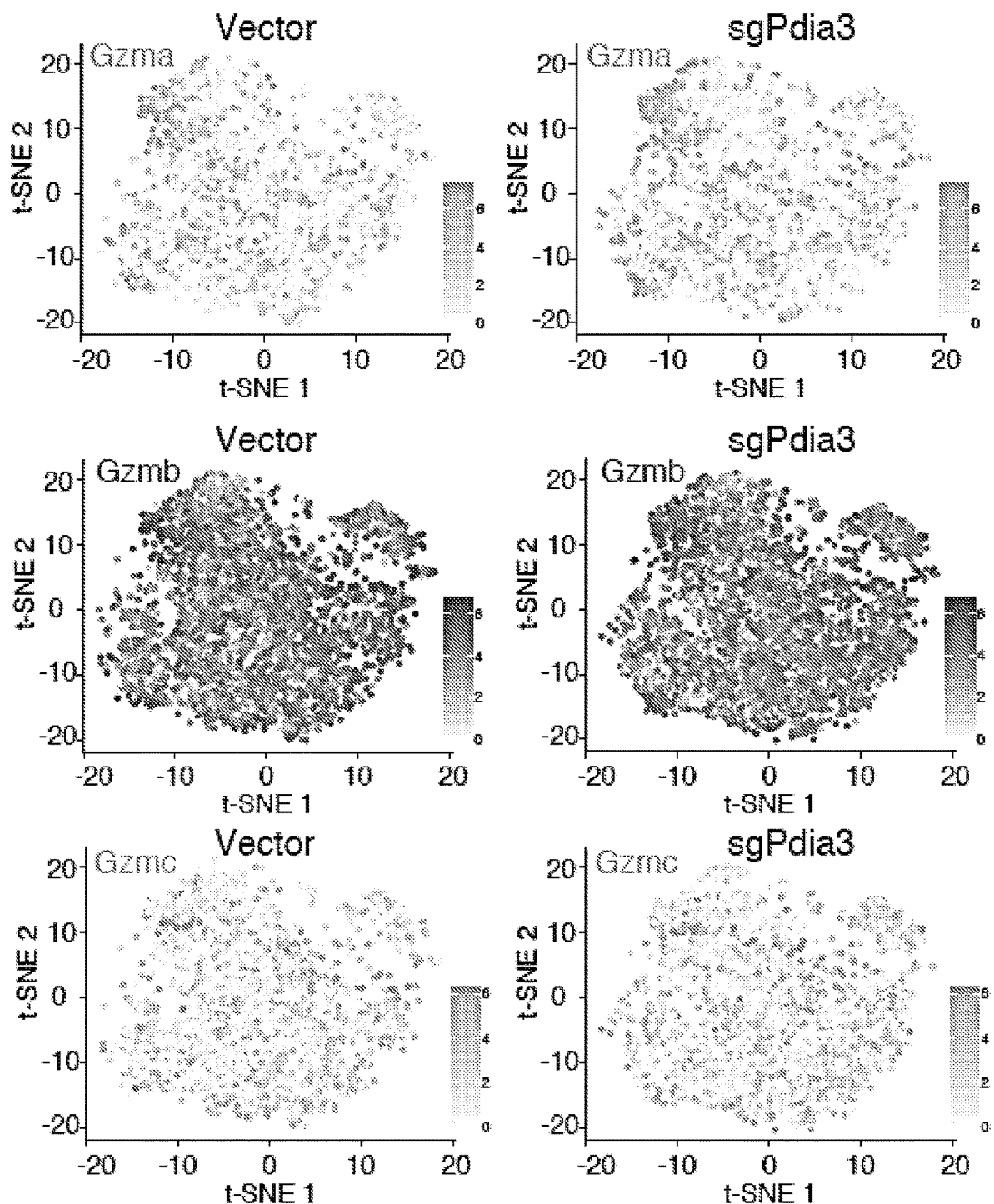
Figure 8A:
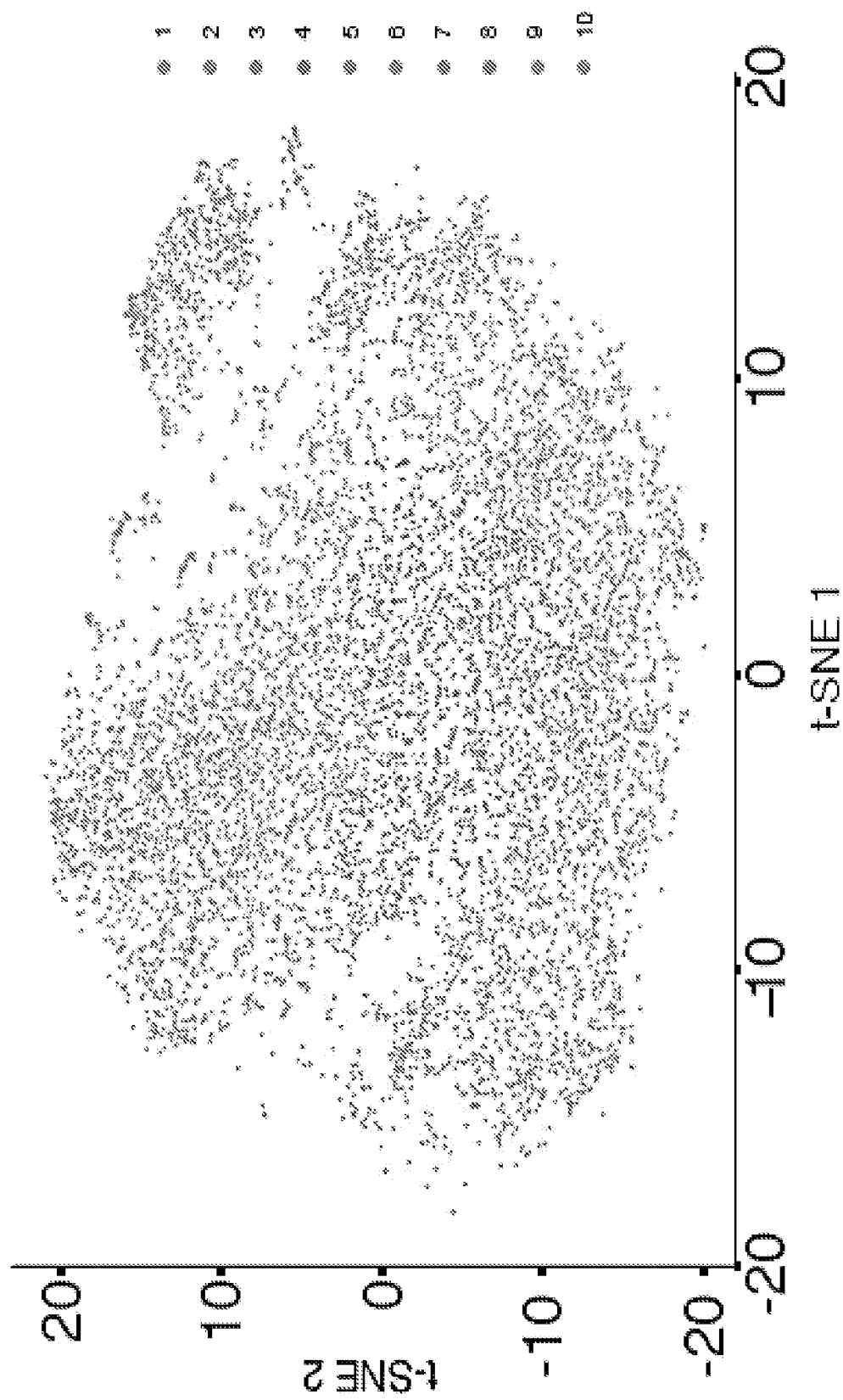
FIGS. 8A-8G describe scRNAseq analysis in Pdia3 knockout in CD8+ T cells.
Figure 8B:
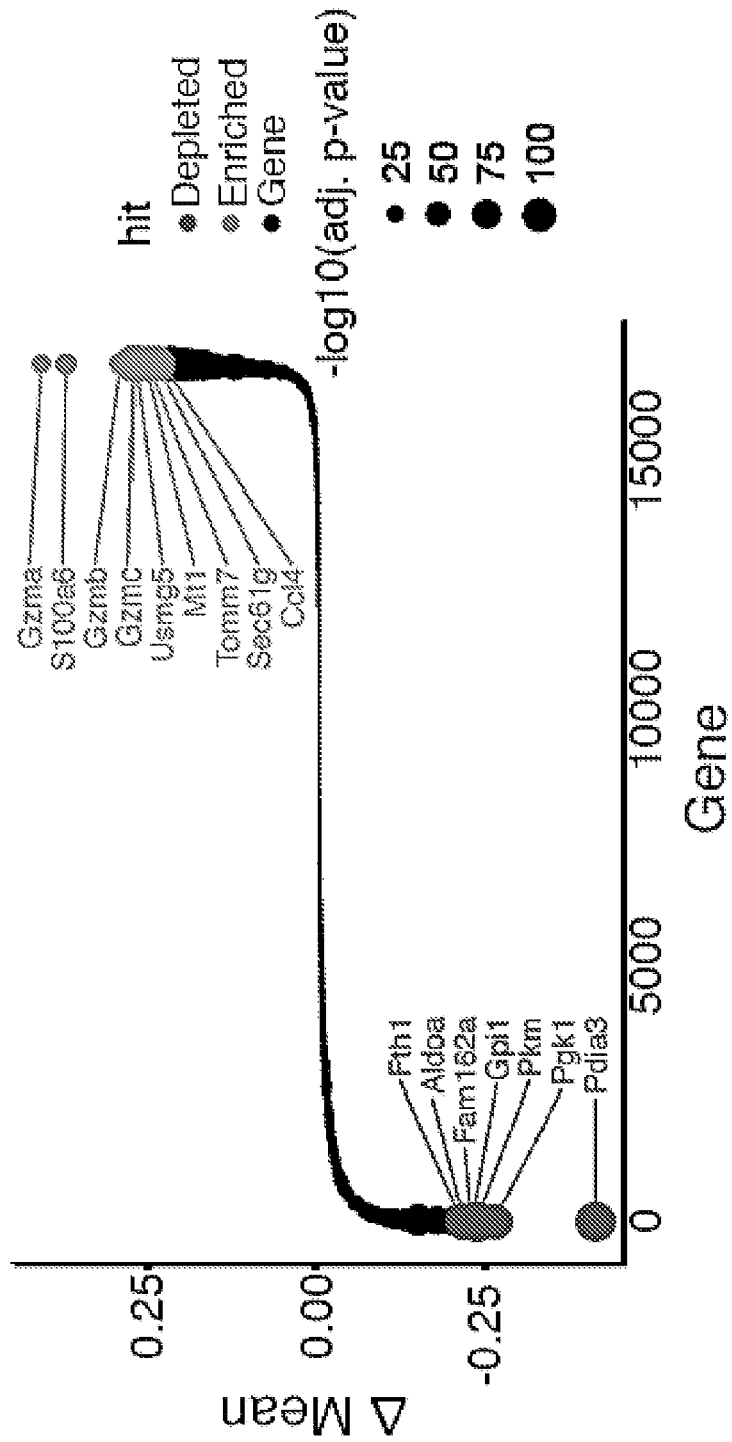
Figure 8C:
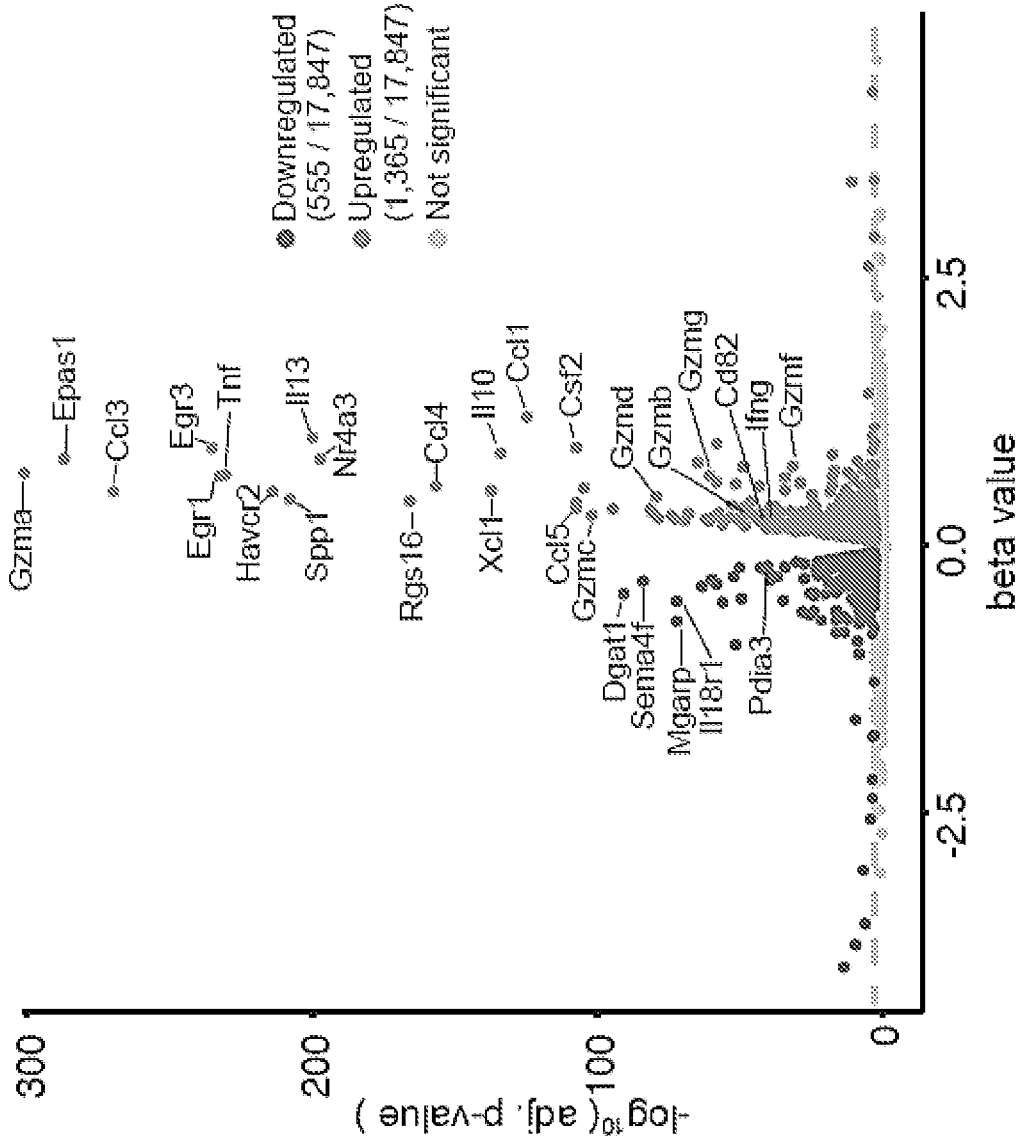
Figure 8D:
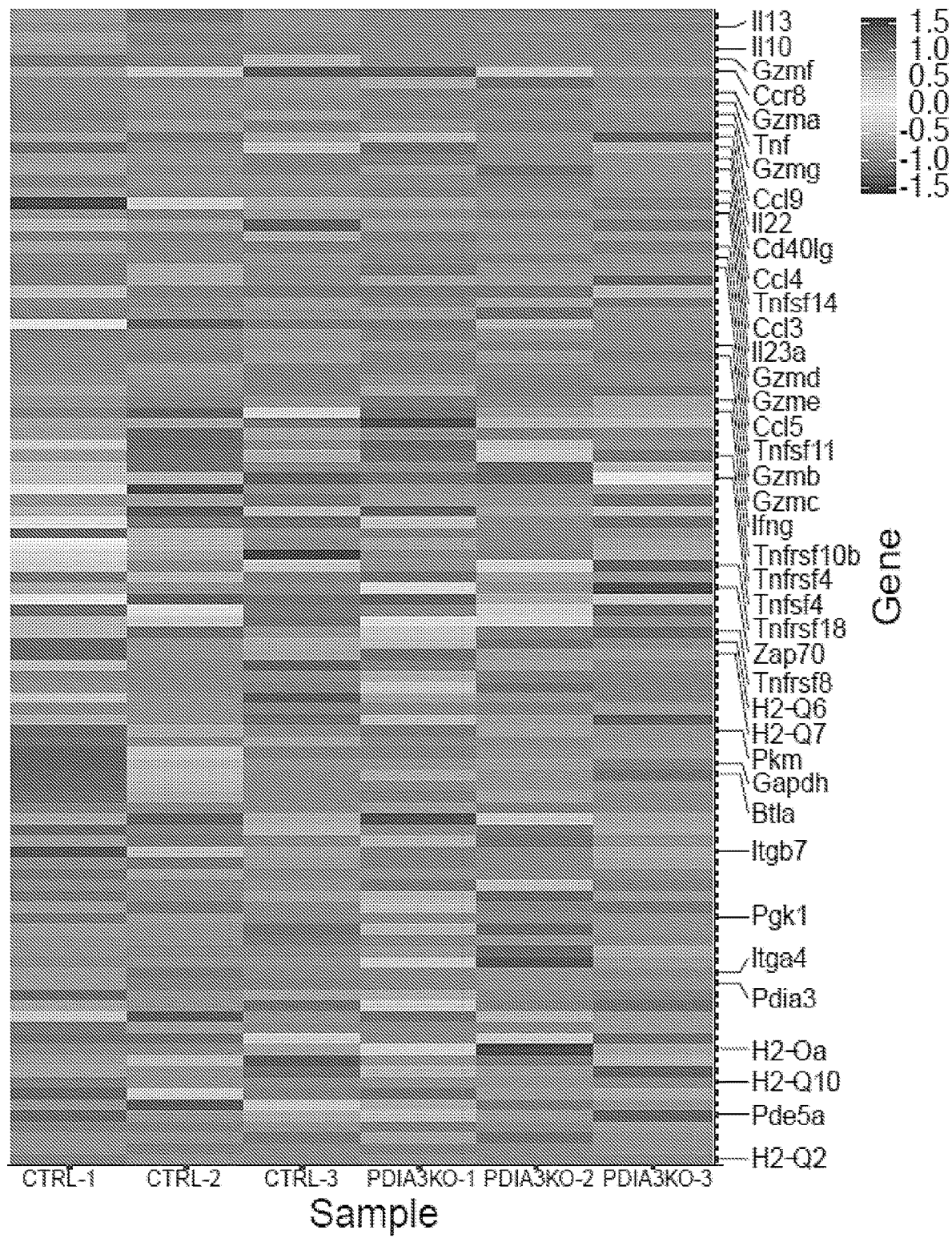
Figure 8E:
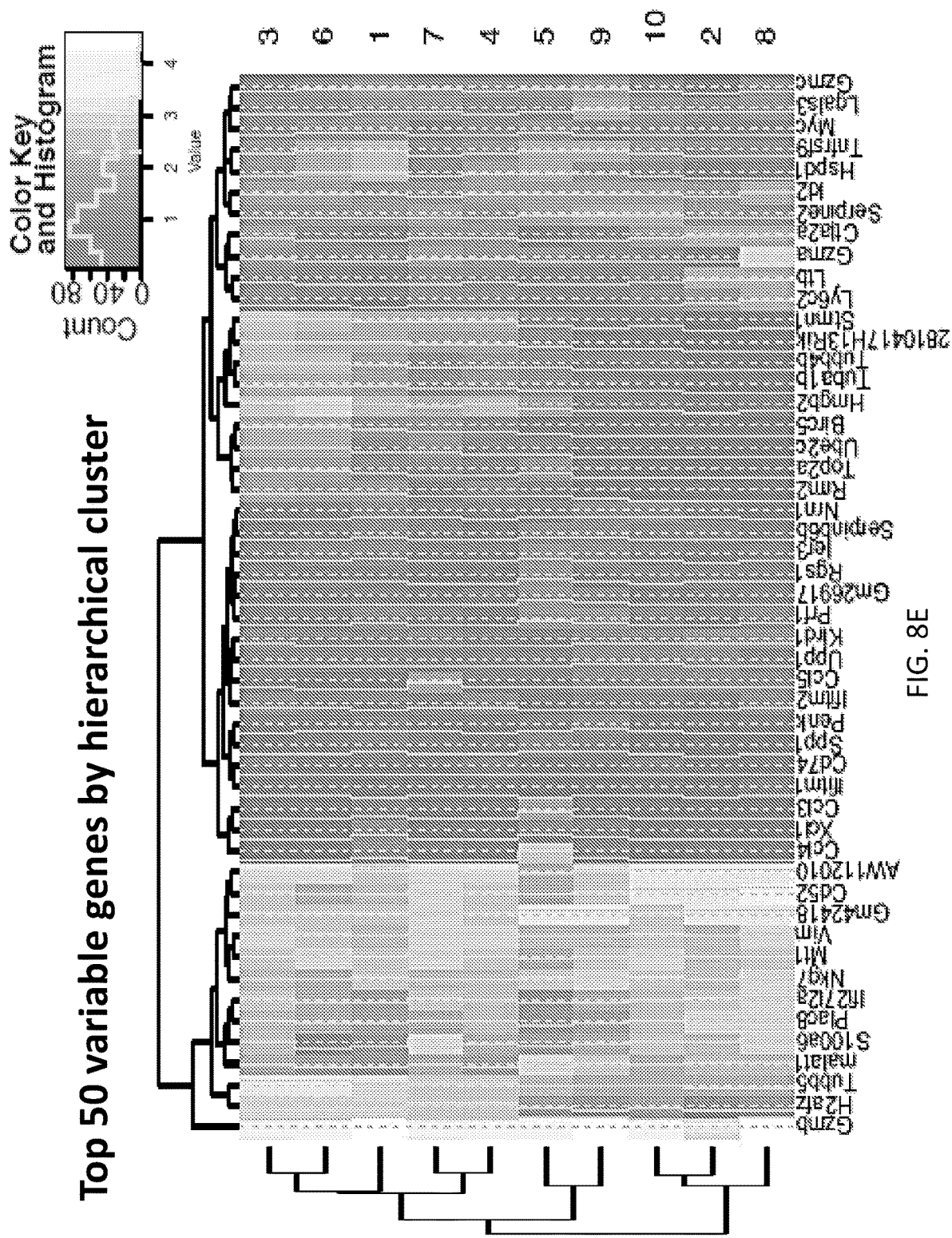
Figure 9:
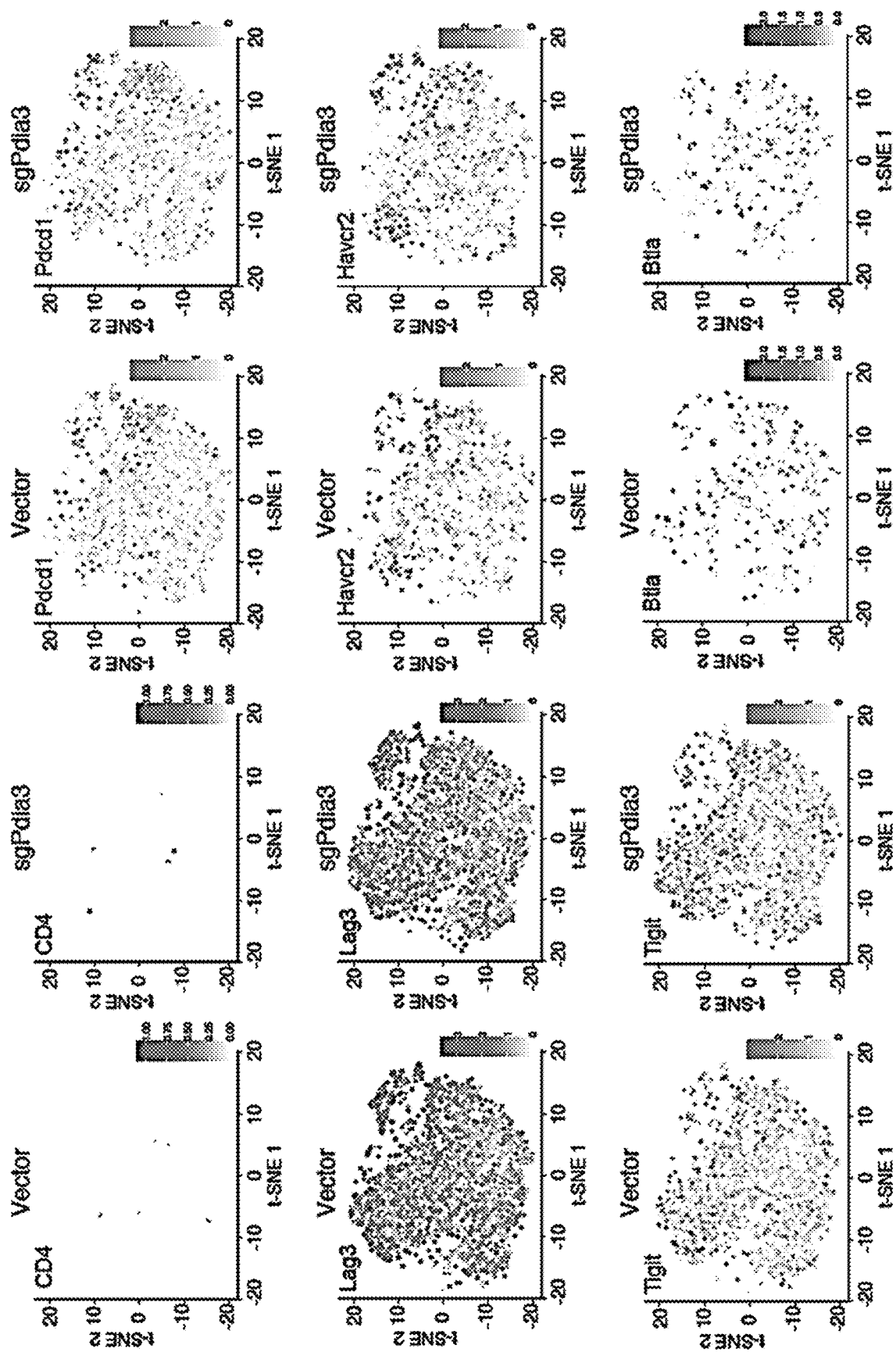
FIG. 9 shows a t-SNE plots of lineage, immune checkpoints, and effector markers of mouse CD8+ T cells from scRNA-seq data. t-SNE plots show multiple T-cell markers at the transcript level, including CD4 (negative control), PD-1, Lag3, Tim3 (Havcr2), Tigit, Btla, Ctla4, Icos, Ifng and Tnf, for both AAV-sgPdia3 and AAV-Vector treated single mouse CD8+ T cells.

Example 5: Effector Molecules Mediate the Enhanced Anti-Tumor Activity of the Pdia3 Mutant T Cells To provide a global map of gene expression level of AAV-sgPdia3 edited T cells, single cell RNA sequencing (scRNA-seq) was performed. The transcriptomes of 9,193 single cells were captured with a 10× Genomics platform, and Illumina-sequenced for AAV-sgPdia3 and AAV-Vector treated CD8 T cells (FIG. 7A). Data analysis of the transcriptomes of these single cells demonstrated that Pdia3 was dramatically and significantly downregulated (FIG. 7B-7C), indicating a clear on-target effect. General T cell lineage markers were not significantly different between Pdia3-edited and control T cells (FIG. 8A, FIG. 9). In addition, the expression of well-known immune checkpoints and co-stimulatory molecules was mapped, including Havcr2 (Tim3), PD-1, Lag3, Tigit, Btla and Icos (FIG. 9). Multiple effector cytokines were significantly upregulated after Pdia3 knockout. The top 5 upregulated genes were Granzyme a (Gzma), S100a6, Gzmb, Gzmc and Usmg5 (FIG. 7B-7D; FIG. 8B-8D), which implied that granzyme family overexpression may be one of the major effector functions that accounts for the Pdia3 mutant T cells' augmented ability to kill tumor cells.

Figure 8F:
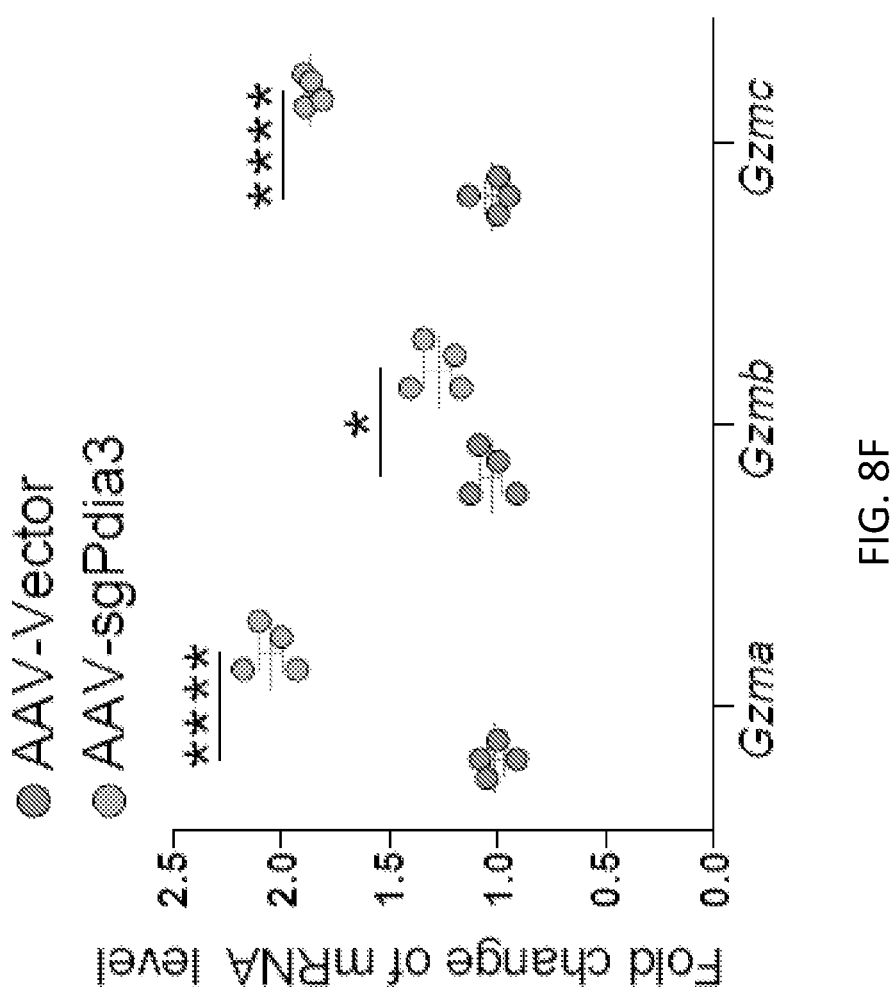
Figure 8G:
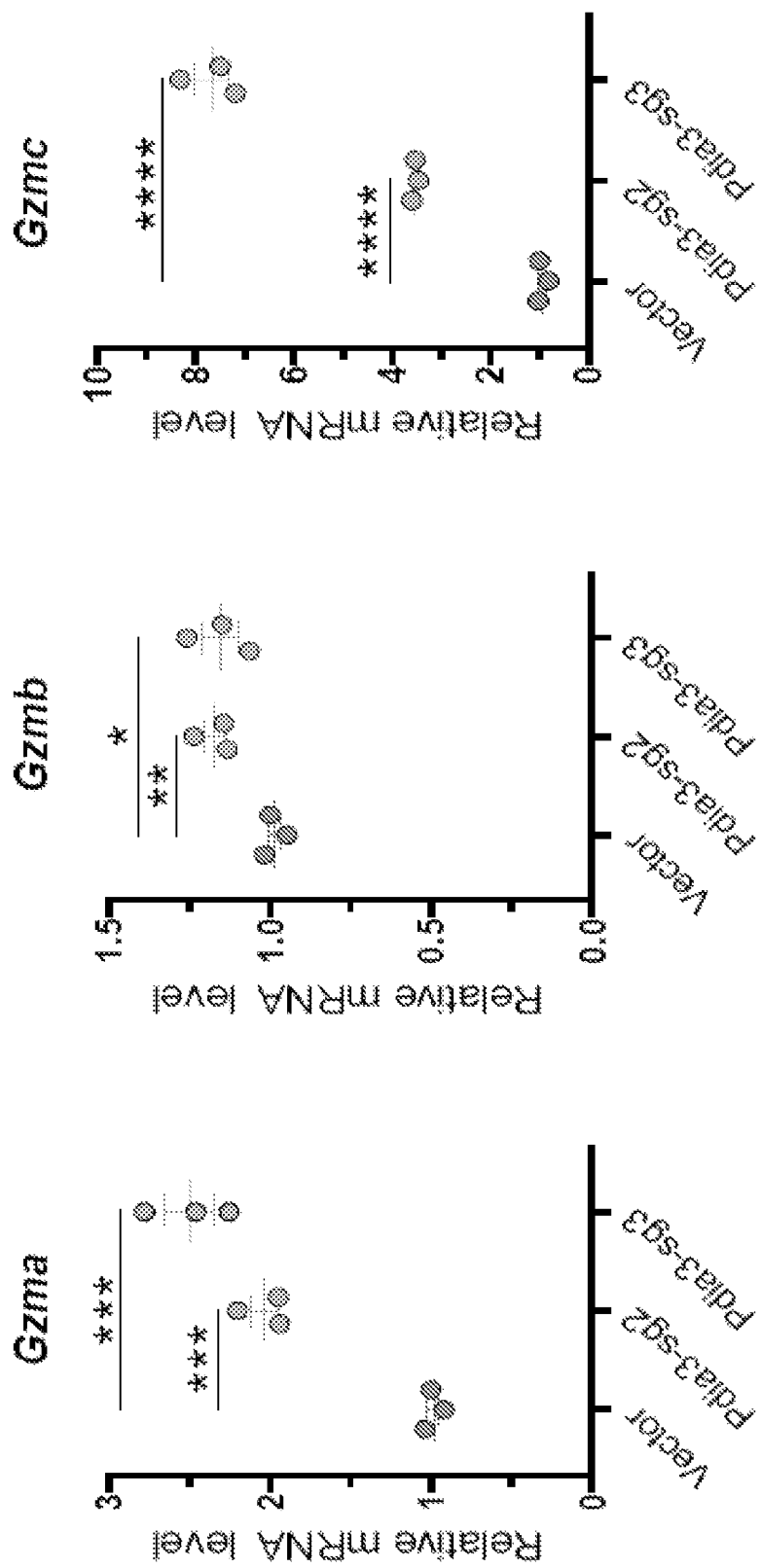
Figure 10A:
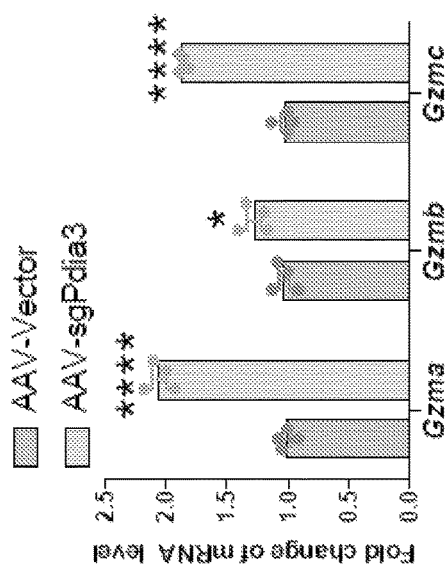
FIGS. 10A-10K show mechanistic analysis and pre-clinical efficacy testing of the anti-tumor activity of Pdia3 knockout CD8 T cells using independent tumor models.
Figure 10B:
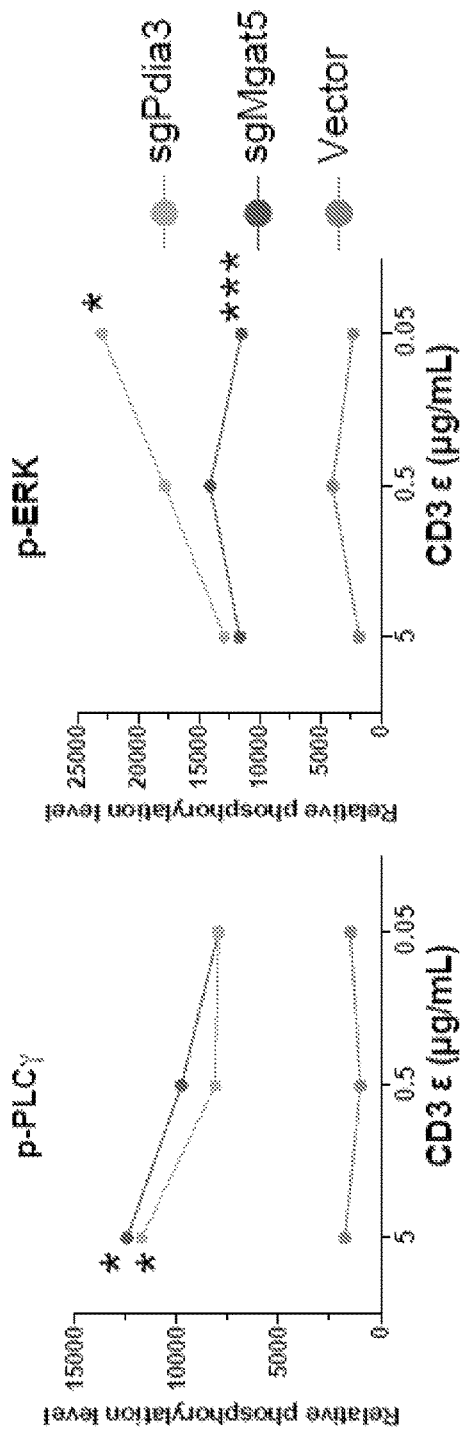
Figure 10C:
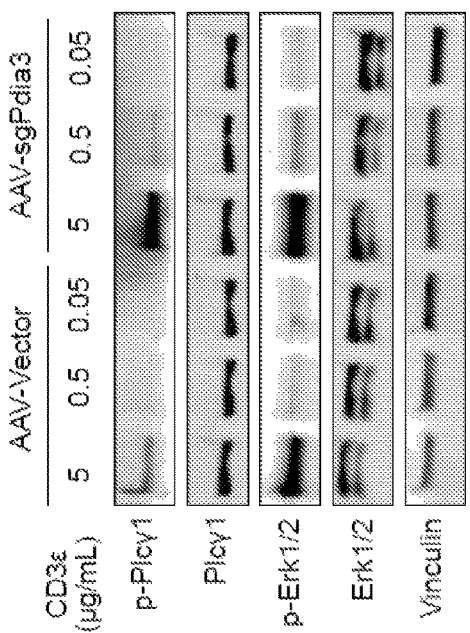
Figure 10D:
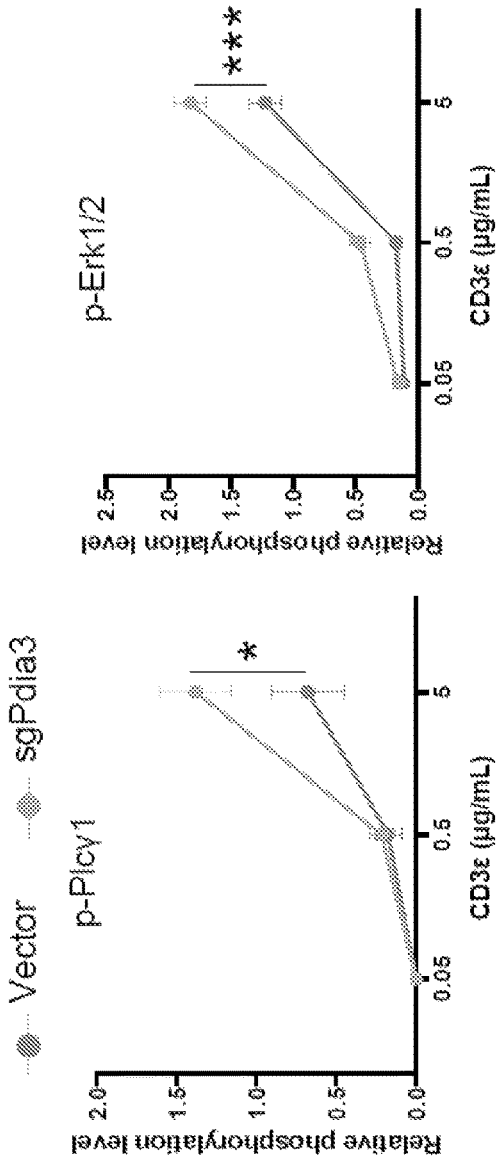
Figure 10E:
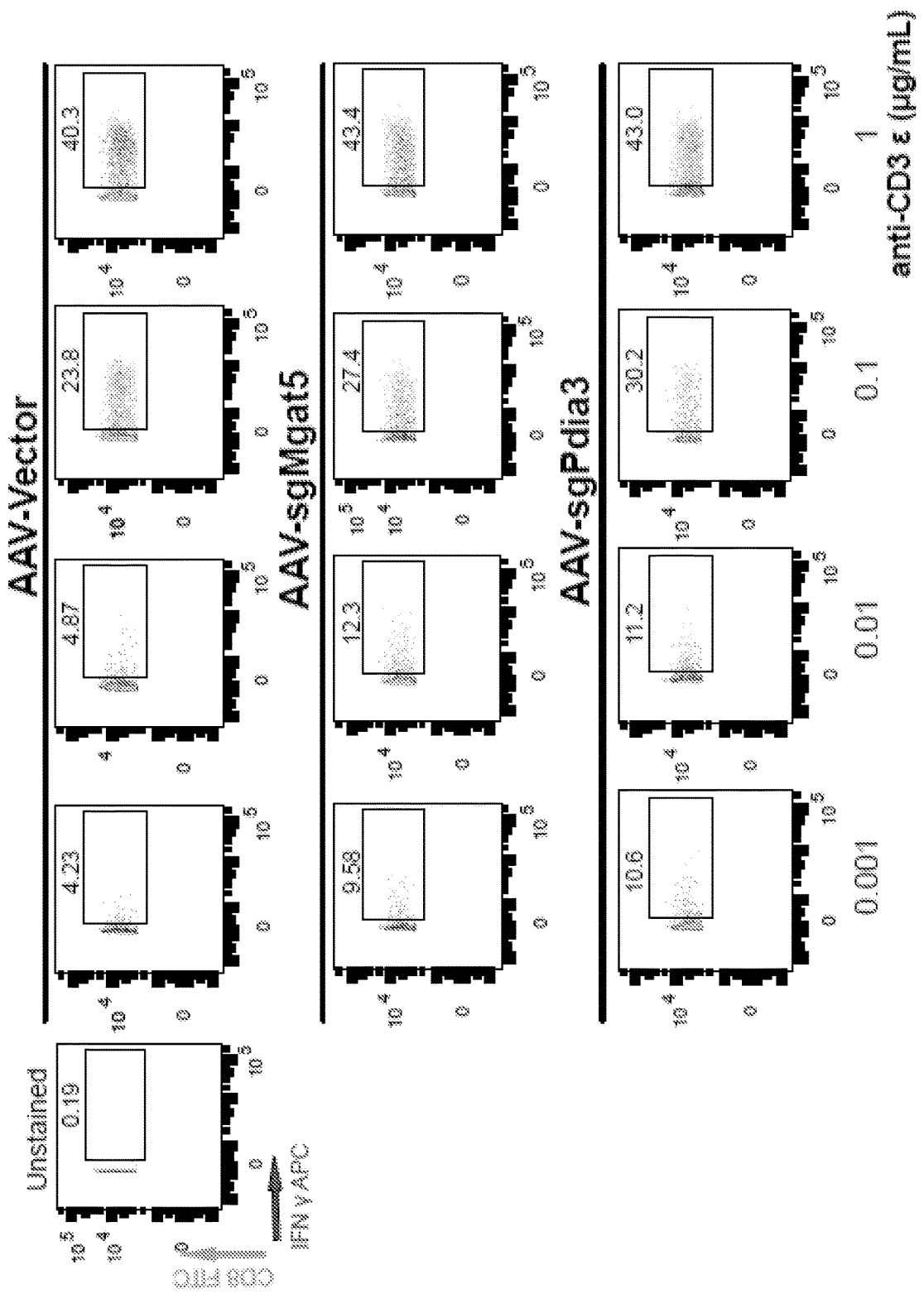
Figure 10G:
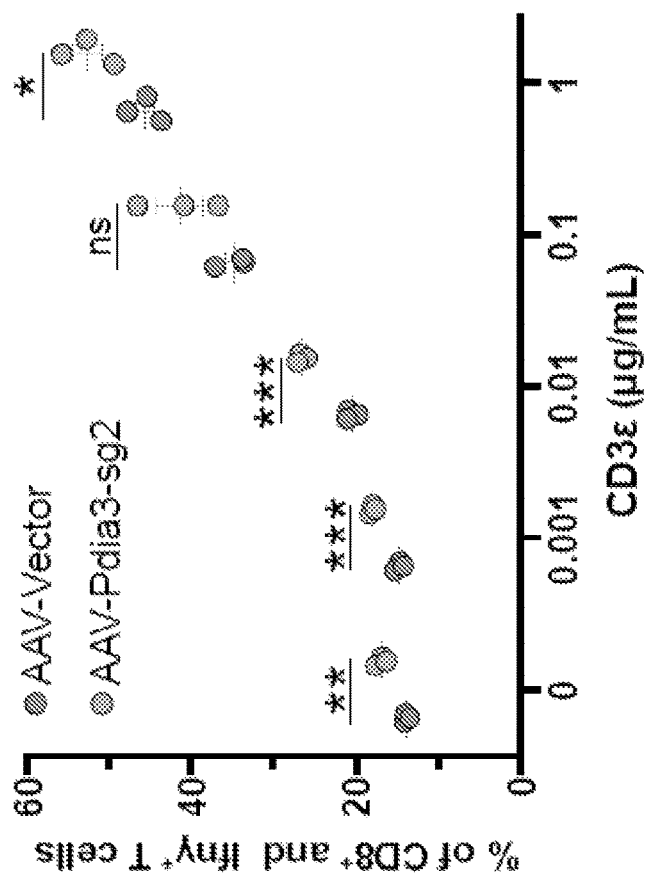
Figure 10F:
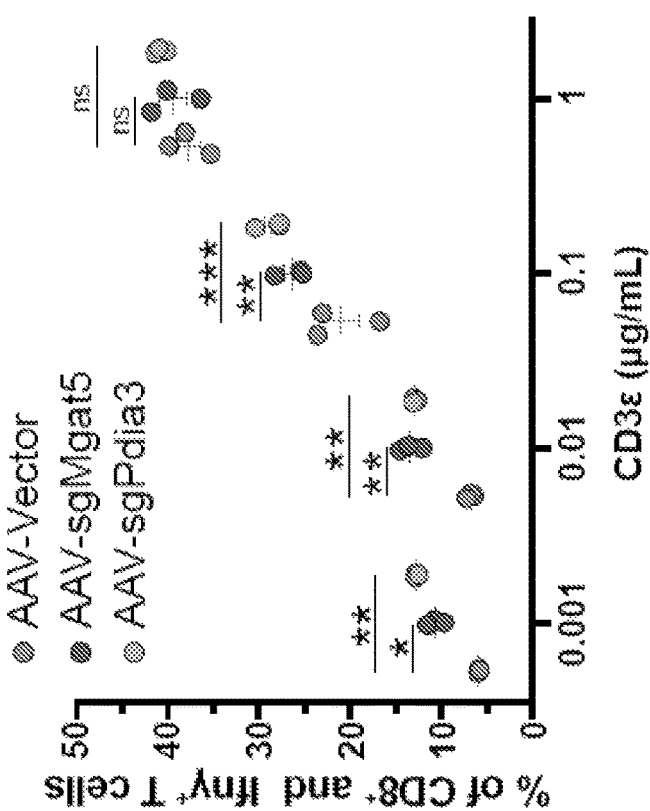

RT-qPCR was performed to validate the scRNA-seq result and confirm the upregulation of granzyme genes upon AAV-sgPdia3 perturbation (FIGS. 8F-8G; FIG. 10A) T cell signaling pathway was next investigated upon Pdia3 perturbation, alongside Mgat5. Quantification of immunoblot results showed that the phosphorylation of PLCγ and ERK1/2 was significantly upregulated across a dose-dependent anti-CD3ε stimulation (FIG. 10B). In concordance with the more sensitive TCR signaling pathway, intracellular flow cytometry experiment revealed that IFNγ production was upregulated in AAV-sgPdia3 infected CD8 T cells, which secreted more IFNγ with low anti-CD3ε stimulation (FIG. 10C-10D). Collectively, these data support a model in which the inhibition of Pdia3 upregulated granzyme gene expression, as well as a more sensitive induction threshold for TCR signaling and IFNγ production.

Example 6: Editing of Pdia3 in CD8 T Cells in Pre-Clinical Tumor Models

Figure 10H:
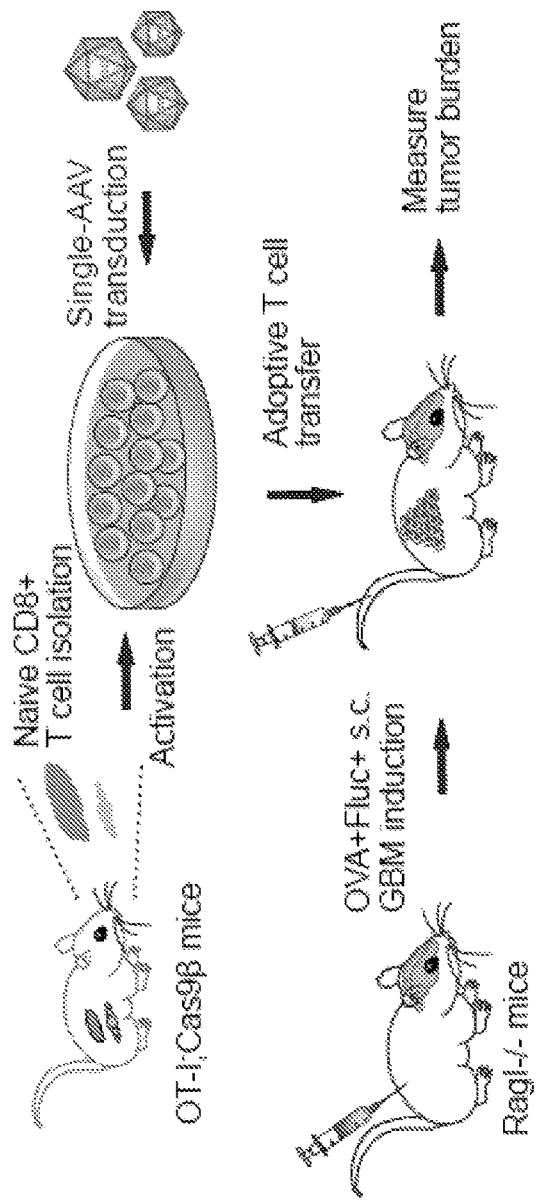
Figure 10I:
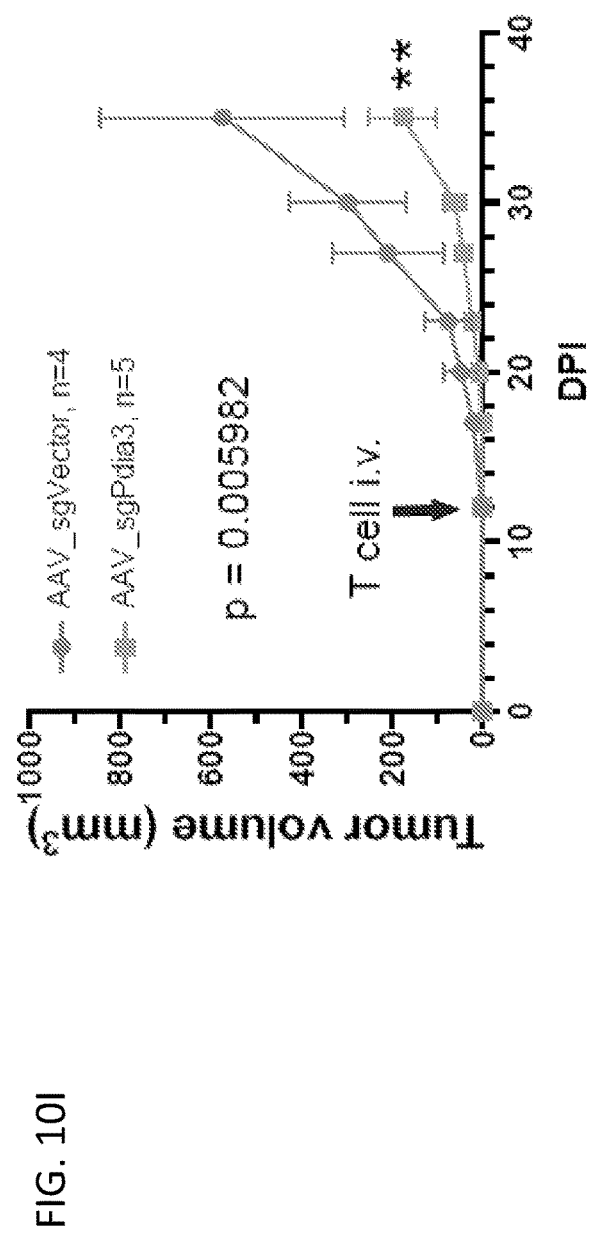
Figure 10J:
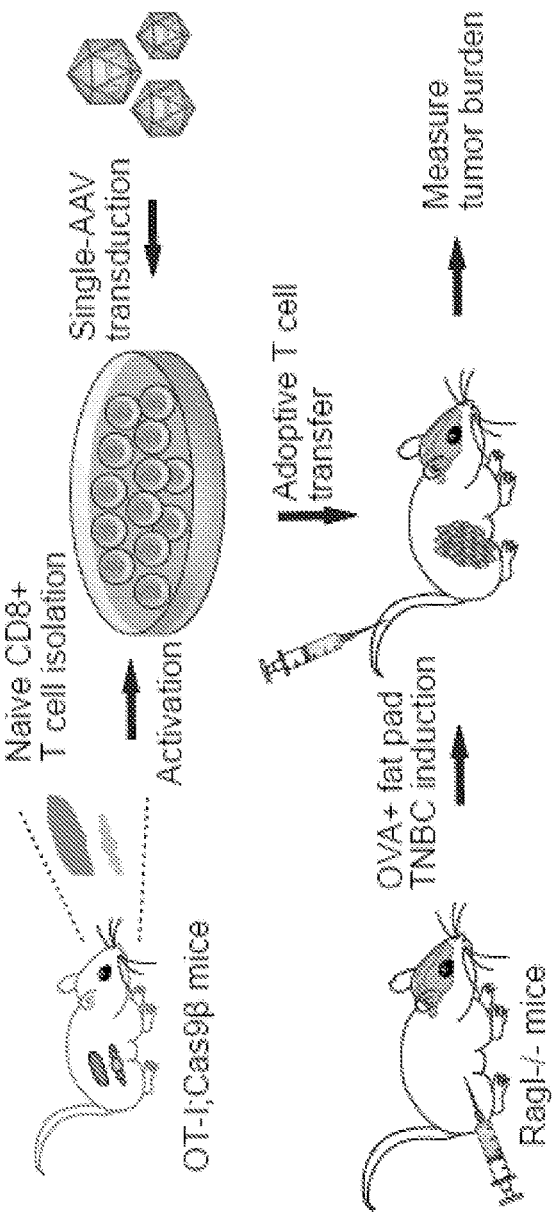
Figure 10K:
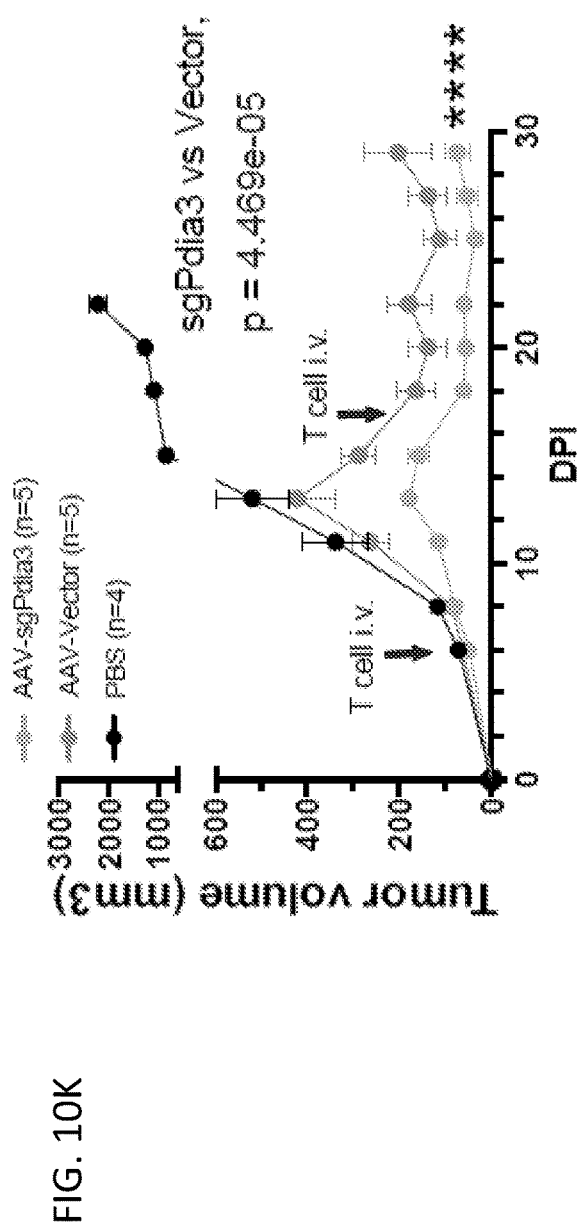

Without wishing to be bound by theory, because granzymes and IFNγ are T cell intrinsic properties, based on the results of Pdia3 edited CD8+ T cells, it is believed that Pdia3 editing could also have anti-tumor effect in other tumor models. To test if genetically editing PDia3 would result in anti-tumor effector function, two models of syngeneic tumor immunotherapy were tested. In the first experiment, GL261 tumors were induced with subcutaneous injection. Pdia3 mutant CD8+ T cells were adoptively transferred via intravenous injection in GL261-tumor bearing mice (FIG. 10H). Knocking out Pdia3 using AAV-sgPdia3 in CD8+ T cells significantly reduced overall tumor volume (FIG. 10I). In the second experiment, we used another cancer cell line, E077, to induce syngeneic orthotopic triple-negative breast cancer (TNBC) via mammary fat pad injection (FIG. 10J). Tumor-bearing mice were again injected with Pdia3 mutant CD8+ T cells by adoptive transfer (FIG. 10J). Compared to vector alone, mice that received Pdia3 mutant CD8+ T cells had significantly lower tumor burden (FIG. 10K). Together, without wishing to be bound by theory, these data suggest that the enhanced anti-tumor activity of Pdia3 perturbation encompasses, at least in part, T cell intrinsic phenotypes.

Example 7: Phenotypic Analysis of Pdia3 Knockout Human CD8 T Cells

Figure 11A:
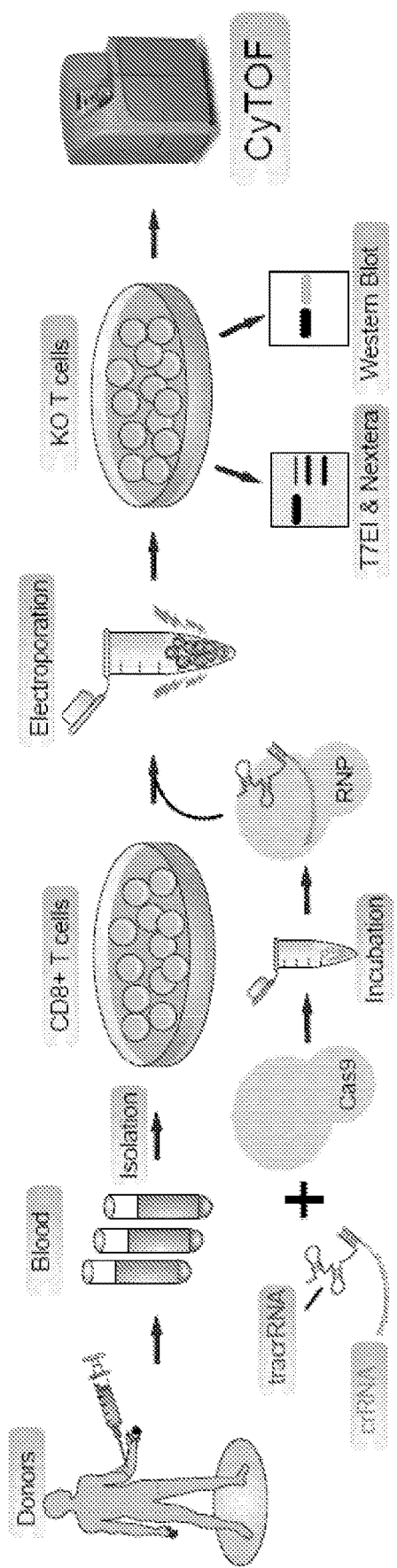
Figure 11E:
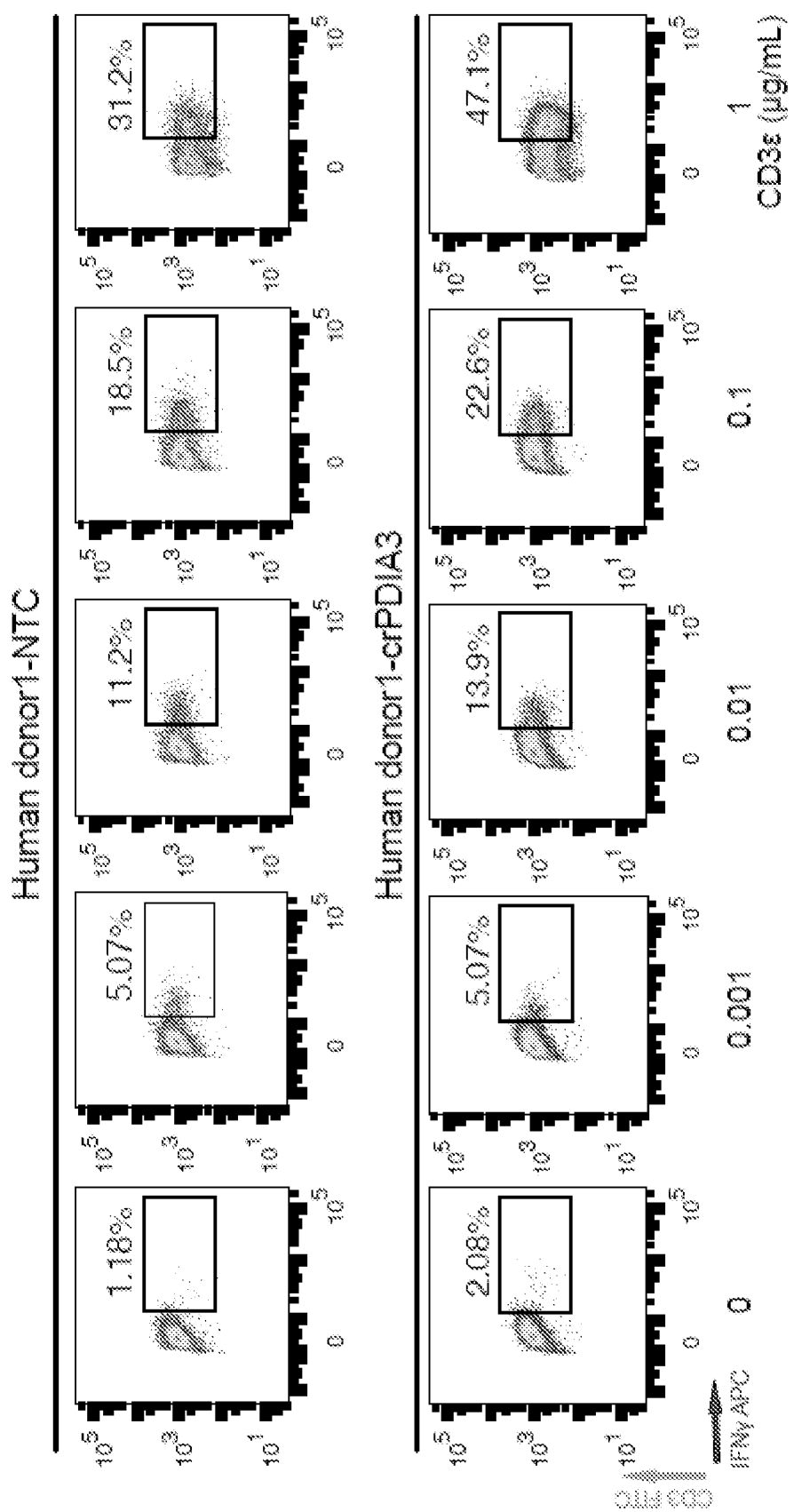
Figure 11G:
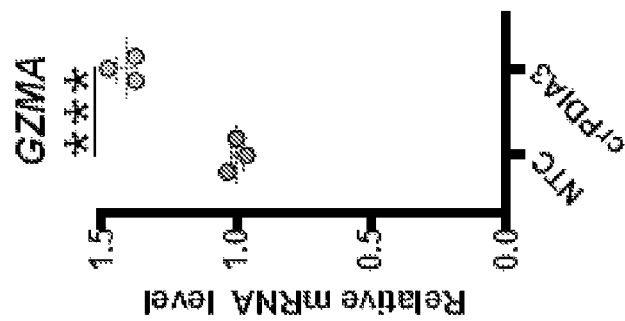
Figure 11F:
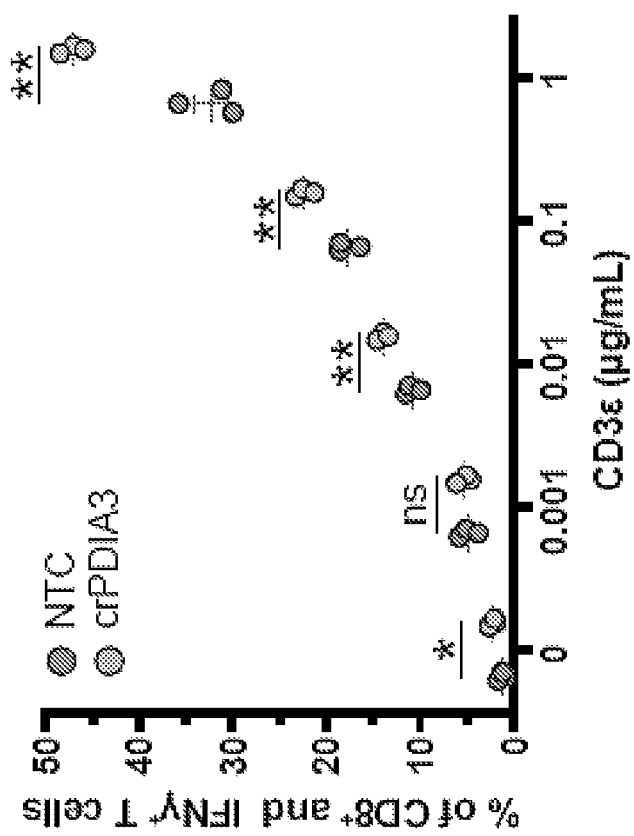
Figures 11H, 11I:
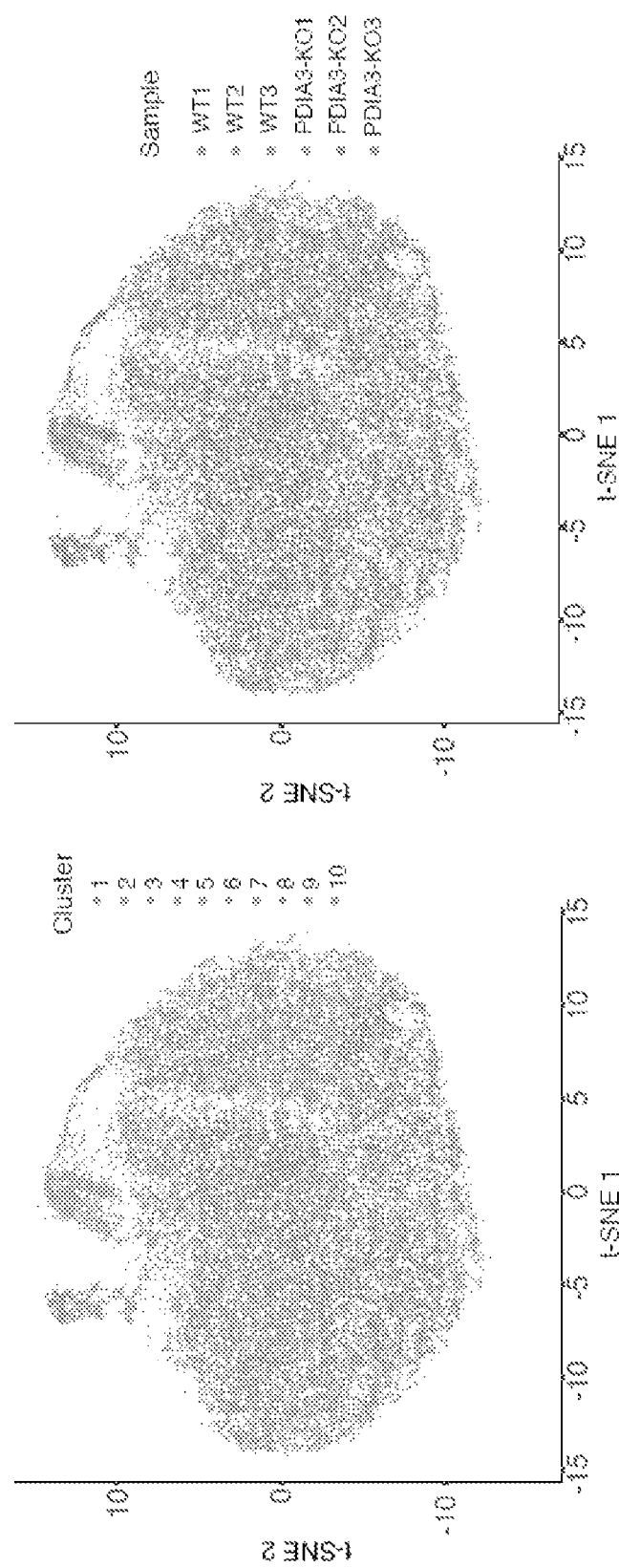
Figure 11J:
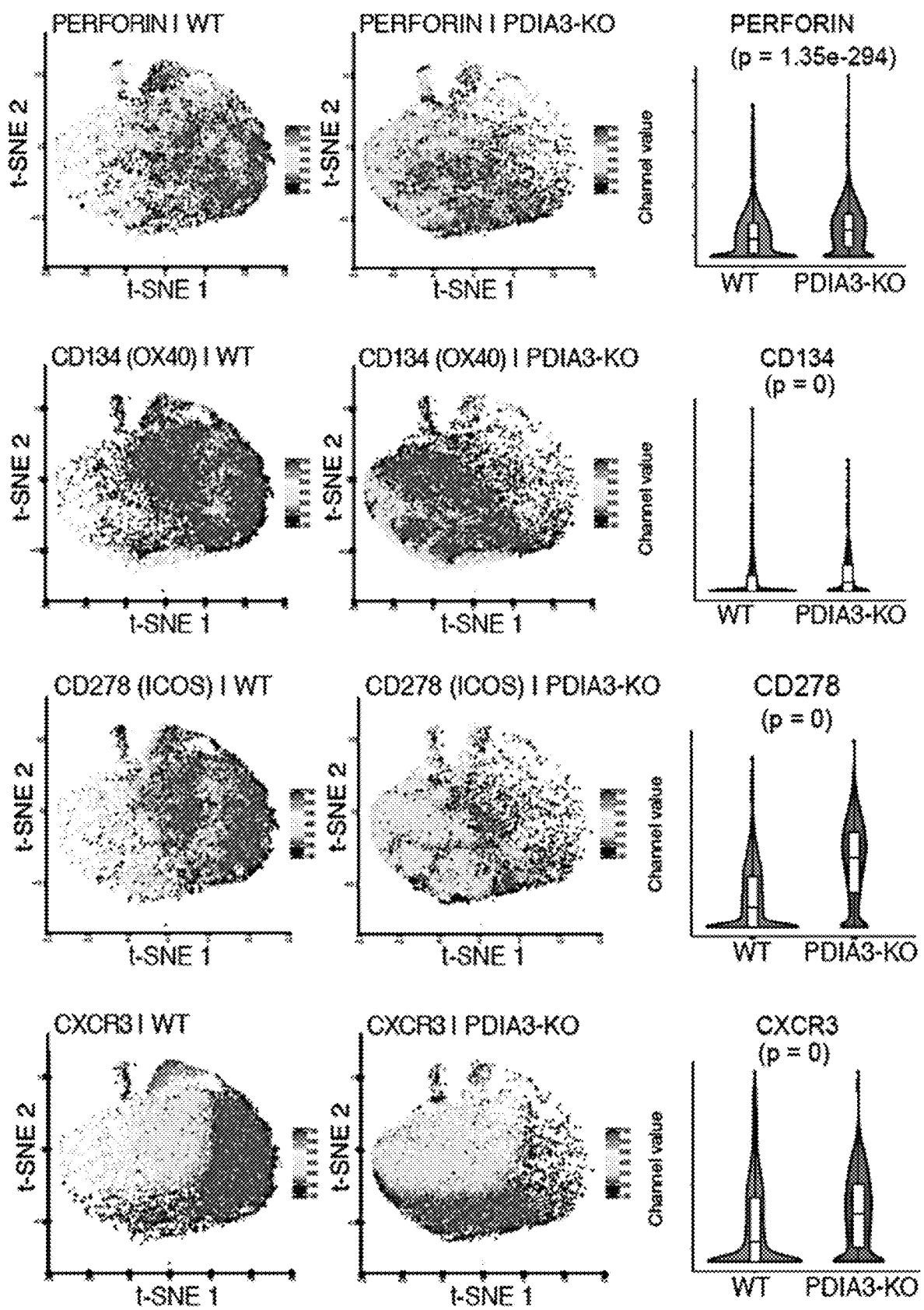
Figure 12:
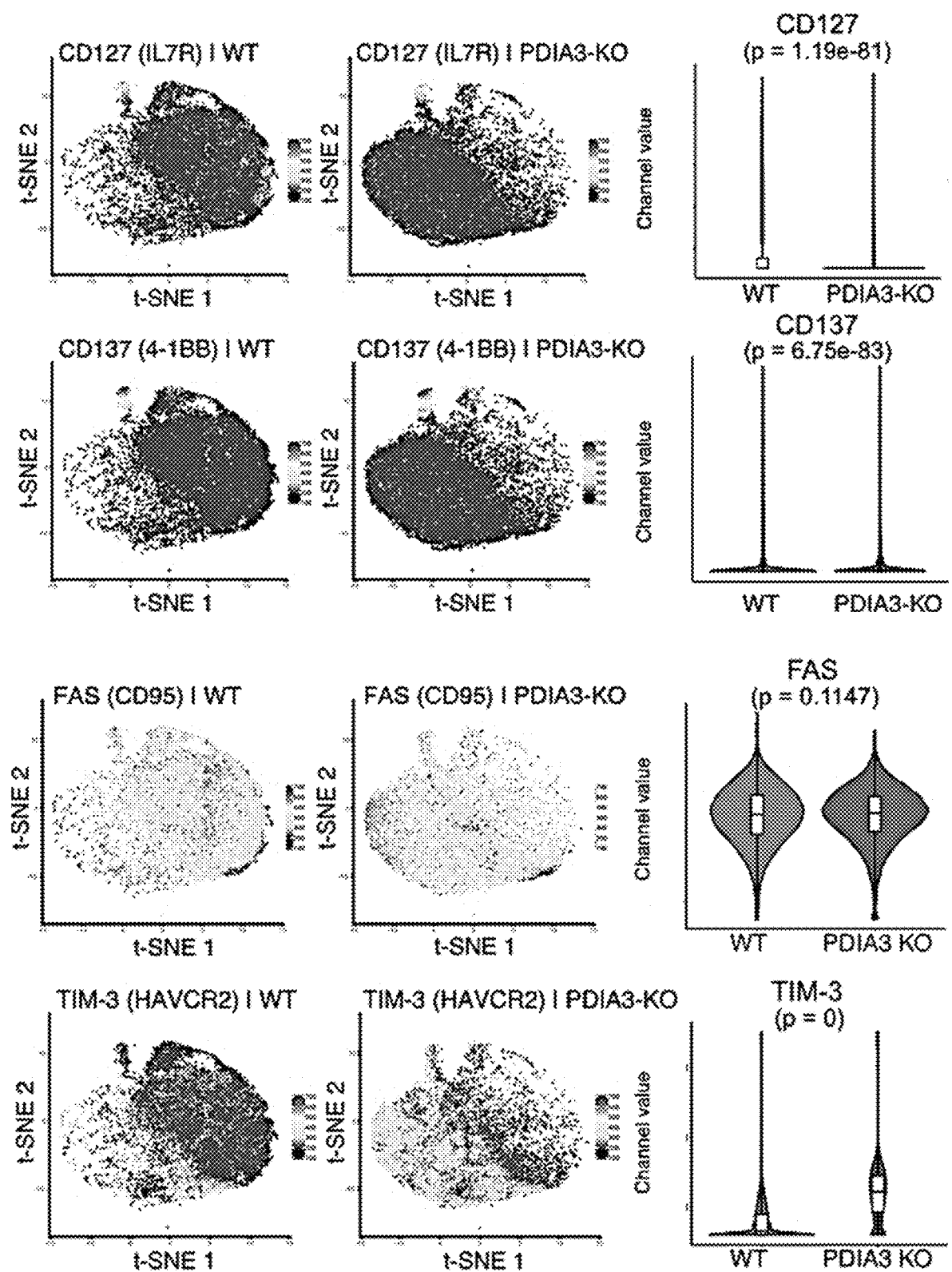
FIG. 12 shows immune checkpoint CyTOF analysis of PDIA3 KO human CD8 T cells. t-SNE and violin plots of CyTOF data of CD127/IL7R, FAS/CD95, 4-1BB/CD137 and TIM-3/HAVCR2 at the surface protein level, for both PDIA3 KO and wildtype single human CD8$^+$ T cells (n=3 replicates each, sampled 7,000 cells per replicate for comparison). Violins show kernel probability density on side, and boxplot is standard, i.e. middle band is median, hinges/ends of box are interquartile range (25% and 75% quantiles), lower whisker=smallest observation greater than or equal to lower hinge-1.5*IQR, upper whisker=largest observation less than or equal to upper hinge+1.5*IQR. Wilcoxon test, two-sided, p value adjusted by Benjamini & Hochberg method. KO vs WT: p=1.91e-81 for CD127/IL7R, p=0.1147 for FAS/CD95, p=6.75e-83 for 4-1BB/CD137, and p=0 for TIM-3/HAVCR2.
Figure 14:
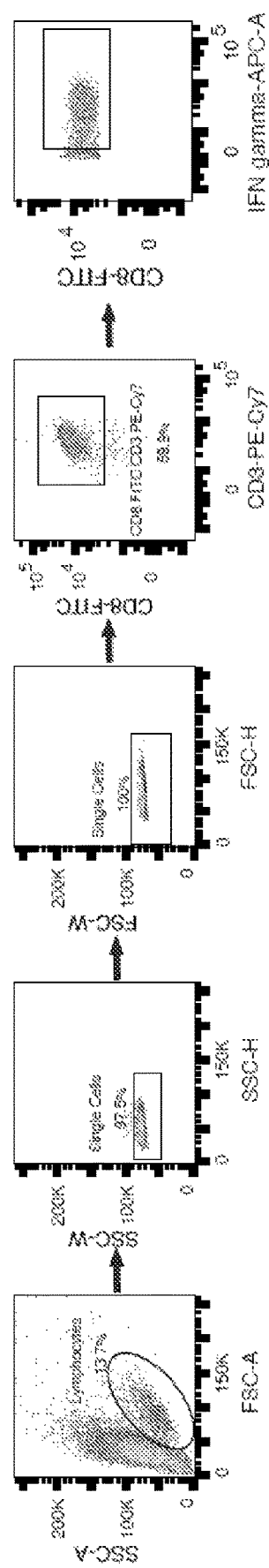
FIG. 14 shows the gating strategy for analyzing CD8 T cells expressing IFNγ.

To investigate the immunological phenotypes of Pdia3 in human CD8+ T cells, the Pdia3 locus in human CD8+ T cells was perturbed using the ribonucleoprotein (RNP) system (FIG. 11A). Analysis of DNA and protein levels demonstrated that the PDIA3 knockout was near-complete (>90% knockout) (FIGS. 11B-11D). Anti-CD3 dose-dependent analysis of IFNγ production was performed and found that PDIA3 edited CD8+ T cells had significantly higher IFNγ (FIGS. 11E-11G, gating strategy illustrated in FIG. 14). RT-qPCR analysis of human GZMA also showed upregulation upon PDIA3 loss (FIG. 11G). CyTOF analysis yielded high-dimensional landscapes of immune checkpoint and other functional molecules in PDIA3 knockout and wildtype human CD8+ T cells from 227,848 single CD8+ T cells (FIGS. 11H-11I). Clustering analysis showed that the PDIA3-KO replicates clustered together and are distinct from the wildtype replicates (FIGS. 11H-11I). The t-SNE plots, either by sample or by clusters, showed that the effector molecule perforin as well as the co-stimulatory markers, OX40 and ICOS, as well as CXCR3, were significantly upregulated in PDIA3 knockouts compared to wildtype CD8 T cells (FIG. 11J). 4-1BB/CD137 and IL7R/CD127 were moderately altered, but not Fas/CD95 (FIG. 12). Uniquely, TIM3 was significantly upregulated in PDIA3 knockout, consistent with mRNA-seq data. Together, these data showed PDIA3 CRISPR editing influenced the surface expression of multiple of immune regulators and effectors in human CD8 T cells.

Figure 13A:
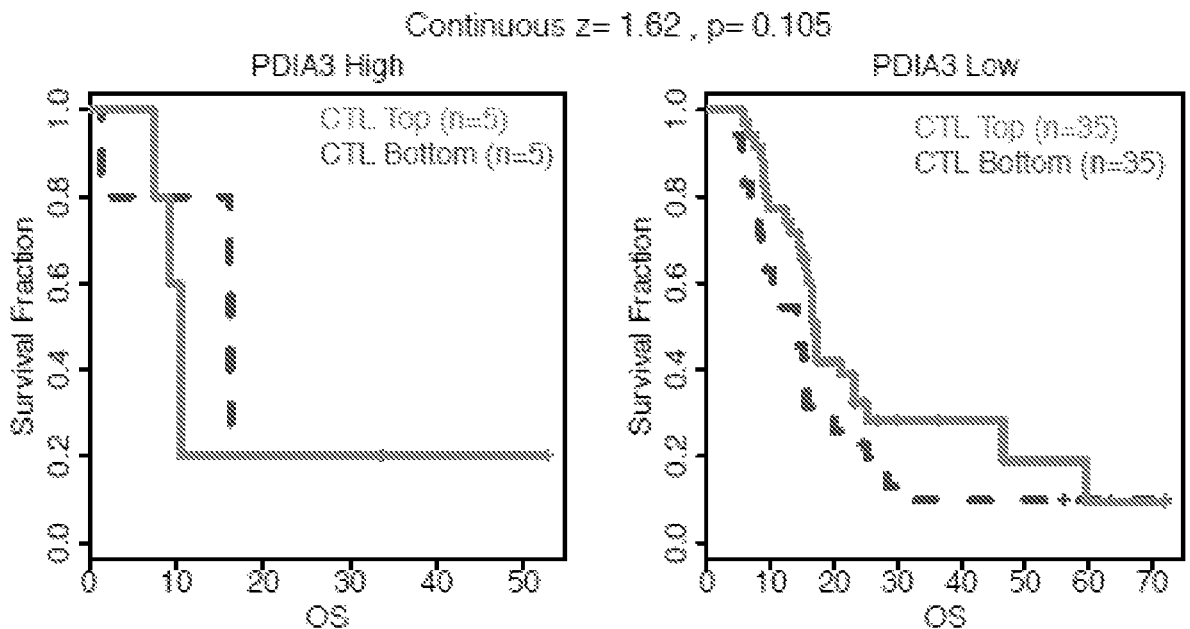
FIGS. 13A-13D describe TIDE analysis of human patient data.
Figure 13B:
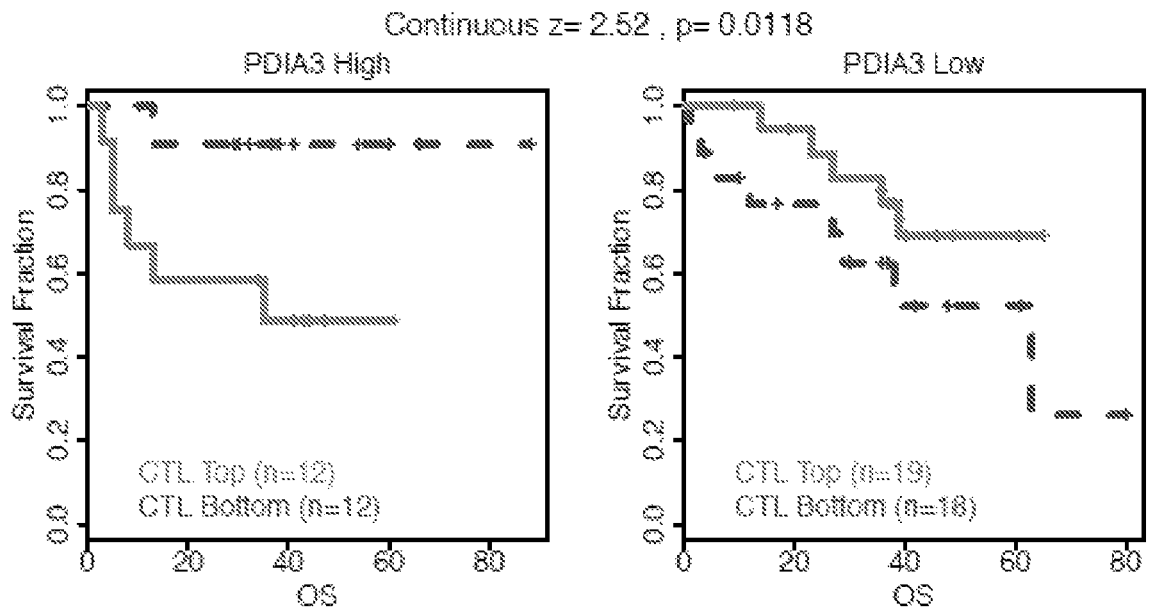
Figures 13C, 13D:
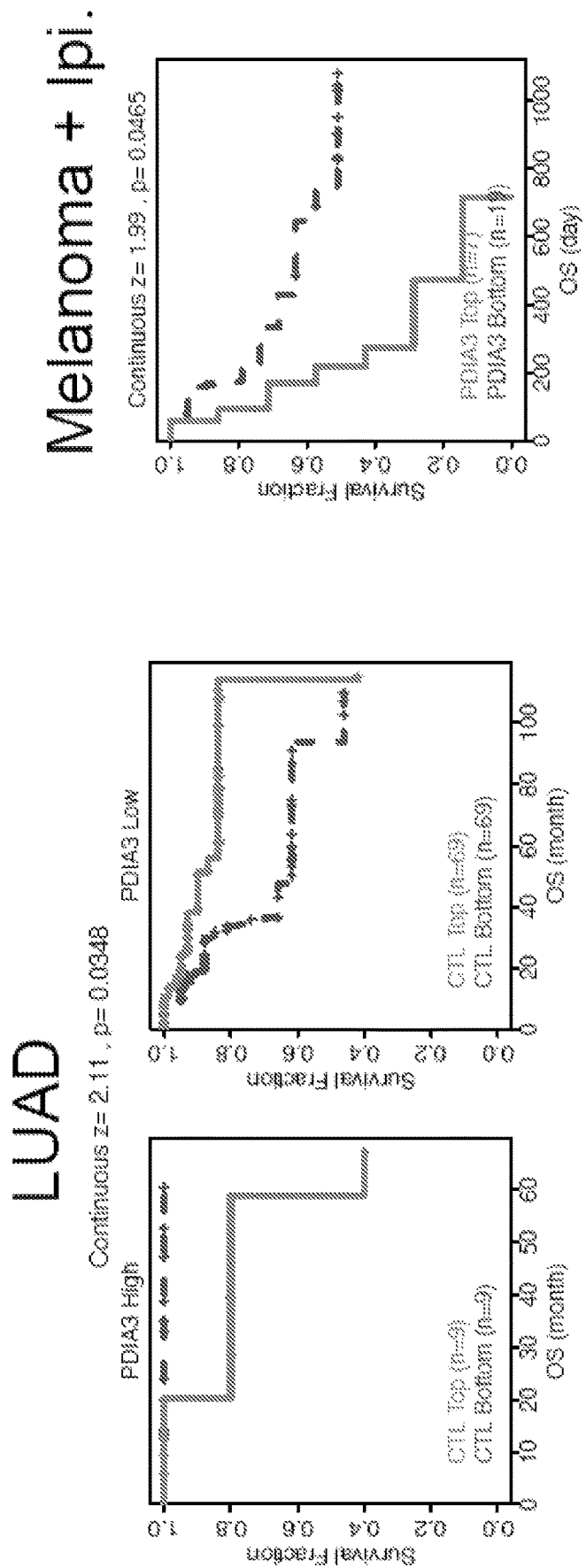

To investigate whether PDIA3 expression was clinically relevant, large-scale patient data analysis using the recently developed Tumor Immune Dysfunction and Exclusion (TIDE) algorithm (Jiang, P. et al. (2018) *Nat Med* 24:1550) was performed. High-levels of PDIA3 abolished or weakened the overall survival of CTL-high patients (FIGS. 13A-13D). Additionally, PDIA3$^{lo}$ patient groups were associated with greater overall survival across multiple cancer types including GBM, TNBC and lung adenocarcinoma (FIGS. 13A-13C). Moreover, in melanoma patients treated with immune checkpoint blockade, PDIA3$^{hi}$ patients had significantly poorer survival than PDIA3$^{lo}$ (FIG. 13D). These data suggest a significant clinical association of PDIA3 with human cancer.

Figure 16A:
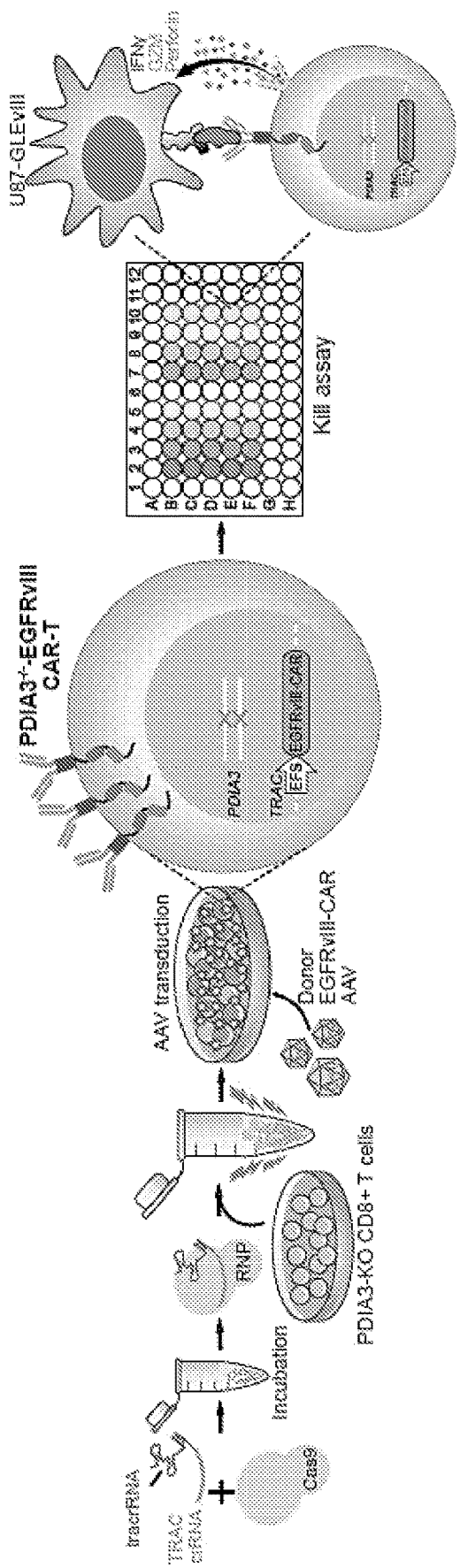
FIGS. 16A-16D show Human PDIA3$^-$-EGFRvIII CAR-T cell establishment and GBM cell killing.
Figures 16B, 16C, 16D:
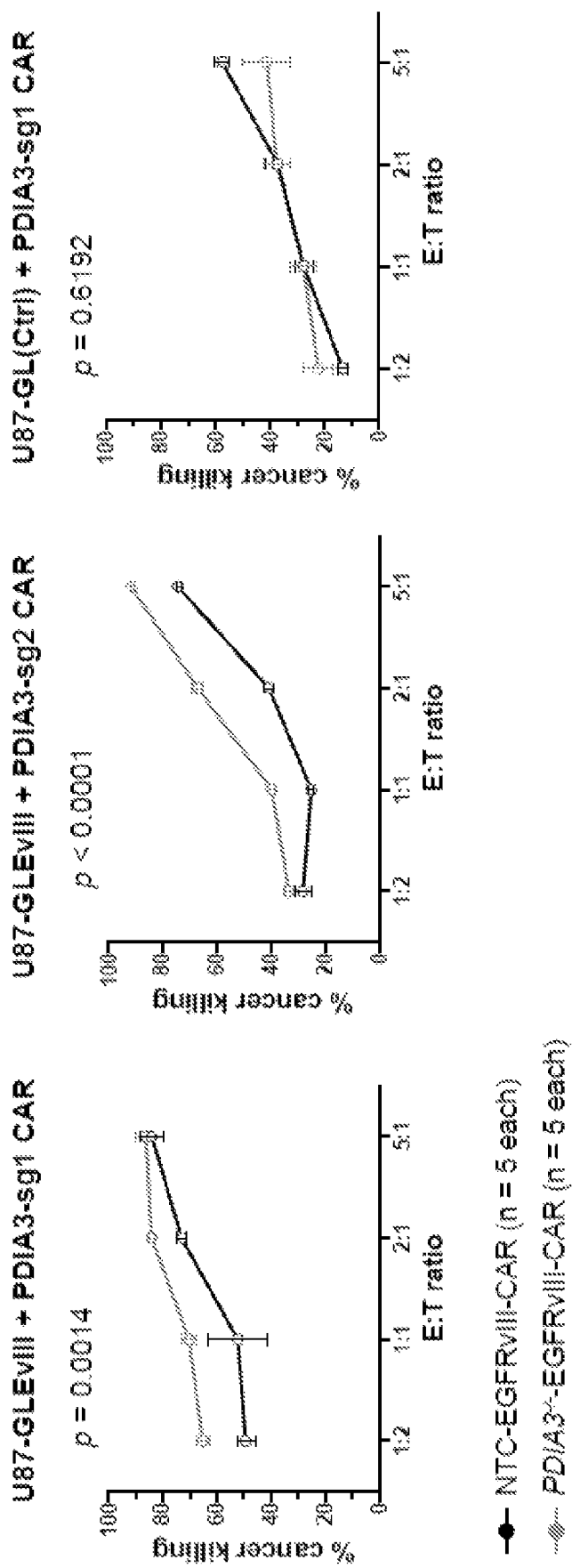

Example 8: PDIA3 Engineering Enhanced CAR-T Killing of Human EGFRvIII+ GBM Cells To further establish PDIA3 as an immunotherapy target of T cell engineering, especially against GBM, a PDIA3 mutant and control human EGFRvIII CAR-T cells were established by Cas9-RNP mediated gene editing of primary CD8+ T cells, along with AAV donor mediated knockin of an EGFRvIII CAR-T cassette into the TCR Alpha Constant chain (TRAC) locus (the EGFRvIII cloning vector is SEQ ID NO: 69,748 the CAR-T construct and vector is SEQ ID NO: 69,749) (FIG. 16A). An EGFRvIII-antigen expressing U87 GBM cell line (U87-Luc-EGFRvIII) was also generated. CAR-T cell:cancer cell co-culture assays were then performed in order to test the cytolytic (killing) activity. PDIA3 knockout compared to wildtype EGFRvIII CAR-T cells had significantly higher killing ability against the cognate U87-Luc-EGFRvIII cells (FIG. 16B). This was confirmed using an independent sgRNA targeting PDIA3 (FIG. 16C), further minimizing the probability of off-target. The killing ability of CAR-T is not different towards the parental U87 cells without EGFRvIII antigen (FIG. 16D), supporting CAR-T's antigen-specificity. These data together demonstrate that the major effect of PDIA3 knockout in EGFRvIII CAR-T cells is dependent on CAR-antigen recognition, and minimally due to TCR off target or gene editing off-target effects.

Example 9: Generation of Novel Monoclonal Antibodies Against Human MGAT5 and PDIA3

Figure 15A:
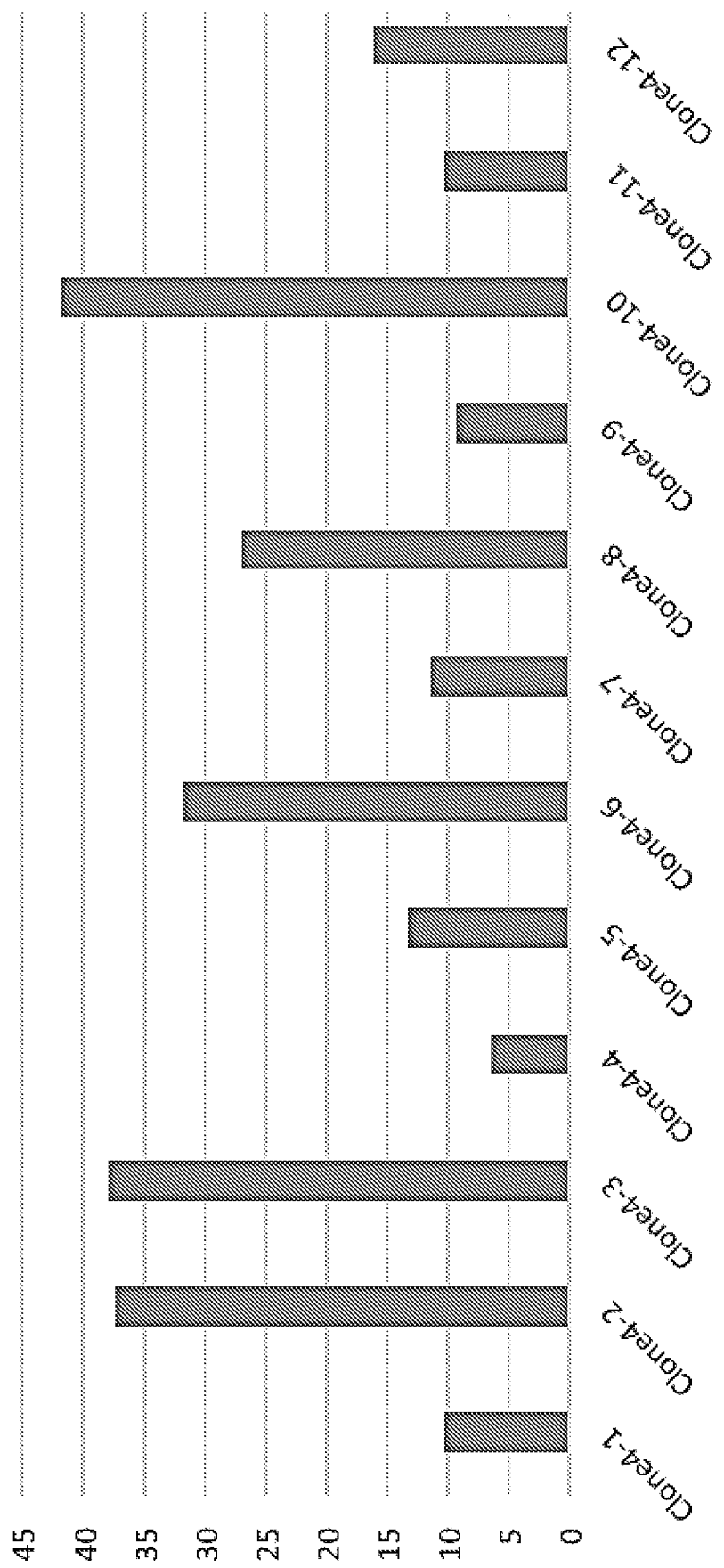
FIGS. 15A-15B show ELISA results of novel antibodies against human MGAT5 (FIG. 15A) or human PDIA3 (FIG. 15B). Phage display was used to generate monoclonal antibodies against MGAT5 or PDIA3, key targets identified by the in vivo AAV-SB-CRISPR screen in T cells. Purified recombinant antibodies were then used to stain HEK293FT cells expressing MGAT5 or PDIA3 antigens using standard flow cytometry protocols (FIG. 15C).
Figure 15B:
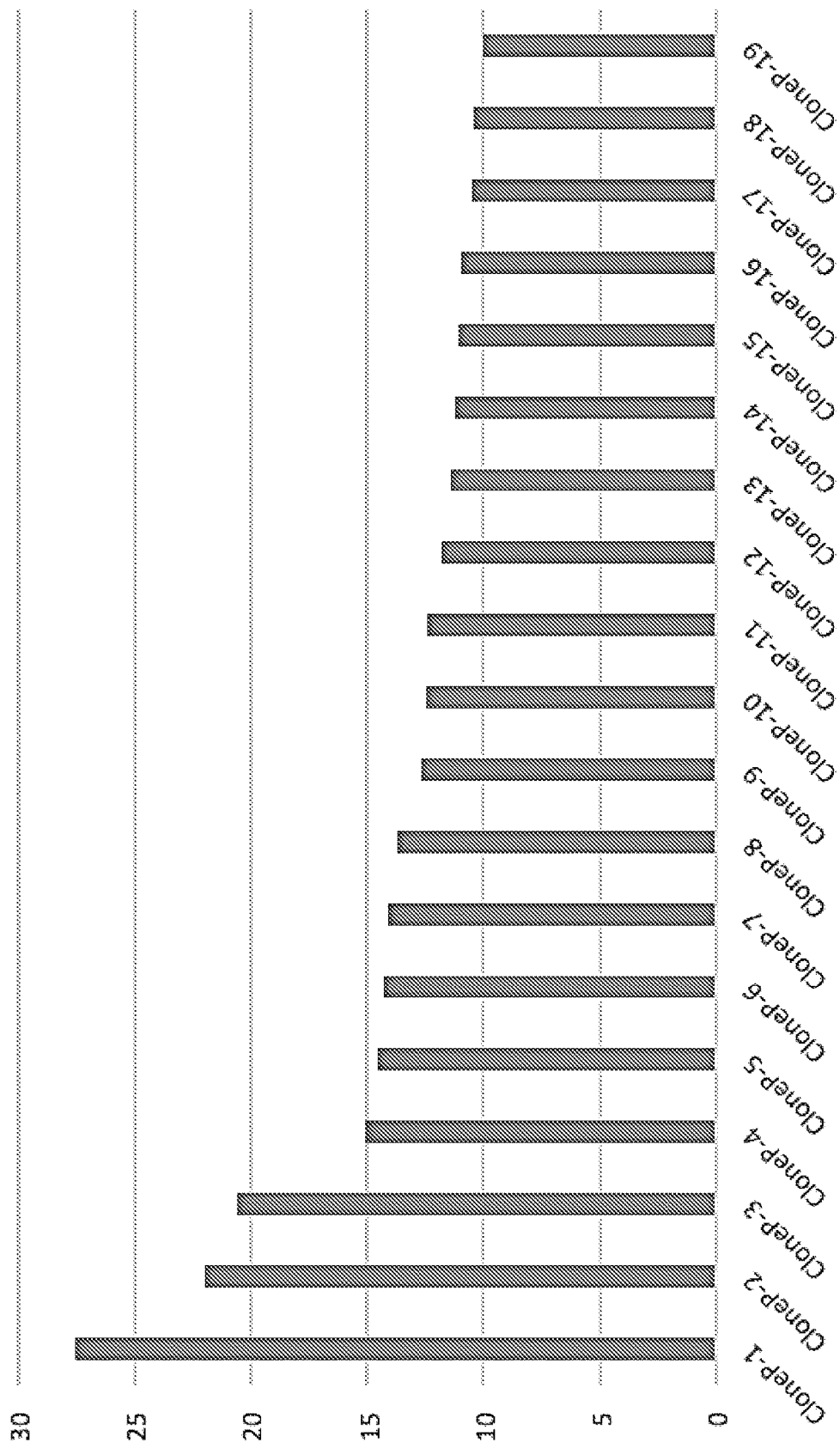
Figure 15C:
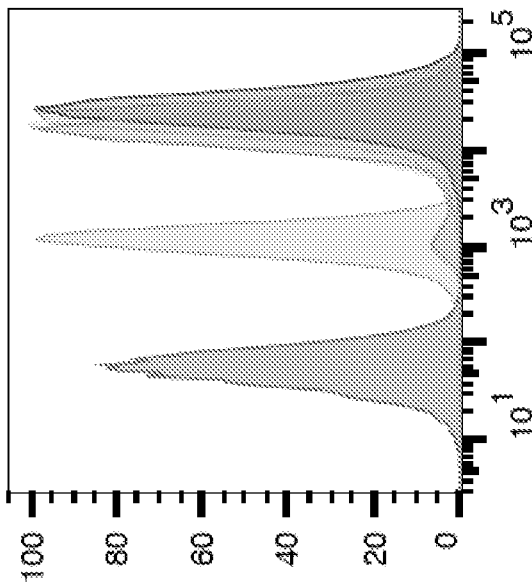
Figure 15C:
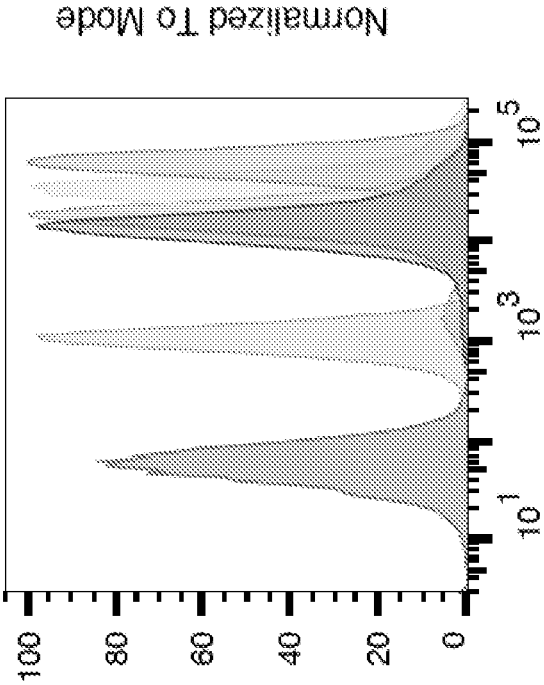

Phage display was used to generate monoclonal antibodies (mAbs) against two key targets revealed by in vivo AAV-SB-CRISPR screen in human and mouse T cells. Monoclonal antibodies against human MGAT5 and PDIA3 were generated successfully. Multiple clones were generated against each protein and target specificity was confirmed by ELISA against recombinant protein (FIG. 15A for MGAT5; FIG. 15B for PDIA3). Complementarity Determining Regions (CDR) were then determined, and are listed in Tables 3 and 4 for MGAT5 and PDIA3, respectively. Purified recombinant antibodies were then used to stain HEK293FT cells expressing MGAT5 or PDIA3 antigens using standard flow cytometry protocols (FIG. 15C). Clone numbers are described in Table 5.

TABLE 1 mmSurf sgRNA library sequences

| SEQ ID NO | id_gRNA Target | Sequence |
|---|---|---|
| SEQ ID NO: 1 | mm00013_Abca1 | ACATGTCATCAACATAACAG |
| SEQ ID NO: 2 | mm00014_Abca1 | GTGGACCCGTACTCTCGCAG |
| SEQ ID NO: 3 | mm00015_Abca1 | CAAGCTGTCAAGCAACACTG |
| SEQ ID NO: 4 | mm00016_Abca1 | GGTATACACAGAGCCATTTG |
| SEQ ID NO: 5 | mm00021_Abca2 | CATGTATGTAGCGATCCGCG |
| SEQ ID NO: 6 | mm00022_Abca2 | CTGGACGCCAATAAGCACGG |
| SEQ ID NO: 7 | mm00023_Abca2 | TAAGGGATAAAGTTGCCACG |

TABLE 1-continued mmSurf sgRNA library sequences

| SEQ ID NO | id_gRNA Target | Sequence |
|---|---|---|
| SEQ ID NO: 8 | mm00024_Abca2 | GAGCCTGAAGCGCTTCGGAG |
| SEQ ID NO: 9 | mm00029_Abcg1 | CAAGGACAATGCGTATACAG |
| SEQ ID NO: 10 | mm00030_Abcg1 | GACTATAAGAGAGACCTCGG |
| SEQ ID NO: 11 | mm00031_Abcg1 | CAGGCCGATCCCAATGTGCG |
| SEQ ID NO: 12 | mm00032_Abcg1 | TTTCCTACTCTGTACCCGAG |
| SEQ ID NO: 13 | mm00073_Asic1 | CCACGTCACCAAGCTCGACG |
| SEQ ID NO: 14 | mm00074_Asic1 | GTGGGCAAGACCGTGCAGCG |
| SEQ ID NO: 15 | mm00075_Asic1 | GGAAAACTGCAACTGCCGTA |
| SEQ ID NO: 16 | mm00076_Asic1 | TCTCTCGTGCCACTTCCGAG |
| SEQ ID NO: 17 | mm00077_Ace | GTTGTTGAACGAGTACGCAG |
| SEQ ID NO: 18 | mm00078_Ace | ACAAATACGTCAATCTCAGG |
| SEQ ID NO: 19 | mm00079_Ace | CTATAACTCGAGTGCCGAGG |
| SEQ ID NO: 20 | mm00080_Ace | GCAATGCACACGGGTCACGA |
| SEQ ID NO: 21 | mm00081_Ache | CAGCAGACCTACATTGCCAG |
| SEQ ID NO: 22 | mm00082_Ache | AAATGTCTGCTACCAGTACG |
| SEQ ID NO: 23 | mm00083_Ache | GACCCCGTAAACCAGAAAGT |
| SEQ ID NO: 24 | mm00084_Ache | CAGTATGTGCATGCCCACGG |
| SEQ ID NO: 25 | mm00109_Acp2 | GGGATTTGGTCAGCTAACCA |
| SEQ ID NO: 26 | mm00110_Acp2 | ACATGGTGGCCAACGAGACA |
| SEQ ID NO: 27 | mm00111_Acp2 | TTCTGCAGCTGCTCATAACG |
| SEQ ID NO: 28 | mm00112_Acp2 | TTCTGAACACCTCTTACCAC |
| SEQ ID NO: 29 | mm00121_Chrna1 | TGACTTGTACAATCTCACGG |
| SEQ ID NO: 30 | mm00122_Chrna1 | AAGGTGCTCCTGGACTACAC |
| SEQ ID NO: 31 | mm00123_Chrna1 | AACATATACTTCCCGATCAG |
| SEQ ID NO: 32 | mm00124_Chrna1 | GAGTAACTTCATGGAGAGCG |
| SEQ ID NO: 33 | mm00125_Chrna4 | TGACATTCTCGTAGTCACCA |
| SEQ ID NO: 34 | mm00126_Chrna4 | GGTGAGCATGCACAGCCGTG |
| SEQ ID NO: 35 | mm00127_Chrna4 | TCTTCTCTGGCTACAACAAG |
| SEQ ID NO: 36 | mm00128_Chrna4 | TGTAGAACAGTGGCAGTCGG |
| SEQ ID NO: 37 | mm00133_Chrna7 | AGATGCATTCACCAAGACGT |
| SEQ ID NO: 38 | mm00134_Chrna7 | ACACAGTAACCATGCGCCGT |
| SEQ ID NO: 39 | mm00135_Chrna7 | TGGAACATGTCTGAGTACCC |
| SEQ ID NO: 40 | mm00136_Chrna7 | AATGGAGAATGGGATCTCAT |
| SEQ ID NO: 41 | mm00141_Chrnb2 | TGTGCGTGGTAGGCGAACGG |
| SEQ ID NO: 42 | mm00142_Chrnb2 | CGTCTGGGTTCTCGTTGCGT |
| SEQ ID NO: 43 | mm00143_Chrnb2 | TCCCTCGACGTACCGCTGGT |
| SEQ ID NO: 44 | mm00144_Chrnb2 | GGAGCCAGATGTGCTTAGAA |
| SEQ ID NO: 45 | mm00157_Adipoq | CGCTGAGCGATACACATAAG |

TABLE 1-continued mmSurf sgRNA library sequences

| SEQ ID NO | id_gRNA Target | Sequence |
|---|---|---|
| SEQ ID NO: 46 | mm00158_Adipoq | ACGTCATCTTCGGCATGACT |
| SEQ ID NO: 47 | mm00159_Adipoq | GGGGTTCCGGGGAAGCCCCG |
| SEQ ID NO: 48 | mm00160_Adipoq | AACCAACAGAATCATTATGA |
| SEQ ID NO: 49 | mm00201_Acvr1 | GGTGGAAATTCTGTGTTCCG |
| SEQ ID NO: 50 | mm00202_Acvr1 | TGTGGGAGACAGCACTCTAG |
| SEQ ID NO: 51 | mm00203_Acvr1 | GCTTTCAGGTTTATGAGCAG |
| SEQ ID NO: 52 | mm00204_Acvr1 | ATTGTACTGTCCATAGCCAG |
| SEQ ID NO: 53 | mm00205_Acvr1b | GTGTCTACCATAACCGCCAG |
| SEQ ID NO: 54 | mm00206_Acvr1b | TCTACGACCTCTCCACGTCA |
| SEQ ID NO: 55 | mm00207_Acvr1b | TGTACGTACCTGCATCCCCA |
| SEQ ID NO: 56 | mm00208_Acvr1b | CAAGAACTCACTCACCGCTG |
| SEQ ID NO: 57 | mm00209_Acvr2a | AGAGACAGAACCAACCAGAC |
| SEQ ID NO: 58 | mm00210_Acvr2a | GGTGTACAGACATCACAAGA |
| SEQ ID NO: 59 | mm00211_Acvr2a | AGGATTGGCATATTTACATG |
| SEQ ID NO: 60 | mm00212_Acvr2a | AGCTGTTAGAAGTGAAAGCA |
| SEQ ID NO: 61 | mm00213_Acvr2b | GTGGAACGAACTGTGCCACG |
| SEQ ID NO: 62 | mm00214_Acvr2b | CCGATGACGATACATCCAGA |
| SEQ ID NO: 63 | mm00215_Acvr2b | GCAGCAGCAGAAGTACACCT |
| SEQ ID NO: 64 | mm00216_Acvr2b | CATCTACTACAACGCCAACT |
| SEQ ID NO: 65 | mm00217_Acvrl1 | TGCCAAAGATCTCCACATGT |
| SEQ ID NO: 66 | mm00218_Acvrl1 | GTTGCGCTGGTAGAGTGTGT |
| SEQ ID NO: 67 | mm00219_Acvrl1 | GTTCCGCGAAGTCATGTCGG |
| SEQ ID NO: 68 | mm00220_Acyrl1 | GCCACAAGCCTAGAGCACCC |
| SEQ ID NO: 69 | mm00225_Ada | GTTGTGGATCTTGTGAACCA |
| SEQ ID NO: 70 | mm00226_Ada | ATTCATCGGACCGTCCACGC |
| SEQ ID NO: 71 | mm00227_Ada | CTTCATCTCCACAAACTCGT |
| SEQ ID NO: 72 | mm00228_Ada | GCTGCGCAACATTATCGGCA |
| SEQ ID NO: 73 | mm00229_Adam10 | GGTTTCATCAAGACTCGTGG |
| SEQ ID NO: 74 | mm00230_Adam10 | CCCATAAATACGGCCCACAG |
| SEQ ID NO: 75 | mm00231_Adam10 | TATCTGTGGAAACGGGATGG |
| SEQ ID NO: 76 | mm00232_Adam10 | CAAACGAGCAGTCTCACATG |
| SEQ ID NO: 77 | mm00237_Adam12 | TCCAGTCTAGAAACTCATGG |
| SEQ ID NO: 78 | mm00238_Adam12 | AGAGCATGACGAACATCCAA |
| SEQ ID NO: 79 | mm00239_Adam12 | GGAGATCCTTATGGTAACTG |
| SEQ ID NO: 80 | mm00240_Adam12 | GGAGCCTGGTACTTACCCCG |
| SEQ ID NO: 81 | mm00241_Adam15 | GGGGGCTGTCCTGAACAACC |
| SEQ ID NO: 82 | mm00242_Adam15 | TGGCACCCGAATGGTCAGCG |
| SEQ ID NO: 83 | mm00243_Adam15 | GATTGTGGCTGATAATTCAG |

TABLE 1-continued mmSurf sgRNA library sequences

| SEQ ID NO | id_gRNA Target | Sequence |
| --- | --- | --- |
| SEQ ID NO: 84 | mm00244_Adam15 | TGTTCCCCTGACTTCTCCGG |
| SEQ ID NO: 85 | mm00245_Adam17 | GGTGTGTGGCAACTCCAGGG |
| SEQ ID NO: 86 | mm00246_Adam17 | ACACGTCGTGGGATAATGCA |
| SEQ ID NO: 87 | mm00247_Adam17 | CATCGACGTACGGCACACAC |
| SEQ ID NO: 88 | mm00248_Adam17 | GCCCCAAATGAGGACCAAGG |
| SEQ ID NO: 89 | mm00249_Adam19 | GGTGTCAATAGATACTGCGT |
| SEQ ID NO: 90 | mm00250_Adam19 | GACACTAGGACGCTGTATGG |
| SEQ ID NO: 91 | mm00251_Adam19 | GCCAATCTCATGGGCCACAG |
| SEQ ID NO: 92 | mm00252_Adam19 | ACCAACTATTATCAGATGGA |
| SEQ ID NO: 93 | mm00253_Adam2 | ATGTTGGCGCTACCTATCAA |
| SEQ ID NO: 94 | mm00254_Adam2 | AAGCAATGGCTACGAAACAC |
| SEQ ID NO: 95 | mm00255_Adam2 | GAATTACTGTAAGATTAAAG |
| SEQ ID NO: 96 | mm00256_Adam2 | TGCATTACTCTACGCCGAGA |
| SEQ ID NO: 97 | mm00257_Adam22 | AACTCACGAAGGGTAATCAG |
| SEQ ID NO: 98 | mm00258_Adam22 | TGAATACCATACCAGACGGA |
| SEQ ID NO: 99 | mm00259_Adam22 | CGCCGCCCAAGCGATAGATG |
| SEQ ID NO: 100 | mm00260_Adam22 | GTTCACTCAGTGCAATGTCG |
| SEQ ID NO: 101 | mm00261_Adam3 | CTGTCTCCGATGTATTCCGA |
| SEQ ID NO: 102 | mm00262_Adam3 | GCATCCAAAGACGTTAGCTG |
| SEQ ID NO: 103 | mm00263_Adam3 | GACTCACCTCTGGTTTGACA |
| SEQ ID NO: 104 | mm00264_Adam3 | AATCTGTACACTGCCTATCT |
| SEQ ID NO: 105 | mm00277_Adam9 | CCACGCAGGTGGGATCAATG |
| SEQ ID NO: 106 | mm00278_Adam9 | GATTCGCTTAGCAAACTACC |
| SEQ ID NO: 107 | mm00279_Adam9 | ACCAGCTTATTACCACAGGA |
| SEQ ID NO: 108 | mm00280_Adam9 | GTTTACACCTACGACAAGGA |
| SEQ ID NO: 109 | mm00285_Adcy6 | CCGGATACATCGCCTCGGAG |
| SEQ ID NO: 110 | mm00286_Adcy6 | CTCACGGGTGCACAGCACCG |
| SEQ ID NO: 111 | mm00287_Adcy6 | GAGTACCACAAAAAGGACAG |
| SEQ ID NO: 112 | mm00288_Adcy6 | CCCGAGGTTACATCCAGGCG |
| SEQ ID NO: 113 | mm00297_Adcy9 | ATGTCATGACATGCACAAAG |
| SEQ ID NO: 114 | mm00298_Adcy9 | TGTACGCCCGGCATTATGCG |
| SEQ ID NO: 115 | mm00299_Adcy9 | GATGGTGAACATGCGTGTTG |
| SEQ ID NO: 116 | mm00300_Adcy9 | TCTGCTGCATCTTAAAGGGG |
| SEQ ID NO: 117 | mm00305_Adcyap1r1 | CCAGGATTATTACTACCTGT |
| SEQ ID NO: 118 | mm00306_Adcyap1r1 | GTCTGGATGACAGAAACCAT |
| SEQ ID NO: 119 | mm00307_Adcyap1r1 | GGCTCTACTTTGATGATGCG |
| SEQ ID NO: 120 | mm00308_Adcyap1r1 | TGTGGGACAATATCACATGT |
| SEQ ID NO: 121 | mm00361_Adora2b | TCACTGGGACACGAGCGAGA |

TABLE 1-continued mmSurf sgRNA library sequences

| SEQ ID NO | id_gRNA Target | Sequence |
|---|---|---|
| SEQ ID NO: 122 | mm00362_Adora2b | TTCTCAAAGAGACATGTCAC |
| SEQ ID NO: 123 | mm00363_Adora2b | CAACGTGCTGGTGTGCGCCG |
| SEQ ID NO: 124 | mm00364_Adora2b | CTTTCTGGTATCCCTGGCGA |
| SEQ ID NO: 125 | mm00381_Adra1b | AGTATCGCACCCCAATGTAG |
| SEQ ID NO: 126 | mm00382_Adra1b | TCTTGGCCACGATGTAGACT |
| SEQ ID NO: 127 | mm00383_Adra1b | CATTCCGACTACAATGCCCA |
| SEQ ID NO: 128 | mm00384_Adra1b | ACCTTGAATACGGCGTCCGG |
| SEQ ID NO: 129 | mm00393_Adra2a | CCAGTAACCCATAACCTCGT |
| SEQ ID NO: 130 | mm00394_Adra2a | GGGGCACCGTTAAGCTGGGT |
| SEQ ID NO: 131 | mm00395_Adra2a | GCAAGATCAACGACCAGAAG |
| SEQ ID NO: 132 | mm00396_Adra2a | GACAGCCGAGATGACCCACA |
| SEQ ID NO: 133 | mm00445_Afp | CTTCTCCGTCACGCACTGGG |
| SEQ ID NO: 134 | mm00446_Afp | CTTGGCTGCTCAGTACGACA |
| SEQ ID NO: 135 | mm00447_Afp | CTTATACTTACGTTGCCTGG |
| SEQ ID NO: 136 | mm00448_Afp | CAAAATGACTAGCGATGTGT |
| SEQ ID NO: 137 | mm00457_Ager | CCTTACGGTAGACTCGGACT |
| SEQ ID NO: 138 | mm00458_Ager | CCACTGGAATTGTCGATGAG |
| SEQ ID NO: 139 | mm00459_Ager | AGACGGGACTCTTTACACTG |
| SEQ ID NO: 140 | mm00460_Ager | ACTTGTGCTAAGCTGTAAGG |
| SEQ ID NO: 141 | mm00461_Angpt1 | ACTGGTTCCTATCTCAAGCA |
| SEQ ID NO: 142 | mm00462_Angpt1 | AGCCTTTGCACTAAAGAAGG |
| SEQ ID NO: 143 | mm00463_Angpt1 | TTGCAATATGGATGTGAATG |
| SEQ ID NO: 144 | mm00464_Angpt1 | AGAATTGGACACCTTGAAGG |
| SEQ ID NO: 145 | mm00473_Agrn | ACACCAGATCAGCCTATACG |
| SEQ ID NO: 146 | mm00474_Agrn | AGAAGGCCAGATGTGAAGCG |
| SEQ ID NO: 147 | mm00475_Agrn | TCTGTATGCCTGTCCCGCCG |
| SEQ ID NO: 148 | mm00476_Agrn | GAAGATTCTAGTGTCCCCGG |
| SEQ ID NO: 149 | mm00489_Agtr1a | GGGCCAGCGGTATTCCATAG |
| SEQ ID NO: 150 | mm00490_Agtr1a | ACACGTGAGCAGGAACACGC |
| SEQ ID NO: 151 | mm00491_Agtr1a | TGGTTAGGCCCAGTCCTATG |
| SEQ ID NO: 152 | mm00492_Agtr1a | TTACATGAAGCTGAAGACTG |
| SEQ ID NO: 153 | mm00497_Agtr2 | GTACCTATCGACACTCATGC |
| SEQ ID NO: 154 | mm00498_Agtr2 | ACAAGCCATACACCAAACAA |
| SEQ ID NO: 155 | mm00499_Agtr2 | ACTGAGCATATTTCTCGGGT |
| SEQ ID NO: 156 | mm00500_Agtr2 | TTTGTGTGAGCAATTAAAGG |
| SEQ ID NO: 157 | mm00521_Ahsg | TCCGTTCAACGATACCAACG |
| SEQ ID NO: 158 | mm00522_Ahsg | ACTCCACCAGAGTAGACACT |
| SEQ ID NO: 159 | mm00523_Ahsg | CTCACAGAACAGTTTGCCAG |

TABLE 1-continued mmSurf sgRNA library sequences

| SEQ ID NO | id_gRNA Target | Sequence |
| --- | --- | --- |
| SEQ ID NO: 160 | mm00524_Ahsg | ACCCAGTGTCATTCCACCCC |
| SEQ ID NO: 161 | mm00573_Alpl | GGATAACGAGATGCCACCAG |
| SEQ ID NO: 162 | mm00574_Alpl | CTAGGAGGCAGGATTGACCA |
| SEQ ID NO: 163 | mm00575_Alpl | ACCTAAGAGGTAGTCCACCC |
| SEQ ID NO: 164 | mm00576_Alpl | GTTGCATCGCGTGCGCTCTG |
| SEQ ID NO: 165 | mm00577_Akp3 | TGTTCGACTTAGCCATCGAG |
| SEQ ID NO: 166 | mm00578_Akp3 | GTGTGAACATATGTGCCCGA |
| SEQ ID NO: 167 | mm00579_Akp3 | CTGTCCCCAGACATACAGTG |
| SEQ ID NO: 168 | mm00580_Akp3 | GTTGCACTGGTCGAATCTCG |
| SEQ ID NO: 169 | mm00605_Alcam | TGCAAGTAGGAACGCGACTG |
| SEQ ID NO: 170 | mm00606_Alcam | CTGAACACCTTGACTAGGGT |
| SEQ ID NO: 171 | mm00607_Alcam | GGTTGTCTTGTACTCCAAGG |
| SEQ ID NO: 172 | mm00608_Alcam | ACTTTCAGGAAAAGCCCGAT |
| SEQ ID NO: 173 | mm00637_Alk | TGGGCAACATATCTCCCCGA |
| SEQ ID NO: 174 | mm00638_Alk | GAATTCCAACTTGAGCGTGG |
| SEQ ID NO: 175 | mm00639_Alk | TACACTTACCATATCGACTG |
| SEQ ID NO: 176 | mm00640_Alk | GGGGTGTACAGGATACCCAA |
| SEQ ID NO: 177 | mm00681_Ambp | GCATGACCAGTACTCGATGG |
| SEQ ID NO: 178 | mm00682_Ambp | TATCTGGCAGTGTTGACGCA |
| SEQ ID NO: 179 | mm00683_Ambp | GGACTGAGCCACTAATAACT |
| SEQ ID NO: 180 | mm00684_Ambp | AAGGATGTGGCCCTGAATGT |
| SEQ ID NO: 181 | mm00689_Amelx | ACCCATGGGTTCGTAACCAT |
| SEQ ID NO: 182 | mm00690_Amelx | GCTCTGGTACCACTTCAAAG |
| SEQ ID NO: 183 | mm00691_Amelx | GGCTGAAGGGTGTGACTCGG |
| SEQ ID NO: 184 | mm00692_Amelx | GGGCTGTTGAGCTGGCACCA |
| SEQ ID NO: 185 | mm00725_Ank3 | CTATACACCACTGCACATCG |
| SEQ ID NO: 186 | mm00726_Ank3 | CAACCACCGAGATGTAACCA |
| SEQ ID NO: 187 | mm00727_Ank3 | ATCTATTCAAGCCGTAACCG |
| SEQ ID NO: 188 | mm00728_Ank3 | GAGGGATTTCCACAATGACG |
| SEQ ID NO: 189 | mm00753_Anxa4 | CCTGGCCTCTCGTACCCCTG |
| SEQ ID NO: 190 | mm00754_Anxa4 | GCTTCATAAGAGCATCATCA |
| SEQ ID NO: 191 | mm00755_Anxa4 | CTGTACGTCATACAGCACTG |
| SEQ ID NO: 192 | mm00756_Anxa4 | GGAACCATCTGCTCCACGGT |
| SEQ ID NO: 193 | mm00757_Anxa5 | TAGGCATCGTAGAGTCGTGA |
| SEQ ID NO: 194 | mm00758_Anxa5 | ATCAATTTCAGGTACCGATG |
| SEQ ID NO: 195 | mm00759_Anxa5 | ATACTTCAGGGTACTACCAG |
| SEQ ID NO: 196 | mm00760_Anxa5 | TGTCCTTGAAGCAATAATCT |
| SEQ ID NO: 197 | mm00773_Aoc3 | ACAATGACTACAGCCCCCCG |

TABLE 1-continued mmSurf sgRNA library sequences

| SEQ ID NO | id_gRNA Target | Sequence |
|---|---|---|
| SEQ ID NO: 198 | mm00774_Aoc3 | ATCAATGTCGACCTGCTACG |
| SEQ ID NO: 199 | mm00775_Aoc3 | TCCCAAACAATGGTACAGGT |
| SEQ ID NO: 200 | mm00776_Aoc3 | TGCATCACGTAGTGTCTTGG |
| SEQ ID NO: 201 | mm00821_Ap2m1 | CCAAAGATACCGTACTACCA |
| SEQ ID NO: 202 | mm00822_Ap2m1 | GAGAAGACACTTACCCTGTG |
| SEQ ID NO: 203 | mm00823_Ap2m1 | CAGCTGATGAAACAAGCAAG |
| SEQ ID NO: 204 | mm00824_Ap2m1 | CCTTTATCCCATATAGACGA |
| SEQ ID NO: 205 | mm00913_Apoa1 | GGAGCTCTACCGCCAGAAGG |
| SEQ ID NO: 206 | mm00914_Apoa1 | CAAGGAGGAGGATTCAAACT |
| SEQ ID NO: 207 | mm00915_Apoa1 | GTCCCAATGGGACAAAGTGA |
| SEQ ID NO: 208 | mm00916_Apoa1 | CTGGAAAACTGGGACACTCT |
| SEQ ID NO: 209 | mm00921_Apoa4 | CAAAGTAACCCAGACGTTCG |
| SEQ ID NO: 210 | mm00922_Apoa4 | GGTGGCAAGGGGCATCATCG |
| SEQ ID NO: 211 | mm00923_Apoa4 | TGCTAGTACGTATGCTGATG |
| SEQ ID NO: 212 | mm00924_Apoa4 | AAAGTAATCCCACACCACAT |
| SEQ ID NO: 213 | mm00949_Apoh | AAAGACATCCTACGACCCTG |
| SEQ ID NO: 214 | mm00950_Apoh | TTTCCGATCATGGCAAAGTG |
| SEQ ID NO: 215 | mm00951_Apoh | CAGCTCATCTAAGTGCACGG |
| SEQ ID NO: 216 | mm00952_Apoh | AGGATTATAGGCCTTCAGCT |
| SEQ ID NO: 217 | mm00957_App | CACGGAAGAGTACTGCATGG |
| SEQ ID NO: 218 | mm00958_App | GCAGCTTGTAGAGACACACA |
| SEQ ID NO: 219 | mm00959_App | AACGGTAAGGAATCACGATG |
| SEQ ID NO: 220 | mm00960_App | CAAAACCTGCATTGGCACCA |
| SEQ ID NO: 221 | mm00965_Aqp1 | AAGTGAATTGTCGACTAGGG |
| SEQ ID NO: 222 | mm00966_Aqp1 | CCTAGGCTTCAATTACCCAC |
| SEQ ID NO: 223 | mm00967_Aqp1 | GGAGCCCCAGTGTGACCGCA |
| SEQ ID NO: 224 | mm00968_Aqp1 | TGATGTACATGACAGCCCGG |
| SEQ ID NO: 225 | mm00977_Aqp4 | GGATCCACCATAAACTGGGG |
| SEQ ID NO: 226 | mm00978_Aqp4 | ACCATGGCTACAGTCACAGC |
| SEQ ID NO: 227 | mm00979_Aqp4 | AAGTGATTATTAACTCCACC |
| SEQ ID NO: 228 | mm00980_Aqp4 | AATCCTCCAACCACACTGGG |
| SEQ ID NO: 229 | mm01017_Areg | AGGGGACTACGACTACTCAG |
| SEQ ID NO: 230 | mm01018_Areg | AGAAGGCATTTCGCTTATGG |
| SEQ ID NO: 231 | mm01019_Areg | CAGATACATCGAGAACCTGG |
| SEQ ID NO: 232 | mm01020_Areg | GAAAGGCGAATCGCTTTCTG |
| SEQ ID NO: 233 | mm01037_Arf6 | CCCCACGGTGGGCTTCAACG |
| SEQ ID NO: 234 | mm01038_Arf6 | TCTGGCGGCATTACTACACC |
| SEQ ID NO: 235 | mm01039_Arf6 | TCTTCGGGAACAAGGAAATG |

TABLE 1-continued mmSurf sgRNA library sequences

| SEQ ID NO | id_gRNA Target | Sequence |
|---|---|---|
| SEQ ID NO: 236 | mm01040_Arf6 | CGACCGCGACCGCATCGACG |
| SEQ ID NO: 237 | mm01049_Rhoa | AAAACACATCAATATAACAT |
| SEQ ID NO: 238 | mm01050_Rhoa | CTATGTGGCGGATATCGAGG |
| SEQ ID NO: 239 | mm01051_Rhoa | GCTACTCACCTAAACTATCA |
| SEQ ID NO: 240 | mm01052_Rhoa | CAGCAAGGACCAGTTCCCAG |
| SEQ ID NO: 241 | mm01053_Rhob | GAAGCACATAAGGATGACGT |
| SEQ ID NO: 242 | mm01054_Rhob | CACATAGTTCTCGAACACGG |
| SEQ ID NO: 243 | mm01055_Rhob | GGGGCAGAAGTGCTTTACCT |
| SEQ ID NO: 244 | mm01056_Rhob | CAGCGACGAGCATGTCCGCA |
| SEQ ID NO: 245 | mm01057_Rhoc | ACGTGCCCATCATCCTAGTG |
| SEQ ID NO: 246 | mm01058_Rhoc | GATGACGTCAGTGTCCGGGT |
| SEQ ID NO: 247 | mm01059_Rhoc | CTATATAGCCGACATCGAAG |
| SEQ ID NO: 248 | mm01060_Rhoc | CAGCAAAGATCAGTTTCCAG |
| SEQ ID NO: 249 | mm01105_Art1 | TGCCGCCCAACAATTTGGCG |
| SEQ ID NO: 250 | mm01106_Art1 | TCAGGCCAACAAAGTATACG |
| SEQ ID NO: 251 | mm01107_Art1 | AAAGCCCCCAGCCTAACGG |
| SEQ ID NO: 252 | mm01108_Art1 | GCTGGCACCCGCGAGATCGG |
| SEQ ID NO: 253 | mm01109_Art2b | GGTTGTAGTTTAGTTTACCG |
| SEQ ID NO: 254 | mm01110_Art2b | AACAGTACGAGTTATCCGGC |
| SEQ ID NO: 255 | mm01111_Art2b | CTCTGTTAAAATCTATAGCG |
| SEQ ID NO: 256 | mm01112_Art2b | CTAGCATGAAAGGCACTGCA |
| SEQ ID NO: 257 | mm01125_Arsb | GGTGGGCAGACTAGGTCTGG |
| SEQ ID NO: 258 | mm01126_Arsb | GAATGTCTGCCGACACGCCG |
| SEQ ID NO: 259 | mm01127_Arsb | AGCACAGACGTATTTATGCA |
| SEQ ID NO: 260 | mm01128_Arsb | GCCAGCACGAAGACCACATG |
| SEQ ID NO: 261 | mm01129_Arsa | AAGCACGTTAGGTTCTGACA |
| SEQ ID NO: 262 | mm01130_Arsa | AGGAGTCCCCAAATGGCCCA |
| SEQ ID NO: 263 | mm01131_Arsa | GTGACCTGGCCAGTAGACCA |
| SEQ ID NO: 264 | mm01132_Arsa | TCGGAGAAAGACACATACC |
| SEQ ID NO: 265 | mm01133_Asah1 | GCAAGGTGTACGTTACCTAG |
| SEQ ID NO: 266 | mm01134_Asah1 | TAACATTTATAACATACCGC |
| SEQ ID NO: 267 | mm01135_Asah1 | AGTGATAAACCCTACCCACT |
| SEQ ID NO: 268 | mm01136_Asah1 | GAATATAAATAATAACACTT |
| SEQ ID NO: 269 | mm01153_Astn1 | CCTTACACGATATTTCAGCG |
| SEQ ID NO: 270 | mm01154_Astn1 | TGCTCAGATGGTTTCAACGG |
| SEQ ID NO: 271 | mm01155_Astn1 | TGACATGAGAAGAGCACACG |
| SEQ ID NO: 272 | mm01156_Astn1 | TGATGATCCTGTACACTCGC |
| SEQ ID NO: 273 | mm01213_Atp1a1 | GTACACGACGATGCCACGTG |

TABLE 1-continued mmSurf sgRNA library sequences

| SEQ ID NO | id_gRNA Target | Sequence |
|---|---|---|
| SEQ ID NO: 274 | mm01214_Atp1a1 | CTTACCACTCTGATTCTCCG |
| SEQ ID NO: 275 | mm01215_Atp1a1 | AATCTGTTCCGTATTTACGA |
| SEQ ID NO: 276 | mm01216_Atp1a1 | GAAAATGAGCATCAATGCGG |
| SEQ ID NO: 277 | mm01217_Atp1b1 | GTACTTACACCAACTACCAC |
| SEQ ID NO: 278 | mm01218_Atp1b1 | TTGAGCTTGATAATGATGCA |
| SEQ ID NO: 279 | mm01219_Atp1b1 | GGCGACATCAATCACGAACG |
| SEQ ID NO: 280 | mm01220_Atp1b1 | AGCTCTTGGGGTCATTAGGA |
| SEQ ID NO: 281 | mm01221_Atp1b2 | GGTTGCTCATAATATCGCCC |
| SEQ ID NO: 282 | mm01222_Atp1b2 | AGGAGTTCGTGTGGAACCCG |
| SEQ ID NO: 283 | mm01223_Atp1b2 | ATTAGTGACACTGAAAGCTG |
| SEQ ID NO: 284 | mm01224_Atp1b2 | CAGTCGATCCTGGTACTTGG |
| SEQ ID NO: 285 | mm01225_Atp1b3 | CTCCATCAGGACAACTTGTG |
| SEQ ID NO: 286 | mm01226_Atp1b3 | TCAACACAATTACCTGGACT |
| SEQ ID NO: 287 | mm01227_Atp1b3 | GCCACAGACTTACAAAAAGT |
| SEQ ID NO: 288 | mm01228_Atp1b3 | CGAGCAGCGGAGAGTTTCTG |
| SEQ ID NO: 289 | mm01257_Atp5b | CTGCTGGCCCCATACGCCAA |
| SEQ ID NO: 290 | mm01258_Atp5b | GCGCTTACCAGGATGAACCC |
| SEQ ID NO: 291 | mm01259_Atp5b | AAATACAGAGTAACCACCAT |
| SEQ ID NO: 292 | mm01260_Atp5b | CCCACCCTAGCCACCGACAT |
| SEQ ID NO: 293 | mm01277_Atp6v1a | TGACTGCTGATATCCGACAG |
| SEQ ID NO: 294 | mm01278_Atp6v1a | AGTCGGCCATCATACTGACG |
| SEQ ID NO: 295 | mm01279_Atp6v1a | ATGTTGCCCCCACGTAACAG |
| SEQ ID NO: 296 | mm01280_Atp6v1a | CTTACGGGAAAAGGGCATCG |
| SEQ ID NO: 297 | mm01325_Slc7a1 | GCCATGGCATAGATAACTCG |
| SEQ ID NO: 298 | mm01326_Slc7a1 | CACAAACGTGAAATACGGTG |
| SEQ ID NO: 299 | mm01327_Slc7a1 | TGACGTGAGAACTCTCCGAT |
| SEQ ID NO: 300 | mm01328_Slc7a1 | CCAGGTCCTTCAGTTCAAAG |
| SEQ ID NO: 301 | mm01329_Slc7a2 | AGGACGTCACTATTCCGATG |
| SEQ ID NO: 302 | mm01330_Slc7a2 | GAACGGAACAAGCATCTACG |
| SEQ ID NO: 303 | mm01331_Slc7a2 | GTATCTATACACTTACGTCA |
| SEQ ID NO: 304 | mm01332_Slc7a2 | CCGAGACAACATATTTGGCG |
| SEQ ID NO: 305 | mm01337_Atrn | CCTCACTGTACAGACAACTG |
| SEQ ID NO: 306 | mm01338_Atrn | ACGATGTGGATACTCAGATG |
| SEQ ID NO: 307 | mm01339_Atrn | GAGGAAAAATTGATTCAACA |
| SEQ ID NO: 308 | mm01340_Atrn | GGCCGCCGTTGACACACGGC |
| SEQ ID NO: 309 | mm01353_Pcdh15 | CTATCATGAAGTACGCATCG |
| SEQ ID NO: 310 | mm01354_Pcdh15 | GAAGCGGGGTAATCCTCAG |
| SEQ ID NO: 311 | mm01355_Pcdh15 | TTAGCAAACGCATCTACAAG |

TABLE 1-continued mmSurf sgRNA library sequences

| SEQ ID NO | id_gRNA Target | Sequence |
|---|---|---|
| SEQ ID NO: 312 | mm01356_Pcdh15 | CTTCCTGAATGACTACACCT |
| SEQ ID NO: 313 | mm01385_B2m | ATTTGGATTTCAATGTGAGG |
| SEQ ID NO: 314 | mm01386_B2m | ACTCACTCTGGATAGCATAC |
| SEQ ID NO: 315 | mm01387_B2m | TGAGTATACTTGAATTTGAG |
| SEQ ID NO: 316 | mm01388_B2m | TCGGCTTCCCATTCTCCGGT |
| SEQ ID NO: 317 | mm01437_Bcan | CGAAGCCTACCGGTTCCGCG |
| SEQ ID NO: 318 | mm01438_Bcan | GATGGAGAGCGAGTCTCGTG |
| SEQ ID NO: 319 | mm01439_Bcan | TGGATGGCTATCCTGGCGTG |
| SEQ ID NO: 320 | mm01440_Bcan | ACACCCAGCCAACGCTGTGG |
| SEQ ID NO: 321 | mm01445_Phb2 | TCTATGACCGCCTTCCACTG |
| SEQ ID NO: 322 | mm01446_Phb2 | TGGGTCGGGACAGCACACGC |
| SEQ ID NO: 323 | mm01447_Phb2 | CATAGTCCAGCCCTAGACGC |
| SEQ ID NO: 324 | mm01448_Phb2 | AGCGCCGTGCCCATGCCCCG |
| SEQ ID NO: 325 | mm01457_Bche | AATTACAACCAAGACCGGAA |
| SEQ ID NO: 326 | mm01458_Bche | GTTTCGATGAACTATAGGGT |
| SEQ ID NO: 327 | mm01459_Bche | CTGGGCAGTAAAGCATCCTG |
| SEQ ID NO: 328 | mm01460_Bche | ACAATGATAGCCTTATCACA |
| SEQ ID NO: 329 | mm01529_Bdkrb2 | GCACAAAAACAGCTGCACTG |
| SEQ ID NO: 330 | mm01530_Bdkrb2 | GGACGGGTAGACGATGACGC |
| SEQ ID NO: 331 | mm01531_Bdkrb2 | TCCCGTTAAGAGCAGACCCG |
| SEQ ID NO: 332 | mm01532_Bdkrb2 | CATCGCCAATAACTTTGACT |
| SEQ ID NO: 333 | mm01565_Bgn | ATGGATTCGTAGTTCTACCA |
| SEQ ID NO: 334 | mm01566_Bgn | GAAGTTCGTTCAGGGTCTCA |
| SEQ ID NO: 335 | mm01567_Bgn | GTTCTGCAGGTCTAGCAGTG |
| SEQ ID NO: 336 | mm01568_Bgn | CTTATTGTTTACCAAGACCA |
| SEQ ID NO: 337 | mm01589_Fabp7 | ACTGTGATTATCAGTCAGGA |
| SEQ ID NO: 338 | mm01590_Fabp7 | TAGATGCTTTCTGCGCAACC |
| SEQ ID NO: 339 | mm01591_Fabp7 | CACGTTTCCCACTTGCCTAG |
| SEQ ID NO: 340 | mm01592_Fabp7 | TCTTGAATGTGCATTGTGTC |
| SEQ ID NO: 341 | mm01605_Cxcr5 | GAAGGTCGGCTACTGCGAGG |
| SEQ ID NO: 342 | mm01606_Cxcr5 | GTGATGGGATGGTGTTACGT |
| SEQ ID NO: 343 | mm01607_Cxcr5 | GGATGGAGAGGAGTCGACGG |
| SEQ ID NO: 344 | mm01608_Cxcr5 | GGATGTTTCCCATCATACCC |
| SEQ ID NO: 345 | mm01613_Bmp1 | CCCACCTCGGCGACCCACGT |
| SEQ ID NO: 346 | mm01614_Bmp1 | AGCCACAGTAGCGCCCAATG |
| SEQ ID NO: 347 | mm01615_Bmp1 | GTAGCCATTGGGATACTCAG |
| SEQ ID NO: 348 | mm01616_Bmp1 | TGTTCAAGGCCCAACCGCGG |
| SEQ ID NO: 349 | mm01617_Bmp10 | TCGCATGATGTATGATGGCG |

TABLE 1-continued mmSurf sgRNA library sequences

| SEQ ID NO | id_gRNA Target | Sequence |
| --- | --- | --- |
| SEQ ID NO: 350 | mm01618_Bmp10 | CTACGGAACCAACAGTGAGT |
| SEQ ID NO: 351 | mm01619_Bmp10 | CTCCGGATGATGTTAGCAGA |
| SEQ ID NO: 352 | mm01620_Bmp10 | ACTGCTCAAGGCCCATAATG |
| SEQ ID NO: 353 | mm01625_Bmp2 | GGGCCGCAAGAAGTTCGCCG |
| SEQ ID NO: 354 | mm01626_Bmp2 | GTGCGCAGCTTCCATCACGA |
| SEQ ID NO: 355 | mm01627_Bmp2 | GCCCATTTAGAGGAGAACCC |
| SEQ ID NO: 356 | mm01628_Bmp2 | TGTGTTCTGATTCACTAACC |
| SEQ ID NO: 357 | mm01657_Bmpr1a | GGGTACCATAAATTTCTGTG |
| SEQ ID NO: 358 | mm01658_Bmpr1a | TGACCTACCTATAACAACAG |
| SEQ ID NO: 359 | mm01659_Bmpr1a | AATCTAGATAGTATGCTCCA |
| SEQ ID NO: 360 | mm01660_Bmpr1a | CATACACCCAGAAGTTAATG |
| SEQ ID NO: 361 | mm01665_Bmpr2 | GTAGGATGTTGGTCTCACAT |
| SEQ ID NO: 362 | mm01666_Bmpr2 | CACACAGAATTACCACGAGG |
| SEQ ID NO: 363 | mm01667_Bmpr2 | GCTGGACATCGAATGCTCAG |
| SEQ ID NO: 364 | mm01668_Bmpr2 | AGATAATGCGGCTATAAGTG |
| SEQ ID NO: 365 | mm01697_Bst1 | AGACTGTGAAAACAACGCCG |
| SEQ ID NO: 366 | mm01698_Bst1 | TTCTGGGGCAAGAGCGCGG |
| SEQ ID NO: 367 | mm01699_Bst1 | CCTGCTCGTTATGAGCTATG |
| SEQ ID NO: 368 | mm01700_Bst1 | AAAGGAGCCTATCCCACGAG |
| SEQ ID NO: 369 | mm01733_Bsg | GGACGCAGATGACCGCTCTG |
| SEQ ID NO: 370 | mm01734_Bsg | CCACCTTACTCGGCCACCCA |
| SEQ ID NO: 371 | mm01735_Bsg | GAAATCAGAGCATTCCAGTG |
| SEQ ID NO: 372 | mm01736_Bsg | CAAACCACCACTGGATCTCG |
| SEQ ID NO: 373 | mm01737_Bsn | CCACAGCCAGTCCGACACGA |
| SEQ ID NO: 374 | mm01738_Bsn | AGACATGTCACTGCAAACCG |
| SEQ ID NO: 375 | mm01739_Bsn | ACCGAGCTATAGCGCCGCAG |
| SEQ ID NO: 376 | mm01740_Bsn | GAGGACGACTCCTTGGCATG |
| SEQ ID NO: 377 | mm01797_C1qa | CACAGATGAAGCGACCCGTG |
| SEQ ID NO: 378 | mm01798_C1qa | CCCAATGACGCTTGGCAACG |
| SEQ ID NO: 379 | mm01799_C1qa | TTCAGCCACTGTCCATACTA |
| SEQ ID NO: 380 | mm01800_C1qa | AGGCAATCCAGGCAATATCA |
| SEQ ID NO: 381 | mm01805_C1qbp | ATCAGTCAAGAATTCAACGA |
| SEQ ID NO: 382 | mm01806_C1qbp | CGTACGCTGAGCAAACCGAA |
| SEQ ID NO: 383 | mm01807_C1qbp | GTTGAAGTTACCAAGACTGA |
| SEQ ID NO: 384 | mm01808_C1qbp | TCCTCCTCACCATCAAATGT |
| SEQ ID NO: 385 | mm01817_Ciita | AGCTCGACTAAGGCTCCGGG |
| SEQ ID NO: 386 | mm01818_Ciita | AGGTCCTTGATTATATCGTG |
| SEQ ID NO: 387 | mm01819_Ciita | TCCAGTGTCCTAATCTACCA |

TABLE 1-continued mmSurf sgRNA library sequences

| SEQ ID NO | id_gRNA Target | Sequence |
|---|---|---|
| SEQ ID NO: 388 | mm01820_Ciita | AGCAGGCCAAGACTTACATG |
| SEQ ID NO: 389 | mm01821_C3ar1 | GCTTATGTACTATCAGACAT |
| SEQ ID NO: 390 | mm01822_C3ar1 | GGAGGCTTTCCACCATAATG |
| SEQ ID NO: 391 | mm01823_C3ar1 | TGGATGGGATAAGTTTGCAC |
| SEQ ID NO: 392 | mm01824_C3ar1 | GAGACCAAGAATGACCATGG |
| SEQ ID NO: 393 | mm01833_C5ar1 | CGAGGGCAGGACTATACAGG |
| SEQ ID NO: 394 | mm01834_C5ar1 | TCCATCCTTCGTGTACCGGG |
| SEQ ID NO: 395 | mm01835_C5ar1 | GAACACCAGCAGGAAACGGT |
| SEQ ID NO: 396 | mm01836_C5ar1 | GCAGTGCCAAGCACGAGAGG |
| SEQ ID NO: 397 | mm01841_Hyou1 | ACAGGCGGATAACCCTCATG |
| SEQ ID NO: 398 | mm01842_Hyou1 | ACATCGTACTCACTTGCCCA |
| SEQ ID NO: 399 | mm01843_Hyou1 | TGGAATTGATATCTTTCCGG |
| SEQ ID NO: 400 | mm01844_Hyou1 | TGGCGTGCTCAGTTTAGACA |
| SEQ ID NO: 401 | mm01853_Cacna1b | GAGCGACGAGCAAGACACCG |
| SEQ ID NO: 402 | mm01854_Cacna1b | TCTGTGCTTTCACCATACGC |
| SEQ ID NO: 403 | mm01855_Cacna1b | CATGGGATTGAGTCGCAAGG |
| SEQ ID NO: 404 | mm01856_Cacna1b | AAGGGCTCCTACCTTCGGAA |
| SEQ ID NO: 405 | mm01857_Cacna1c | CCAGTAAATTCCAACCATTG |
| SEQ ID NO: 406 | mm01858_Cacna1c | AATCAGGGTGGATAAGACGT |
| SEQ ID NO: 407 | mm01859_Cacna1c | GACATCGAGGGAGAAAACTG |
| SEQ ID NO: 408 | mm01860_Cacna1c | CCAGTACAAAGTGTGGTACG |
| SEQ ID NO: 409 | mm01873_Cacna1s | CTGATGGAATAGGAAGCCGT |
| SEQ ID NO: 410 | mm01874_Cacna1s | TCTCCAGCATTACAACCAGT |
| SEQ ID NO: 411 | mm01875_Cacna1s | TCCAGCTCATGTAACCACGG |
| SEQ ID NO: 412 | mm01876_Cacna1s | AAATGCACACCAGCACACCA |
| SEQ ID NO: 413 | mm01877_Cacna2d1 | TTGCAGCTTACTGTAAAACG |
| SEQ ID NO: 414 | mm01878_Cacna2d1 | ATTCCCACGGACATCTATGA |
| SEQ ID NO: 415 | mm01879_Cacna2d1 | GGTCAACATAATTATGACAG |
| SEQ ID NO: 416 | mm01880_Cacna2d1 | ATGATGTACGCAGAAGACCA |
| SEQ ID NO: 417 | mm01909_Pdia4 | CTGACTGTTAACATACCACG |
| SEQ ID NO: 418 | mm01910_Pdia4 | GTACAGCAAACGCCCCCTGG |
| SEQ ID NO: 419 | mm01911_Pdia4 | TACTGGAGTTCTATGCACCA |
| SEQ ID NO: 420 | mm01912_Pdia4 | AGCATCCTGATACTGCAAGT |
| SEQ ID NO: 421 | mm01917_Anxa2 | CAGATCAGTCTTGTACACTG |
| SEQ ID NO: 422 | mm01918_Anxa2 | GTTTGTCAGGATGTTGACAA |
| SEQ ID NO: 423 | mm01919_Anxa2 | AAGGAACCGACGTCCCCAAG |
| SEQ ID NO: 424 | mm01920_Anxa2 | TTGCCTTCGCCTATCAGAGA |
| SEQ ID NO: 425 | mm01937_Calcr | GTGATGGCGTGGATAATGGT |

TABLE 1-continued mmSurf sgRNA library sequences

| SEQ ID NO | id_gRNA Target | Sequence |
|---|---|---|
| SEQ ID NO: 426 | mm01938_Calcr | CAAAGTCCGGGAAGTAGTCA |
| SEQ ID NO: 427 | mm01939_Calcr | CCTACCAATCTCACTGACTC |
| SEQ ID NO: 428 | mm01940_Calcr | ACATATGTGGACAATGCAGT |
| SEQ ID NO: 429 | mm01957_Calr | TGAGCAGAATATCGACTGTG |
| SEQ ID NO: 430 | mm01958_Calr | CAAGAATGTGCTGATCAACA |
| SEQ ID NO: 431 | mm01959_Calr | TATGTTTGGATTCGACCCAG |
| SEQ ID NO: 432 | mm01960_Calr | GCGGCCAGACAACACCTATG |
| SEQ ID NO: 433 | mm01965_Calu | GAAGGGCACGACCTCAATG |
| SEQ ID NO: 434 | mm01966_Calu | CCTACCTAAAACGTAGCCGT |
| SEQ ID NO: 435 | mm01967_Calu | TGAACTTTATCGCTGAGCTG |
| SEQ ID NO: 436 | mm01968_Calu | AAGTAAAATAGATGACGACA |
| SEQ ID NO: 437 | mm02017_Capn5 | AGCTTGATATGATCCGTCTG |
| SEQ ID NO: 438 | mm02018_Capn5 | CCTGAGCATCCATAAGACAT |
| SEQ ID NO: 439 | mm02019_Capn5 | TTTACTATAAGGGCACCCCA |
| SEQ ID NO: 440 | mm02020_Capn5 | ATGAGCTGGTTGTTGACTGT |
| SEQ ID NO: 441 | mm02061_Car4 | CTGTACAGCCTCGTACCGGG |
| SEQ ID NO: 442 | mm02062_Car4 | GAAGTTGACATCTAGCAAGG |
| SEQ ID NO: 443 | mm02063_Car4 | TCACGGGGTTTGGAGATACT |
| SEQ ID NO: 444 | mm02064_Car4 | GAGGATACCTTCAGTAGAGG |
| SEQ ID NO: 445 | mm02125_Casr | GATAATGTCAGCCATCGCGG |
| SEQ ID NO: 446 | mm02126_Casr | CCCAACTTCCTTGAACACAA |
| SEQ ID NO: 447 | mm02127_Casr | AGCCTTCAGACCGAACCCAA |
| SEQ ID NO: 448 | mm02128_Casr | TTCCTCGTGACTTCTCACGA |
| SEQ ID NO: 449 | mm02145_Cav1 | CAAGCATCTCAACGACGACG |
| SEQ ID NO: 450 | mm02146_Cav1 | ATGTGATTGCAGAACCAGAA |
| SEQ ID NO: 451 | mm02147_Cav1 | CGAAGATCGTAGACAACAAG |
| SEQ ID NO: 452 | mm02148_Cav1 | AGTGTATGACGCGCACACCA |
| SEQ ID NO: 453 | mm02149_Cav2 | GCAGATCCACACTTTGTCAA |
| SEQ ID NO: 454 | mm02150_Cav2 | AGATGAGAGTTGAGCTGGTG |
| SEQ ID NO: 455 | mm02151_Cav2 | CTGCGTAGTCAACGCCACTG |
| SEQ ID NO: 456 | mm02152_Cav2 | ATACCCGCAATGAAGGCCAA |
| SEQ ID NO: 457 | mm02153_Cav3 | CCAGCAGTGTAGACAACAGG |
| SEQ ID NO: 458 | mm02154_Cav3 | CCATACACCGTCGAAGCTGT |
| SEQ ID NO: 459 | mm02155_Cav3 | CGACCCCAAGAACATCAATG |
| SEQ ID NO: 460 | mm02156_Cav3 | TCACTGCAAGGAGATAGACT |
| SEQ ID NO: 461 | mm02201_Serpinh1 | TGGGTGTTACGATGATGCAC |
| SEQ ID NO: 462 | mm02202_Serpinh1 | CATCGCCTGATATAGGCTGA |
| SEQ ID NO: 463 | mm02203_Serpinh1 | AGACTCACGCTTAAAGAACA |

TABLE 1-continued mmSurf sgRNA library sequences

| SEQ ID NO | id_gRNA Target | Sequence |
|---|---|---|
| SEQ ID NO: 464 | mm02204_Serpinh1 | CGGAGCTGGGCCCGTACAGG |
| SEQ ID NO: 465 | mm02249_Cckbr | GATGGCCGCGAGATTTAGAG |
| SEQ ID NO: 466 | mm02250_Cckbr | AGCCGGGTCCGAAACCAAGG |
| SEQ ID NO: 467 | mm02251_Cckbr | CGAAGATGAATGTGCCCATG |
| SEQ ID NO: 468 | mm02252_Cckbr | CCCGGTTCCGCGGATACGAG |
| SEQ ID NO: 469 | mm02313_Ccr6 | ACTGATGAAAGGCACATATG |
| SEQ ID NO: 470 | mm02314_Ccr6 | TCTGAGACAGACCTGTACCG |
| SEQ ID NO: 471 | mm02315_Ccr6 | AGAGGTCAGAAACTTCACCA |
| SEQ ID NO: 472 | mm02316_Ccr6 | AGATTTGGTTGCCTGGACGA |
| SEQ ID NO: 473 | mm02349_Cd14 | AATCCGACTAGGAATCCGCG |
| SEQ ID NO: 474 | mm02350_Cd14 | GCAGATGTGGAATTGTACGG |
| SEQ ID NO: 475 | mm02351_Cd14 | TTGCCCACGACACGTTGCGG |
| SEQ ID NO: 476 | mm02352_Cd14 | TGGAGGGTCGGGAACTTGAG |
| SEQ ID NO: 477 | mm02353_Cd151 | TACCTGCTGATAATAGACAT |
| SEQ ID NO: 478 | mm02354_Cd151 | TACCACCAGTCAGGCCACGA |
| SEQ ID NO: 479 | mm02355_Cd151 | AGCCACGGCCTACATCTTAG |
| SEQ ID NO: 480 | mm02356_Cd151 | GACTAATGTAGTCACTCTTG |
| SEQ ID NO: 481 | mm02357_Ctla4 | TGTGATGGTGAATATTCACA |
| SEQ ID NO: 482 | mm02358_Ctla4 | GGACTGAGAGCTGTTGACAC |
| SEQ ID NO: 483 | mm02359_Ctla4 | ACAGGTGACCCAACCTTCAG |
| SEQ ID NO: 484 | mm02360_Ctla4 | TGCCCACAAAGTATGGCGGT |
| SEQ ID NO: 485 | mm02361_Cd19 | GAATGACTGACCCCGCCAGG |
| SEQ ID NO: 486 | mm02362_Cd19 | AATGTCTCAGACCATATGGG |
| SEQ ID NO: 487 | mm02363_Cd19 | GGCACCTATTATTGTCTCCG |
| SEQ ID NO: 488 | mm02364_Cd19 | TTTAGCCCACACATACAGCT |
| SEQ ID NO: 489 | mm02365_Cd1d1 | GGAGACCACGGACAAATAGG |
| SEQ ID NO: 490 | mm02366_Cd1d1 | CTGGTCCCGCACAGACAGCG |
| SEQ ID NO: 491 | mm02367_Cd1d1 | AAATATGTCGTGAGATTCTG |
| SEQ ID NO: 492 | mm02368_Cd1d1 | TGGCTTCGTGAAGCTGATGG |
| SEQ ID NO: 493 | mm02369_Cd2 | CCGATGATGAGAAACGACAG |
| SEQ ID NO: 494 | mm02370_Cd2 | GAACGCACCATTCAAGTGTG |
| SEQ ID NO: 495 | mm02371_Cd2 | TGATATTGATGAGGTGCGAT |
| SEQ ID NO: 496 | mm02372_Cd2 | AGAGACAATGAGACCATCTG |
| SEQ ID NO: 497 | mm02373_Ms4a1 | GTTACAGTACTGTGTAGATG |
| SEQ ID NO: 498 | mm02374_Ms4a1 | TACCATACACTCAAACAGAT |
| SEQ ID NO: 499 | mm02375_Ms4a1 | CAGTCGTAGATATCAACATA |
| SEQ ID NO: 500 | mm02376_Ms4a1 | CCACACAAAGCTTCTTCATG |
| SEQ ID NO: 501 | mm02377_Cd22 | GTAATTCCCAGCATGCCACG |

TABLE 1-continued mmSurf sgRNA library sequences

| SEQ ID NO | id_gRNA Target | Sequence |
|---|---|---|
| SEQ ID NO: 502 | mm02378_Cd22 | CGATACGTGCCAATGACAGT |
| SEQ ID NO: 503 | mm02379_Cd22 | CAGCGCGGATCTCTGATGCG |
| SEQ ID NO: 504 | mm02380_Cd22 | GTACAAAACTCCACTACCCA |
| SEQ ID NO: 505 | mm02381_Cd24a | GAACAGGGTCTCACCTGCGT |
| SEQ ID NO: 506 | mm02382_Cd24a | GCAGAAATATTCTGGTTACC |
| SEQ ID NO: 507 | mm02383_Cd24a | GAAACGGTGCAACAGATGTT |
| SEQ ID NO: 508 | mm02384_Cd24a | GGTAGCGTTACTTGGATTTG |
| SEQ ID NO: 509 | mm02385_Cd28 | TCGGCATTCGAGCGAAACTG |
| SEQ ID NO: 510 | mm02386_Cd28 | GCTTGTGGTAGATAGCAACG |
| SEQ ID NO: 511 | mm02387_Cd28 | CAAGGGCGTGAACAGCGACG |
| SEQ ID NO: 512 | mm02388_Cd28 | TTCCTACAACCTTCTCGCAA |
| SEQ ID NO: 513 | mm02393_Cd33 | CTCCTGACATTATAATCCCG |
| SEQ ID NO: 514 | mm02394_Cd33 | AGGTGTGAACGTCAGCACGG |
| SEQ ID NO: 515 | mm02395_Cd33 | GCCCGAGTCAGTGACAGTCG |
| SEQ ID NO: 516 | mm02396_Cd33 | CTAGTGCAGAAGGCAACACA |
| SEQ ID NO: 517 | mm02397_Cd34 | TGATGTGTAAGCATATGGCT |
| SEQ ID NO: 518 | mm02398_Cd34 | GCTCTGGAATCCGAGAAGTG |
| SEQ ID NO: 519 | mm02399_Cd34 | TGTCCTGATAGATCAAGTAG |
| SEQ ID NO: 520 | mm02400_Cd34 | CTCATTGGTAGGAACTGATG |
| SEQ ID NO: 521 | mm02401_Cd36 | AAATATAACTCAGGACCCCG |
| SEQ ID NO: 522 | mm02402_Cd36 | CCAAAACTGTCTGTACACAG |
| SEQ ID NO: 523 | mm02403_Cd36 | TAGGATATGGAACCAAACTG |
| SEQ ID NO: 524 | mm02404_Cd36 | TTAATCATGTCGCAATAGCT |
| SEQ ID NO: 525 | mm02405_Scarb2 | ATAGAACAGGCCGAAATTCG |
| SEQ ID NO: 526 | mm02406_Scarb2 | AAATAAAACTGGATGTACAC |
| SEQ ID NO: 527 | mm02407_Scarb2 | AATATGATTAACGGGACAGA |
| SEQ ID NO: 528 | mm02408_Scarb2 | ATAATGACACGTACCAACAG |
| SEQ ID NO: 529 | mm02409_Cd37 | CCAAGTCTGCAGTGGCACGA |
| SEQ ID NO: 530 | mm02410_Cd37 | ATCTCCGCGGGACTGGAACA |
| SEQ ID NO: 531 | mm02411_Cd37 | CTGTCTCATCCGGATTCGTG |
| SEQ ID NO: 532 | mm02412_Cd37 | TTTGCCACACAGATTACCCT |
| SEQ ID NO: 533 | mm02413_Cd38 | AGCCCAGATCGGTCTCGGAG |
| SEQ ID NO: 534 | mm02414_Cd38 | TCAAACCATACCATGTAACA |
| SEQ ID NO: 535 | mm02415_Cd38 | GGAGGATCTGAGTGTAGATG |
| SEQ ID NO: 536 | mm02416_Cd38 | CATCAATATACTTGGATCCA |
| SEQ ID NO: 537 | mm02417_Entpd2 | GCCAGCACTCCACTCTACCT |
| SEQ ID NO: 538 | mm02418_Entpd2 | TGGCCACTTGTAGACAAACA |
| SEQ ID NO: 539 | mm02419_Entpd2 | GGACGCTGACCCATAGTGCA |

TABLE 1-continued mmSurf sgRNA library sequences

| SEQ ID NO | id_gRNA Target | Sequence |
|---|---|---|
| SEQ ID NO: 540 | mm02420_Entpd2 | GGGCACCACGGAAGTCAAAG |
| SEQ ID NO: 541 | mm02421_Entpd6 | GGCTGGTTACCTCGACACGT |
| SEQ ID NO: 542 | mm02422_Entpd6 | TCTATGTTGCCTATATCAAG |
| SEQ ID NO: 543 | mm02423_Entpd6 | TTAGACAGGTTACCTCCAGG |
| SEQ ID NO: 544 | mm02424_Entpd6 | ACAAGCTGTACTCCTACAGG |
| SEQ ID NO: 545 | mm02429_Cd3d | TTACACAGATATATCCCTCG |
| SEQ ID NO: 546 | mm02430_Cd3d | TCCATCTAGATGCATGACGC |
| SEQ ID NO: 547 | mm02431_Cd3d | AAGAATAAAACACTCAACTT |
| SEQ ID NO: 548 | mm02432_Cd3d | GATACAAGTGACCGAATATG |
| SEQ ID NO: 549 | mm02433_Cd3e | AGGGCACGTCAACTCTACAC |
| SEQ ID NO: 550 | mm02434_Cd3e | TTCTCGGAAGTCGAGGACAG |
| SEQ ID NO: 551 | mm02435_Cd3e | TACTTGTACCTGAAAGCTCG |
| SEQ ID NO: 552 | mm02436_Cd3e | TCAGAAGCATGATAAGCACC |
| SEQ ID NO: 553 | mm02437_Cd3g | TGACACTGATACGTGCCTCG |
| SEQ ID NO: 554 | mm02438_Cd3g | TTCTGTAATACACTTGCAGG |
| SEQ ID NO: 555 | mm02439_Cd3g | AACTGCATTGAGCTAAACAT |
| SEQ ID NO: 556 | mm02440_Cd3g | GTACAAGTGGATGGCAGCCG |
| SEQ ID NO: 557 | mm02445_Cd4 | TCAAAACGATCAAACTGCGA |
| SEQ ID NO: 558 | mm02446_Cd4 | TATCACGGCCTATAAGAGTG |
| SEQ ID NO: 559 | mm02447_Cd4 | ACTCACCCTCAAGATACCCC |
| SEQ ID NO: 560 | mm02448_Cd4 | TTCTTCTGGGAACTCTCGCA |
| SEQ ID NO: 561 | mm02449_Cd44 | GCAATATGTGTCATAGTGGG |
| SEQ ID NO: 562 | mm02450_Cd44 | TCATGGAGAAAATTGGACCC |
| SEQ ID NO: 563 | mm02451_Cd44 | TCTGTGCGGGCAGAAACCCG |
| SEQ ID NO: 564 | mm02452_Cd44 | CAGTCCGGGAGATACTGTAG |
| SEQ ID NO: 565 | mm02453_Cd48 | ATACGTTTATATGGTCCAAG |
| SEQ ID NO: 566 | mm02454_Cd48 | TCACCTGAGGCTATCGTGTG |
| SEQ ID NO: 567 | mm02455_Cd48 | GAACGAGTTGAAGATAACCC |
| SEQ ID NO: 568 | mm02456_Cd48 | CCTTGAAATCCAGTTCCCAA |
| SEQ ID NO: 569 | mm02457_Cd5 | ACTGCAGAGACTTACAGATG |
| SEQ ID NO: 570 | mm02458_Cd5 | CACTGCTGCCCCCGACCAGG |
| SEQ ID NO: 571 | mm02459_Cd5 | GTGTGCAAACAGCTGAGATG |
| SEQ ID NO: 572 | mm02460_Cd5 | TGAGACACAGCTCCCGTTCG |
| SEQ ID NO: 573 | mm02461_Cd53 | GTTACGGAAGAGTACTCCAT |
| SEQ ID NO: 574 | mm02462_Cd53 | CATTGTGGGATCCATTATCA |
| SEQ ID NO: 575 | mm02463_Cd53 | GCTGATTATTCTCCTTGCTG |
| SEQ ID NO: 576 | mm02464_Cd53 | AATGACTCACCGACATAAGC |
| SEQ ID NO: 577 | mm02465_Cd59a | TGGAAACAATCAGATTGTCA |

TABLE 1-continued mmSurf sgRNA library sequences

| SEQ ID NO | id_gRNA Target | Sequence |
|---|---|---|
| SEQ ID NO: 578 | mm02466_Cd59a | AAACCACCGGTTGGAAACAG |
| SEQ ID NO: 579 | mm02467_Cd59a | CAGGAATGCAAGTGTATCAA |
| SEQ ID NO: 580 | mm02468_Cd59a | TAGAGACAGGAATCCTGGTC |
| SEQ ID NO: 581 | mm02469_Cd6 | GCAGCGCCGGGAATACGACG |
| SEQ ID NO: 582 | mm02470_Cd6 | GAGCCAAAGGACAATACGGT |
| SEQ ID NO: 583 | mm02471_Cd6 | AGCAGTTCACCTGATCGCGG |
| SEQ ID NO: 584 | mm02472_Cd6 | AATACCTGAGCAGACAACCC |
| SEQ ID NO: 585 | mm02473_Cd63 | CCCCGCACTACTCACGCAGA |
| SEQ ID NO: 586 | mm02474_Cd63 | CCTTCCTAGAATAACTGCTG |
| SEQ ID NO: 587 | mm02475_Cd63 | GACAGGAAGATGGCAAACTG |
| SEQ ID NO: 588 | mm02476_Cd63 | ATTACCCATGAGACTACTGC |
| SEQ ID NO: 589 | mm02481_Cd69 | GTGGGCAAGTACAATTGCCC |
| SEQ ID NO: 590 | mm02482_Cd69 | CAAAATGTATACTGGTGCCA |
| SEQ ID NO: 591 | mm02483_Cd69 | CATTCTTGCAGGTAGCAACA |
| SEQ ID NO: 592 | mm02484_Cd69 | ATGAGTGGATTTCATACAAG |
| SEQ ID NO: 593 | mm02489_Cd72 | GGGTAAGACTACGCACAGCG |
| SEQ ID NO: 594 | mm02490_Cd72 | GCATCTAACCATCTAGGACA |
| SEQ ID NO: 595 | mm02491_Cd72 | GTCCTGTCTGATGTTAGGGG |
| SEQ ID NO: 596 | mm02492_Cd72 | AGGGAGAAGATAAGTCAGCT |
| SEQ ID NO: 597 | mm02493_Cd79a | GGAACCCTAATATCACATGG |
| SEQ ID NO: 598 | mm02494_Cd79a | CCTACTCACTGCGCACGCGG |
| SEQ ID NO: 599 | mm02495_Cd79a | CGAAGTAAACAAGAACCACA |
| SEQ ID NO: 600 | mm02496_Cd79a | AGGCGTATGACAAGAAGAGG |
| SEQ ID NO: 601 | mm02497_Cd80 | TGAGGAGAGTTGTAACGGCA |
| SEQ ID NO: 602 | mm02498_Cd80 | GAAATTGTCGTATTGATGCC |
| SEQ ID NO: 603 | mm02499_Cd80 | CTGGCAAAAACATGACAAAG |
| SEQ ID NO: 604 | mm02500_Cd80 | TGCCCCGGTCTGAAAGGACC |
| SEQ ID NO: 605 | mm02505_Cd82 | TGCCACCAGTAGCCGCGAGG |
| SEQ ID NO: 606 | mm02506_Cd82 | CTGTATCGGTGCTGTCAATG |
| SEQ ID NO: 607 | mm02507_Cd82 | GAAGTAGAAGAGGACCCCTA |
| SEQ ID NO: 608 | mm02508_Cd82 | AGGGGGTGCCTTACGTAGGA |
| SEQ ID NO: 609 | mm02509_Cd83 | GGGCGCTGTGCAAGGCAAGT |
| SEQ ID NO: 610 | mm02510_Cd83 | ACCCGCGATGGCGATGCGGG |
| SEQ ID NO: 611 | mm02511_Cd83 | CAAGCAAAACAGCTCCTTCG |
| SEQ ID NO: 612 | mm02512_Cd83 | CACACTCTCAGTGCCACTCT |
| SEQ ID NO: 613 | mm02513_Cd84 | GAATCCCATTCATTACCACC |
| SEQ ID NO: 614 | mm02514_Cd84 | CATAGATCAGAAGTATGACC |
| SEQ ID NO: 615 | mm02515_Cd84 | AGGAGCTGGTTACCTGTACA |

TABLE 1-continued mmSurf sgRNA library sequences

| SEQ ID NO | id_gRNA Target | Sequence |
|---|---|---|
| SEQ ID NO: 616 | mm02516_Cd84 | ATAACTTACGGTAGATATGA |
| SEQ ID NO: 617 | mm02517_Cd86 | AGTGTGAATGCCAAGTACCT |
| SEQ ID NO: 618 | mm02518_Cd86 | TTGACCTGCACGTCTAAGCA |
| SEQ ID NO: 619 | mm02519_Cd86 | TCTGCCGTGCCCATTTACAA |
| SEQ ID NO: 620 | mm02520_Cd86 | TGGAGGATAATTGATCCTGT |
| SEQ ID NO: 621 | mm02521_Cd8a | TGGGTGAGTCGATTATCCTG |
| SEQ ID NO: 622 | mm02522_Cd8a | ATCCCACAACAAGATAACGT |
| SEQ ID NO: 623 | mm02523_Cd8a | GTGTTGGGGTCCGTTTCGCA |
| SEQ ID NO: 624 | mm02524_Cd8a | GGACGCCGAACTTGGTCAGA |
| SEQ ID NO: 625 | mm02525_Cd8b1 | ACAGGGACGAAGCTGACTGT |
| SEQ ID NO: 626 | mm02526_Cd8b1 | TGACTTCTACTTCTGCGCGA |
| SEQ ID NO: 627 | mm02527_Cd8b1 | GCTGGTTCAAACCAACCATA |
| SEQ ID NO: 628 | mm02528_Cd8b1 | GGACGAAGGGGTCTGAATGA |
| SEQ ID NO: 629 | mm02529_Cd9 | CAATGGCGAATATCACCAAG |
| SEQ ID NO: 630 | mm02530_Cd9 | AAAGCCATCCATATGGCGGT |
| SEQ ID NO: 631 | mm02531_Cd9 | CTTGTGGGTATAGCCCCAGA |
| SEQ ID NO: 632 | mm02532_Cd9 | TCTTGGTCTGAGAGTCGAAT |
| SEQ ID NO: 633 | mm02573_Cdh1 | ATGATGAAAACGCCAACGGG |
| SEQ ID NO: 634 | mm02574_Cdh1 | CCCTCCAAATCCGATACCTG |
| SEQ ID NO: 635 | mm02575_Cdh1 | GGTGGCTGAGACCTTCATCA |
| SEQ ID NO: 636 | mm02576_Cdh1 | AAATGCCATCATTGGTCGTG |
| SEQ ID NO: 637 | mm02577_Cdh11 | CACCAAGACATTGGACCGAG |
| SEQ ID NO: 638 | mm02578_Cdh11 | AGGACAACCCTATTTCTCGG |
| SEQ ID NO: 639 | mm02579_Cdh11 | TTTGTGATAGAAGAGTACAC |
| SEQ ID NO: 640 | mm02580_Cdh11 | CTGTGAGAGCGATCACCCCA |
| SEQ ID NO: 641 | mm02581_Cdh13 | CCAGCCTGCCGAATTCATCG |
| SEQ ID NO: 642 | mm02582_Cdh13 | GCAGAGATCTCATAGTCCAG |
| SEQ ID NO: 643 | mm02583_Cdh13 | CGCTGTCATCCGCATCACCG |
| SEQ ID NO: 644 | mm02584_Cdh13 | GCAGAACTCGTGATTGTCGG |
| SEQ ID NO: 645 | mm02585_Cdh15 | CCATCGACAAGTTCACCGGG |
| SEQ ID NO: 646 | mm02586_Cdh15 | GTATAATCTGACCTTGCAAG |
| SEQ ID NO: 647 | mm02587_Cdh15 | CTGAGGACGAGCATAGCTGA |
| SEQ ID NO: 648 | mm02588_Cdh15 | CCTTCAAAAGGGTGAAGCA |
| SEQ ID NO: 649 | mm02593_Cdh17 | TCAGTACAACTTAAGTATCG |
| SEQ ID NO: 650 | mm02594_Cdh17 | CTGGAGACAGACATGTCGGT |
| SEQ ID NO: 651 | mm02595_Cdh17 | TGTAGCTTGGATGATTAGGA |
| SEQ ID NO: 652 | mm02596_Cdh17 | TACATAACATCGTTGATTTG |
| SEQ ID NO: 653 | mm02597_Cdh2 | TTACCGAAGGATGTGCACGA |

TABLE 1-continued mmSurf sgRNA library sequences

| SEQ ID NO | id_gRNA Target | Sequence |
| --- | --- | --- |
| SEQ ID NO: 654 | mm02598_Cdh2 | AATGCGGCATACAGAATCAG |
| SEQ ID NO: 655 | mm02599_Cdh2 | TCTGTTGCATATATCGATCG |
| SEQ ID NO: 656 | mm02600_Cdh2 | GTGTTTGAAAGGCCATAAGT |
| SEQ ID NO: 657 | mm02601_Cdh3 | ATGGTGAAGACTCCTTCGGG |
| SEQ ID NO: 658 | mm02602_Cdh3 | ATGGTGAACATGAGGTCGTG |
| SEQ ID NO: 659 | mm02603_Cdh3 | ATCACCTCCCACGATGTGGT |
| SEQ ID NO: 660 | mm02604_Cdh3 | AAACTCCGGAGCGTTATCGT |
| SEQ ID NO: 661 | mm02605_Cdh4 | GGATATGAACGGTAACAAGG |
| SEQ ID NO: 662 | mm02606_Cdh4 | CGTCTACCGAATCATAAGTG |
| SEQ ID NO: 663 | mm02607_Cdh4 | CACCATCAACAGTGAAACAG |
| SEQ ID NO: 664 | mm02608_Cdh4 | CTTGGACTTCAAAGTCGGGG |
| SEQ ID NO: 665 | mm02609_Cdh5 | ACAGACCCCAAACGTAACGA |
| SEQ ID NO: 666 | mm02610_Cdh5 | GCCAACGAACTGGATTCTCG |
| SEQ ID NO: 667 | mm02611_Cdh5 | GCTTACATTGAGTAAAGACG |
| SEQ ID NO: 668 | mm02612_Cdh5 | TCGGGTCGATGCTAACACA |
| SEQ ID NO: 669 | mm02613_Cdh6 | GGATCCGATTATCAGTACGT |
| SEQ ID NO: 670 | mm02614_Cdh6 | CAATGAGCCAATATTCACCA |
| SEQ ID NO: 671 | mm02615_Cdh6 | CTACATCCTACAGATACGGG |
| SEQ ID NO: 672 | mm02616_Cdh6 | CAACATCACAGTGATCGCAA |
| SEQ ID NO: 673 | mm02733_Celsr1 | GTACGGATCACACCAGACGT |
| SEQ ID NO: 674 | mm02734_Celsr1 | GCTGGTGCAGTACTACAACA |
| SEQ ID NO: 675 | mm02735_Celsr1 | AGTCCCGGATAACTGACGGG |
| SEQ ID NO: 676 | mm02736_Celsr1 | CTTTGCTACTCCAATCCGTG |
| SEQ ID NO: 677 | mm02781_Cftr | GCCGTGTGACTGACATACGT |
| SEQ ID NO: 678 | mm02782_Cftr | TTCTAACTGAGACCTTACGC |
| SEQ ID NO: 679 | mm02783_Cftr | GTGGCGATCATGTTGCTGCG |
| SEQ ID NO: 680 | mm02784_Cftr | TATGGAGAGTAAAATATCGT |
| SEQ ID NO: 681 | mm02837_Chl1 | TTGTTAGCCGCAATTATCCG |
| SEQ ID NO: 682 | mm02838_Chl1 | TGAAGAAAACTACGCGACAG |
| SEQ ID NO: 683 | mm02839_Chl1 | GTACAGCCAACAATTTGTTG |
| SEQ ID NO: 684 | mm02840_Chl1 | TGTTGGGTAGACAATGCCAT |
| SEQ ID NO: 685 | mm02861_Chrm4 | CCAGTTCTTGTCCAACCCGG |
| SEQ ID NO: 686 | mm02862_Chrm4 | CATTAAGAAACCTCCACCAG |
| SEQ ID NO: 687 | mm02863_Chrm4 | TGTTCACAAGCATCGACCCG |
| SEQ ID NO: 688 | mm02864_Chrm4 | GGCCTGCCATCTTAGTAGTG |
| SEQ ID NO: 689 | mm02929_Clcn2 | TCTGTTTGACAACCGGACGT |
| SEQ ID NO: 690 | mm02930_Clcn2 | GAAATGAAAACCATCCTTCG |
| SEQ ID NO: 691 | mm02931_Clcn2 | GCCTCCAGGTACAATTCGGT |

TABLE 1-continued mmSurf sgRNA library sequences

| SEQ ID NO | id_gRNA Target | Sequence |
|---|---|---|
| SEQ ID NO: 692 | mm02932_Clcn2 | TGATGTCCTCGACTCGCACC |
| SEQ ID NO: 693 | mm02933_Clcn3 | GGTTGTACCACAATGCACTG |
| SEQ ID NO: 694 | mm02934_Clcn3 | GAGAATTGTGGGGATCGCTG |
| SEQ ID NO: 695 | mm02935_Clcn3 | AGATGACAATTTGTTAGACG |
| SEQ ID NO: 696 | mm02936_Clcn3 | CTAAAAAGAACTCCTCCGAT |
| SEQ ID NO: 697 | mm02941_Clcn5 | GGGCAAGTATCCTGTCGTCG |
| SEQ ID NO: 698 | mm02942_Clcn5 | TAAAAGCAAAGAGTCAACAT |
| SEQ ID NO: 699 | mm02943_Clcn5 | AAAAGAAGGGATATGTACAG |
| SEQ ID NO: 700 | mm02944_Clcn5 | TGGGCATCTACAGTGCCATG |
| SEQ ID NO: 701 | mm02949_Clcnka | AGAACAGGTAAACGCAACTG |
| SEQ ID NO: 702 | mm02950_Clcnka | GTCCCAAAGATGGTGAACCG |
| SEQ ID NO: 703 | mm02951_Clcnka | CAAAGCCGTCGGGGATACTG |
| SEQ ID NO: 704 | mm02952_Clcnka | ATGAAACGGCCCACACCAGG |
| SEQ ID NO: 705 | mm02985_Tpp1 | TGAGTTTCATCGCTATGTAG |
| SEQ ID NO: 706 | mm02986_Tpp1 | TTATGGTAGAAGGTTACCTG |
| SEQ ID NO: 707 | mm02987_Tpp1 | AACCTGACAGCCAAAGATGT |
| SEQ ID NO: 708 | mm02988_Tpp1 | GATCGAGGCCAGTCTAGATG |
| SEQ ID NO: 709 | mm03001_Clu | AGAAATGAGGCCTCTTGTGT |
| SEQ ID NO: 710 | mm03002_Clu | AACATGTTGTGGAAGCTCGG |
| SEQ ID NO: 711 | mm03003_Clu | TTCCTCTAAACTGTTGAGCA |
| SEQ ID NO: 712 | mm03004_Clu | AGATGACCGCACTGTGTGCA |
| SEQ ID NO: 713 | mm03013_Cxcr2 | TGTGGTTGTAATATACGTCC |
| SEQ ID NO: 714 | mm03014_Cxcr2 | GATATTCTCATACGTGAAGG |
| SEQ ID NO: 715 | mm03015_Cxcr2 | TCGTAGAATTAAGATGGGCA |
| SEQ ID NO: 716 | mm03016_Cxcr2 | CAGGTTCAGCAGGTAGACAT |
| SEQ ID NO: 717 | mm03017_Cxcr3 | TGAGGGCTACACGTACCCGG |
| SEQ ID NO: 718 | mm03018_Cxcr3 | AGTTAACACCAGCAGAACAT |
| SEQ ID NO: 719 | mm03019_Cxcr3 | TCTGCGTGTACTGCAGCTAG |
| SEQ ID NO: 720 | mm03020_Cxcr3 | ACTGGCAATGGGTGGCATTG |
| SEQ ID NO: 721 | mm03021_Cxcr4 | ACAGGCTATCGGGGTAAAGG |
| SEQ ID NO: 722 | mm03022_Cxcr4 | TGGTGGCGTGGACAATAGCG |
| SEQ ID NO: 723 | mm03023_Cxcr4 | TCTTCTGGTAACCCATGACC |
| SEQ ID NO: 724 | mm03024_Cxcr4 | TGGAGACTATGACTCCAACA |
| SEQ ID NO: 725 | mm03025_Ccr1 | GAACACTAGAGAATACAGGG |
| SEQ ID NO: 726 | mm03026_Ccr1 | ACGGTGAGTGAACTCCCACT |
| SEQ ID NO: 727 | mm03027_Ccr1 | CAGATTATCATGACTAACAG |
| SEQ ID NO: 728 | mm03028_Ccr1 | AGTAACAGTTCGGGCCCTCA |
| SEQ ID NO: 729 | mm03029_Ccr9 | TGGTATTGCCACATGTACCA |

TABLE 1-continued mmSurf sgRNA library sequences

| SEQ ID NO | id_gRNA Target | Sequence |
|---|---|---|
| SEQ ID NO: 730 | mm03030_Ccr9 | TCTCATCATGTGCATCAGTG |
| SEQ ID NO: 731 | mm03031_Ccr9 | TTGTGCAATACCAGTAGACA |
| SEQ ID NO: 732 | mm03032_Ccr9 | AGGCCATGACCATAAAGGGG |
| SEQ ID NO: 733 | mm03041_Ccr2 | ATCATCGTAGTCATACGGTG |
| SEQ ID NO: 734 | mm03042_Ccr2 | TACACTTGTTATCACCCCAA |
| SEQ ID NO: 735 | mm03043_Ccr2 | GATGATCACCATTACACCTG |
| SEQ ID NO: 736 | mm03044_Ccr2 | CCAGGGAGTAGAGTGGAGGC |
| SEQ ID NO: 737 | mm03045_Ccr4 | GGAGAATACCGCGTGCACGA |
| SEQ ID NO: 738 | mm03046_Ccr4 | ACTCGGTCAACTCGACGACG |
| SEQ ID NO: 739 | mm03047_Ccr4 | CAAGAGGCTCAAGTCCATGA |
| SEQ ID NO: 740 | mm03048_Ccr4 | GGAAGGTATCAAGGCATTTG |
| SEQ ID NO: 741 | mm03049_Ccr5 | AGTCAGAACGGTCAACTTTG |
| SEQ ID NO: 742 | mm03050_Ccr5 | GAATACCAGGGAGTAGAGTG |
| SEQ ID NO: 743 | mm03051_Ccr5 | CAGAAATGATACTGAGTGTG |
| SEQ ID NO: 744 | mm03052_Ccr5 | AGTACCTATCAATTGTCAGG |
| SEQ ID NO: 745 | mm03053_Ccr7 | TTTGGCGTCTACCTGTGTAA |
| SEQ ID NO: 746 | mm03054_Ccr7 | TGACGTACATCTATTTCAAG |
| SEQ ID NO: 747 | mm03055_Ccr7 | TAGGAACCCAAAAACCATCT |
| SEQ ID NO: 748 | mm03056_Ccr7 | AGCGGTCAATGCTGATGCAT |
| SEQ ID NO: 749 | mm03061_Ccr10 | GTGAAGGCCAACGACGCTGT |
| SEQ ID NO: 750 | mm03062_Ccr10 | AGACTGAAACCAAGTGCGCT |
| SEQ ID NO: 751 | mm03063_Ccr10 | CAGGCTGCCATGACGCCCAG |
| SEQ ID NO: 752 | mm03064_Ccr10 | CCATCAGGGAGACACTGGGT |
| SEQ ID NO: 753 | mm03065_Ackr3 | ACACCAAGATGCATACAACA |
| SEQ ID NO: 754 | mm03066_Ackr3 | GCATAACCAGTGGCCCATGG |
| SEQ ID NO: 755 | mm03067_Ackr3 | GGTCCACGCTCATGCAGGCG |
| SEQ ID NO: 756 | mm03068_Ackr3 | CCAACAATGAGACCTACTGC |
| SEQ ID NO: 757 | mm03069_Abcc2 | AAGACCCTGACTCATATCCG |
| SEQ ID NO: 758 | mm03070_Abcc2 | GCATTCGGAAGAAAGAACTC |
| SEQ ID NO: 759 | mm03071_Abcc2 | ACTCGGATCTTGGTTACACA |
| SEQ ID NO: 760 | mm03072_Abcc2 | GTTTAAGACGATCATGACAA |
| SEQ ID NO: 761 | mm03117_Cnr1 | GCTGGATCATGCGAACTGCG |
| SEQ ID NO: 762 | mm03118_Cnr1 | GGCAGGAGACAACTCCCCGT |
| SEQ ID NO: 763 | mm03119_Cnr1 | TGTACCTGTCGATGGCCGTG |
| SEQ ID NO: 764 | mm03120_Cnr1 | AACGAGGACAACATCCAGTG |
| SEQ ID NO: 765 | mm03125_Cntfr | AGACGCTCATACTGCACGTG |
| SEQ ID NO: 766 | mm03126_Cntfr | ATACTGCGAAGCTTAGAACT |
| SEQ ID NO: 767 | mm03127_Cntfr | AACCCACATGTAGAAGGACT |

TABLE 1-continued mmSurf sgRNA library sequences

| SEQ ID NO | id_gRNA Target | Sequence |
|---|---|---|
| SEQ ID NO: 768 | mm03128_Cntfr | GGCCGTAGTGTTGTGACCCA |
| SEQ ID NO: 769 | mm03129_Cntn1 | GATCGGTACAGTATGGTCGG |
| SEQ ID NO: 770 | mm03130_Cntn1 | GTGCACGGCGCAGACAATCG |
| SEQ ID NO: 771 | mm03131_Cntn1 | TACCCTTCAGTATCACAAAG |
| SEQ ID NO: 772 | mm03132_Cntn1 | TGAAGGACCACACAAACGTG |
| SEQ ID NO: 773 | mm03161_Col12a1 | GTTGTGTATCGCCCTCAAGG |
| SEQ ID NO: 774 | mm03162_Col12a1 | CAGAACCTCTGAATACCGTG |
| SEQ ID NO: 775 | mm03163_Col12a1 | GTGGCGAACTTACCATACAA |
| SEQ ID NO: 776 | mm03164_Col12a1 | CAATGTTCGTGACCTTACAG |
| SEQ ID NO: 777 | mm03181_Col2a1 | TGGGACAGCACTCTCCGAAG |
| SEQ ID NO: 778 | mm03182_Col2a1 | ACATGAGATTTACTCACCGG |
| SEQ ID NO: 779 | mm03183_Col2a1 | CTTCTTGTCAGGGTAACCCA |
| SEQ ID NO: 780 | mm03184_Col2a1 | CAGGCTAATAGACTTACAGA |
| SEQ ID NO: 781 | mm03185_Col3a1 | GTTAGCCCTGCAATTCCAAG |
| SEQ ID NO: 782 | mm03186_Col3a1 | GGCAAGAATGGAGAACGGGG |
| SEQ ID NO: 783 | mm03187_Col3a1 | ACATCATATGAGTCGAATTG |
| SEQ ID NO: 784 | mm03188_Col3a1 | GGACTGCCGTTATTCCCGGG |
| SEQ ID NO: 785 | mm03209_Col5a1 | TTGGCGTGCCCGGATTACCG |
| SEQ ID NO: 786 | mm03210_Col5a1 | GGAGTGTAATAGTCATCTGG |
| SEQ ID NO: 787 | mm03211_Col5a1 | TTCAAACCGCCACTCCCAGG |
| SEQ ID NO: 788 | mm03212_Col5a1 | TGGAATTCCGATGGGCCCAG |
| SEQ ID NO: 789 | mm03217_Col6a1 | AGGCAAGCGCGGAATCGACG |
| SEQ ID NO: 790 | mm03218_Col6a1 | GTGGCAATGATACTTAGACG |
| SEQ ID NO: 791 | mm03219_Col6a1 | CAACGACATTTCACCCCGTG |
| SEQ ID NO: 792 | mm03220_Col6a1 | TCATACCCAGGGTCGCCTCG |
| SEQ ID NO: 793 | mm03221_Col6a2 | TGCAGCTGGCTGATAAACTG |
| SEQ ID NO: 794 | mm03222_Col6a2 | TGCAACCAGGAGGCCCAATG |
| SEQ ID NO: 795 | mm03223_Col6a2 | ACCTAAACGAACAAGGCCTG |
| SEQ ID NO: 796 | mm03224_Col6a2 | GGCTGTCCTGAATCCCCTCG |
| SEQ ID NO: 797 | mm03249_Col1a1 | ACTGTCTTACAGGGTAACGT |
| SEQ ID NO: 798 | mm03250_Col1a1 | GGGGCACCATTGTTTCCTCG |
| SEQ ID NO: 799 | mm03251_Col1a1 | ACACTTACACGCTCGCCAGG |
| SEQ ID NO: 800 | mm03252_Col1a1 | GATACTTACAACAGCGCCAG |
| SEQ ID NO: 801 | mm03325_Cp | CATATAAGCATCAATTAGGG |
| SEQ ID NO: 802 | mm03326_Cp | GCTGTGAGGAGCGACCTGGT |
| SEQ ID NO: 803 | mm03327_Cp | ATGAAAAGTGTAGATCCTAG |
| SEQ ID NO: 804 | mm03328_Cp | GCTGAACAAATACCACACGA |
| SEQ ID NO: 805 | mm03329_Cpa3 | GAGATTCCTTCTCACTAACT |

TABLE 1-continued mmSurf sgRNA library sequences

| SEQ ID NO | id_gRNA Target | Sequence |
|---|---|---|
| SEQ ID NO: 806 | mm03330_Cpa3 | ACCATGCCTCAATGTCTACA |
| SEQ ID NO: 807 | mm03331_Cpa3 | GAACTTGACCCAAAGCATTG |
| SEQ ID NO: 808 | mm03332_Cpa3 | GAGGTCAGTGCCAATGCAGG |
| SEQ ID NO: 809 | mm03333_Cpd | GCTGGGCAGCAAATACACGT |
| SEQ ID NO: 810 | mm03334_Cpd | TGGCGCGCACTGGTATGACG |
| SEQ ID NO: 811 | mm03335_Cpd | ATGGAGATATCTGATAACCC |
| SEQ ID NO: 812 | mm03336_Cpd | TTTGAAGTAACTATCGAACT |
| SEQ ID NO: 813 | mm03337_Cpe | TCATCGTCATTCTTGCGACA |
| SEQ ID NO: 814 | mm03338_Cpe | CGGCTTTCTCAAAGCCGTCG |
| SEQ ID NO: 815 | mm03339_Cpe | TTTGGAAAATTGCGTCATCA |
| SEQ ID NO: 816 | mm03340_Cpe | CTTTCTGGTACTCGTTACAC |
| SEQ ID NO: 817 | mm03377_Cr2 | ATGTTGACCAGTTTGTTGCG |
| SEQ ID NO: 818 | mm03378_Cr2 | CTATACATTGCACCCCTGAG |
| SEQ ID NO: 819 | mm03379_Cr2 | AGACGGATTTCTATAAACCA |
| SEQ ID NO: 820 | mm03380_Cr2 | ATGCAATGCTCATGGCACAT |
| SEQ ID NO: 821 | mm03429_Crhr1 | GAGCTGGACCACAAACCACG |
| SEQ ID NO: 822 | mm03430_Crhr1 | GGTGGAGTACGTGAGTACGA |
| SEQ ID NO: 823 | mm03431_Crhr1 | GGCACTCAGAATAATTCACA |
| SEQ ID NO: 824 | mm03432_Crhr1 | CCTGCAGTGCAATGCCTCCG |
| SEQ ID NO: 825 | mm03449_Crlf1 | CGGTCAGGATAACACATGTG |
| SEQ ID NO: 826 | mm03450_Crlf1 | GTGCACGTGAGCCGCGTTGG |
| SEQ ID NO: 827 | mm03451_Crlf1 | GTGGAAGCCACCAATCGCCT |
| SEQ ID NO: 828 | mm03452_Crlf1 | ATCCGCCCCGAGGCACCCCG |
| SEQ ID NO: 829 | mm03489_Crll | TTGTTGAGTTCAATGCACTG |
| SEQ ID NO: 830 | mm03490_Crll | ATGCCTGGGGGTATCTCACA |
| SEQ ID NO: 831 | mm03491_Crll | TTAATTATACTTGTAATCAA |
| SEQ ID NO: 832 | mm03492_Crll | AAGGCGCTCTTTAACCTGGT |
| SEQ ID NO: 833 | mm03513_Cryab | AGTCCGGTGTCAATCCAGCT |
| SEQ ID NO: 834 | mm03514_Cryab | CTCTTGGATTAGGACGAACA |
| SEQ ID NO: 835 | mm03515_Cryab | CTCCGAAGAACTGGTCGAAG |
| SEQ ID NO: 836 | mm03516_Cryab | GGGGACGTGATTGAGGTCCA |
| SEQ ID NO: 837 | mm03577_Csf1 | TTTGCTAAGTGCTCTAGCCG |
| SEQ ID NO: 838 | mm03578_Csf1 | TCCATTCCCTAAATCAACAG |
| SEQ ID NO: 839 | mm03579_Csf1 | GTGCCAAGCAGCGACCACCC |
| SEQ ID NO: 840 | mm03580_Csf1 | GGTGTCCATTCCCAATCATG |
| SEQ ID NO: 841 | mm03581_Csf1r | GATAACGTTGAATCCCACTT |
| SEQ ID NO: 842 | mm03582_Csf1r | AAGATCATCGAGAGATACGA |
| SEQ ID NO: 843 | mm03583_Csf1r | TTCAAGCTCGGTACAACGGT |

TABLE 1-continued mmSurf sgRNA library sequences

| SEQ ID NO | id_gRNA Target | Sequence |
|---|---|---|
| SEQ ID NO: 844 | mm03584_Csf1r | CGGATAATGAACCCTCGCCA |
| SEQ ID NO: 845 | mm03589_Csf2ra | AGGACGCGGTGACGTCACGT |
| SEQ ID NO: 846 | mm03590_Csf2ra | CCTACTTGGTCGTGACCGGT |
| SEQ ID NO: 847 | mm03591_Csf2ra | CTAGCGTCACTAACCCAGAA |
| SEQ ID NO: 848 | mm03592_Csf2ra | TGACATCCAGCGTGACACCG |
| SEQ ID NO: 849 | mm03641_Vcan | GGCTTGTTTGGATATCGGGG |
| SEQ ID NO: 850 | mm03642_Vcan | TGTTAATTATAGTAGCACGC |
| SEQ ID NO: 851 | mm03643_Vcan | TTTCCATGGATGTTACTAAG |
| SEQ ID NO: 852 | mm03644_Vcan | TATGTCTAGTACAGTACTCG |
| SEQ ID NO: 853 | mm03645_Ncan | CACCCCCTCACCGAACCGTG |
| SEQ ID NO: 854 | mm03646_Ncan | GGGAGATTGTGTCAGCAGAG |
| SEQ ID NO: 855 | mm03647_Ncan | TGGGCTGTATCGCTGCCAAG |
| SEQ ID NO: 856 | mm03648_Ncan | TTGGGGACAAGTGTAGAGCG |
| SEQ ID NO: 857 | mm03653_Csrp1 | CTGGGCGGTACTCACTACAC |
| SEQ ID NO: 858 | mm03654_Csrp1 | GCACGCTGAGCACAGACAAG |
| SEQ ID NO: 859 | mm03655_Csrp1 | TTCTCCATGCACTGCCACGG |
| SEQ ID NO: 860 | mm03656_Csrp1 | TAGACCGCCTGGCTACAGCG |
| SEQ ID NO: 861 | mm03673_Cst8 | TTGACAGATCACAGACCGAA |
| SEQ ID NO: 862 | mm03674_Cst8 | CCAAACACACTGCTTCACAT |
| SEQ ID NO: 863 | mm03675_Cst8 | CATGGAGTATCTTGTCCACA |
| SEQ ID NO: 864 | mm03676_Cst8 | TCAGTCCAAGAATGAAGTGA |
| SEQ ID NO: 865 | mm03713_Ctsb | CAATGGCCGAGTCAACGTGG |
| SEQ ID NO: 866 | mm03714_Ctsb | TTGACATGGTGCTCGCAGGG |
| SEQ ID NO: 867 | mm03715_Ctsb | TCCTCACCGAACGCAACCCT |
| SEQ ID NO: 868 | mm03716_Ctsb | TGTAGACTCCACCTGAAACC |
| SEQ ID NO: 869 | mm03717_Ctsc | CTGCAAGATACAACCTCCTG |
| SEQ ID NO: 870 | mm03718_Ctsc | GGCAGTAACTGATAGCTGTG |
| SEQ ID NO: 871 | mm03719_Ctsc | TCACAACCACAACTTTGTGA |
| SEQ ID NO: 872 | mm03720_Ctsc | CTGTATTTCATCAGTCATCG |
| SEQ ID NO: 873 | mm03721_Ctsd | TATCCGTCGGACTATGACGG |
| SEQ ID NO: 874 | mm03722_Ctsd | TGACTCCAAGTACTACCACG |
| SEQ ID NO: 875 | mm03723_Ctsd | GACTGTGAAACACTGCGGCG |
| SEQ ID NO: 876 | mm03724_Ctsd | ACGTCCTTTGACATCCACTA |
| SEQ ID NO: 877 | mm03741_Ctsl | TTGGGGATCTTAAGCATCAG |
| SEQ ID NO: 878 | mm03742_Ctsl | AATGATCCAGCTACACAACG |
| SEQ ID NO: 879 | mm03743_Ctsl | CAATTACCTTCGCTTCATAG |
| SEQ ID NO: 880 | mm03744_Ctsl | TTAGTGCAGAGTGGCACCAG |
| SEQ ID NO: 881 | mm03745_Ctss | GAAGAAATCTTGTGTCGGAT |

TABLE 1-continued mmSurf sgRNA library sequences

| SEQ ID NO | id_gRNA Target | Sequence |
|---|---|---|
| SEQ ID NO: 882 | mm03746_Ctss | CACCGTGGCTTTGTAGGGAT |
| SEQ ID NO: 883 | mm03747_Ctss | GAGATCCCAATGGTAGTCCA |
| SEQ ID NO: 884 | mm03748_Ctss | ATCGTTCATGCCCACTTGGT |
| SEQ ID NO: 885 | mm03773_Cxadr | GCATCACTACACCCGAACAG |
| SEQ ID NO: 886 | mm03774_Cxadr | ACTCTCAGTCCCGAAGACCA |
| SEQ ID NO: 887 | mm03775_Cxadr | AACTACTATCCGGATCTGAA |
| SEQ ID NO: 888 | mm03776_Cxadr | ACGCTAGCCTCCAACCGAGC |
| SEQ ID NO: 889 | mm03817_Cyp1a2 | CAATGGCGGTCTCATCCCCG |
| SEQ ID NO: 890 | mm03818_Cyp1a2 | GCACTACCAAGACTTCAACA |
| SEQ ID NO: 891 | mm03819_Cyp1a2 | GAACATCGTGAATAACAGCA |
| SEQ ID NO: 892 | mm03820_Cyp1a2 | CTTCGAACCAGTCAGCCAGG |
| SEQ ID NO: 893 | mm03977_Cd55 | CTCTTATACGTATAGCCAGG |
| SEQ ID NO: 894 | mm03978_Cd55 | CTGCTGTCCCCAACTGTACG |
| SEQ ID NO: 895 | mm03979_Cd55 | TGTGACAGAACAGAAAGTAG |
| SEQ ID NO: 896 | mm03980_Cd55 | CGAAAACAACCTCCACTCCC |
| SEQ ID NO: 897 | mm03985_Dag1 | TGGTTAGGTTCTCCCCCACG |
| SEQ ID NO: 898 | mm03986_Dag1 | GTCTGGAATGCCAACCACGG |
| SEQ ID NO: 899 | mm03987_Dag1 | GACCTCGATAGAGAACACAC |
| SEQ ID NO: 900 | mm03988_Dag1 | GGCGTAGGCACTATCCGCGA |
| SEQ ID NO: 901 | mm04005_Slc6a3 | TAGATGATGAAGATCAACCC |
| SEQ ID NO: 902 | mm04006_Slc6a3 | GCTCGTCAGGGAGTTAATGG |
| SEQ ID NO: 903 | mm04007_Slc6a3 | CAGGGAGGGTGACTCCACGC |
| SEQ ID NO: 904 | mm04008_Slc6a3 | TTACTCAAAATACTCAGCAG |
| SEQ ID NO: 905 | mm04049_Dcc | GCAAAGGATAATAATCAACG |
| SEQ ID NO: 906 | mm04050_Dcc | CACCTGGTTACGAGGCGAGG |
| SEQ ID NO: 907 | mm04051_Dcc | CACAGAAAGACTACCCGCAG |
| SEQ ID NO: 908 | mm04052_Dcc | AACCCATGCCAACAATACAC |
| SEQ ID NO: 909 | mm04061_Dcn | TAGATATCAGGGGATTGTCA |
| SEQ ID NO: 910 | mm04062_Dcn | TTGAGGGATCGCAGTTATGT |
| SEQ ID NO: 911 | mm04063_Dcn | TAGGTTTGGACAAAGTGCCC |
| SEQ ID NO: 912 | mm04064_Dcn | CCTGTCTAAGAACCAACTAA |
| SEQ ID NO: 913 | mm04193_Dgcr2 | GGGCAGTTTGCATGTCACGG |
| SEQ ID NO: 914 | mm04194_Dgcr2 | AGAGGCCCGTCCTTATGGGA |
| SEQ ID NO: 915 | mm04195_Dgcr2 | TTCCTAGGGAAATGCCCAAG |
| SEQ ID NO: 916 | mm04196_Dgcr2 | CGGTACTGCTGACACCCCTG |
| SEQ ID NO: 917 | mm04249_Dlk1 | CCTAACCCATGCGAGAACGA |
| SEQ ID NO: 918 | mm04250_Dlk1 | TATTTACCCATTGATCACGC |
| SEQ ID NO: 919 | mm04251_Dlk1 | CCTCGCAGAATCCATACTGG |

TABLE 1-continued mmSurf sgRNA library sequences

| SEQ ID NO | id_gRNA Target | Sequence |
|---|---|---|
| SEQ ID NO: 920 | mm04252_Dlk1 | CACGTGGGACCCATGAACGG |
| SEQ ID NO: 921 | mm04297_Dmd | AAGGCATAACTCTTGAATCG |
| SEQ ID NO: 922 | mm04298_Dmd | CATGGATGAACTGATCAATG |
| SEQ ID NO: 923 | mm04299_Dmd | AGGACCGTTTGACATAAAGG |
| SEQ ID NO: 924 | mm04300_Dmd | AGAATGTACAAGGAACGACA |
| SEQ ID NO: 925 | mm04305_Tmc1 | TGCCGTACGGTAAACCCCAG |
| SEQ ID NO: 926 | mm04306_Tmc1 | TGAAGGCCAATATTACCCTG |
| SEQ ID NO: 927 | mm04307_Tmc1 | TTCAGCAAATAAGTCAAACA |
| SEQ ID NO: 928 | mm04308_Tmc1 | TGAAGTTCTCAAAATCTCGG |
| SEQ ID NO: 929 | mm04401_Dpep1 | TCACCCGTCGATGACCGGTG |
| SEQ ID NO: 930 | mm04402_Dpep1 | GACAACTGGCTTGTGGACAG |
| SEQ ID NO: 931 | mm04403_Dpep1 | AGTGGCCAGTCTGATCGGCG |
| SEQ ID NO: 932 | mm04404_Dpep1 | ATGTATGCGGACCAGAACTG |
| SEQ ID NO: 933 | mm04413_Dpp4 | CTACGATGTAGAGTGTAGAG |
| SEQ ID NO: 934 | mm04414_Dpp4 | CTTGGAATACAACTACGTGA |
| SEQ ID NO: 935 | mm04415_Dpp4 | GTCGATGTGATCCTATGACT |
| SEQ ID NO: 936 | mm04416_Dpp4 | TAGAAGGAGTATTCAATGAG |
| SEQ ID NO: 937 | mm04417_Dpp6 | GTGACCACCAATGAGCGATG |
| SEQ ID NO: 938 | mm04418_Dpp6 | GCGGAGCGACTGTGACGAGG |
| SEQ ID NO: 939 | mm04419_Dpp6 | TTTGCCTTCTATTAACACCG |
| SEQ ID NO: 940 | mm04420_Dpp6 | GGTGTTATGCACAGTAACAG |
| SEQ ID NO: 941 | mm04473_Dsc2 | TGGTGTGATCACTACCACGT |
| SEQ ID NO: 942 | mm04474_Dsc2 | GCATTGGAGGGATACACTCG |
| SEQ ID NO: 943 | mm04475_Dsc2 | TCTTACCTGCATCTAACGCA |
| SEQ ID NO: 944 | mm04476_Dsc2 | TCATCTCACTTACCTCTACT |
| SEQ ID NO: 945 | mm04489_Dsg2 | GTCTTCAACAGTGATAACGA |
| SEQ ID NO: 946 | mm04490_Dsg2 | TCTGTGTGTCAGTCTCAATG |
| SEQ ID NO: 947 | mm04491_Dsg2 | GAAGTGGAAAATAACGCACC |
| SEQ ID NO: 948 | mm04492_Dsg2 | TCAAAGACGAATATGCCGAA |
| SEQ ID NO: 949 | mm04505_Slc26a2 | GAGCCGACACCATGACTCCG |
| SEQ ID NO: 950 | mm04506_Slc26a2 | ATGGCCGGAGAGCTTTCCGT |
| SEQ ID NO: 951 | mm04507_Slc26a2 | ACTGTGCCTTATGATTGGTG |
| SEQ ID NO: 952 | mm04508_Slc26a2 | TCCAAAATGAGAAGCCAATG |
| SEQ ID NO: 953 | mm04613_Ecel1 | CCTGTCCTCACCATTCCGAG |
| SEQ ID NO: 954 | mm04614_Ecel1 | CCTGTACCTAGCTCAAGACG |
| SEQ ID NO: 955 | mm04615_Ecel1 | ACCTCGCGTCGATTCCAGCG |
| SEQ ID NO: 956 | mm04616_Ecel1 | GCTTGTCGTCGGGGATAGCG |
| SEQ ID NO: 957 | mm04617_Ecm1 | CAAGCTTCAAACAGTCTAGG |

TABLE 1-continued mmSurf sgRNA library sequences

| SEQ ID NO | id_gRNA Target | Sequence |
|---|---|---|
| SEQ ID NO: 958 | mm04618_Ecm1 | GCCAGTCTTCCTCGTACACA |
| SEQ ID NO: 959 | mm04619_Ecm1 | GTCCGGTGTGGGCAACCCCG |
| SEQ ID NO: 960 | mm04620_Ecm1 | GCTCTGGCGTCATCTCTCGC |
| SEQ ID NO: 961 | mm04629_Ect2 | AGCATACTCGTACAATACAG |
| SEQ ID NO: 962 | mm04630_Ect2 | TAGGAGTGTATATTACCTTG |
| SEQ ID NO: 963 | mm04631_Ect2 | AGAATGGATTTATAAAGCGT |
| SEQ ID NO: 964 | mm04632_Ect2 | ACTTCTAGAAGACTTAGCAC |
| SEQ ID NO: 965 | mm04641_S1pr1 | GTCCGGCATTACAACTACAC |
| SEQ ID NO: 966 | mm04642_S1pr1 | GCCTGCTAATAGGTCCGAGA |
| SEQ ID NO: 967 | mm04643_S1pr1 | CTGAAGATGAAACTACACAA |
| SEQ ID NO: 968 | mm04644_S1pr1 | GGCAGGTGTGAGCTTGTAAG |
| SEQ ID NO: 969 | mm04645_S1pr3 | GGGAACATTACGATTACGTG |
| SEQ ID NO: 970 | mm04646_S1pr3 | AATCACTACGGTCCGCAGAA |
| SEQ ID NO: 971 | mm04647_S1pr3 | GCCAGCACATCCCAATCAGA |
| SEQ ID NO: 972 | mm04648_S1pr3 | GCGCGCATACAAGATGACGA |
| SEQ ID NO: 973 | mm04649_S1pr4 | CAGCAGCACGTTGACCACGT |
| SEQ ID NO: 974 | mm04650_S1pr4 | ACATAGCCCTTGGAGTAGAG |
| SEQ ID NO: 975 | mm04651_S1pr4 | GATTGTAGTGCAGGACAATG |
| SEQ ID NO: 976 | mm04652_S1pr4 | CTCTAAAGATGGCCCCGTAG |
| SEQ ID NO: 977 | mm04669_Ednra | CCTTGGAGACCTTATCTACG |
| SEQ ID NO: 978 | mm04670_Ednra | GAGAGCACAGAGGTTCAAGA |
| SEQ ID NO: 979 | mm04671_Ednra | AAGGGGTGAAGTCTTCCATG |
| SEQ ID NO: 980 | mm04672_Ednra | CCTAGCAATGGCTCAATGCA |
| SEQ ID NO: 981 | mm04673_Ednrb | TCAATATTTCGTTGGCACGG |
| SEQ ID NO: 982 | mm04674_Ednrb | GTAGATGATTCTTAGCAGCG |
| SEQ ID NO: 983 | mm04675_Ednrb | ATGATTACGTCGGACTACAA |
| SEQ ID NO: 984 | mm04676_Ednrb | GTCACTTCTCGGGACTAAAG |
| SEQ ID NO: 985 | mm04693_Eef2 | GTTGTGAGCTGCTATACGAG |
| SEQ ID NO: 986 | mm04694_Eef2 | CCTACGGCGAGGGCGAGAGT |
| SEQ ID NO: 987 | mm04695_Eef2 | CCGATTGAGGACGTGCCATG |
| SEQ ID NO: 988 | mm04696_Eef2 | AGTCAGCCAATAGCCCAGAT |
| SEQ ID NO: 989 | mm04705_Efna2 | GGTTCCAGTAGACTGCGTAT |
| SEQ ID NO: 990 | mm04706_Efna2 | TATCTACTGCCCACACTACG |
| SEQ ID NO: 991 | mm04707_Efna2 | GCCGCTGCGTGCGCGCAACG |
| SEQ ID NO: 992 | mm04708_Efna2 | TGGCGGCGGCTATACCGTGG |
| SEQ ID NO: 993 | mm04709_Efna3 | TGTTCCAGTATACCGCATGC |
| SEQ ID NO: 994 | mm04710_Efna3 | AGTAGTATTCTTGGCCGGCA |
| SEQ ID NO: 995 | mm04711_Efna3 | GGCCCTGAGCTGTTGTAGTG |

TABLE 1-continued mmSurf sgRNA library sequences

| SEQ ID NO | id_gRNA Target | Sequence |
|---|---|---|
| SEQ ID NO: 996 | mm04712_Efna3 | CTGTACATGGTGAACCTGAG |
| SEQ ID NO: 997 | mm04717_Efna5 | TGTTCCAGTAGACGGCGTAG |
| SEQ ID NO: 998 | mm04718_Efna5 | GGACAGAGTCCTCATAGTGA |
| SEQ ID NO: 999 | mm04719_Efna5 | TCCGTTGTCTGGGATTGCAG |
| SEQ ID NO: 1000 | mm04720_Efna5 | TGAGCGCTACGTCCTGTACA |
| SEQ ID NO: 1001 | mm04721_Efnb1 | CACATGTAATGTAGTAATCG |
| SEQ ID NO: 1002 | mm04722_Efnb1 | ATCGTTATGAAGGTTGGGCA |
| SEQ ID NO: 1003 | mm04723_Efnb1 | TACAGCTTGTAGTACTCGTA |
| SEQ ID NO: 1004 | mm04724_Efnb1 | CAGGTTCTTGGCCAACGGCG |
| SEQ ID NO: 1005 | mm04729_Efnb3 | GGAGGGACACCATACCAGGT |
| SEQ ID NO: 1006 | mm04730_Efnb3 | GGAGGCGTGTGCCTAACCAG |
| SEQ ID NO: 1007 | mm04731_Efnb3 | GGGGACAAAGTAGATCTAGC |
| SEQ ID NO: 1008 | mm04732_Efnb3 | AATTATGTAGTAATCGTGGT |
| SEQ ID NO: 1009 | mm04749_Egfr | ACCAGACAGTCACTCTCTCG |
| SEQ ID NO: 1010 | mm04750_Egfr | TGGGCCTGACTACTACGAAG |
| SEQ ID NO: 1011 | mm04751_Egfr | CATGAATAGGCCAATCCCAA |
| SEQ ID NO: 1012 | mm04752_Egfr | GAGAACCTAGAAATAATACG |
| SEQ ID NO: 1013 | mm04753_Rhbdf1 | ATTCACGTTTGCGACGCCGA |
| SEQ ID NO: 1014 | mm04754_Rhbdf1 | GATGTCCACGTACCCAGATG |
| SEQ ID NO: 1015 | mm04755_Rhbdf1 | CACCACCTCCCCTCTACGTG |
| SEQ ID NO: 1016 | mm04756_Rhbdf1 | CTTCACCCACACCGCCAACG |
| SEQ ID NO: 1017 | mm04869_Aimp1 | CTGGCAGAAATTCATAACGG |
| SEQ ID NO: 1018 | mm04870_Aimp1 | TCCAGACGCGATGCGTCGAT |
| SEQ ID NO: 1019 | mm04871_Aimp1 | TGATGCAGATTCACTGTATG |
| SEQ ID NO: 1020 | mm04872_Aimp1 | TACAAAAGAGCAGATCAAAG |
| SEQ ID NO: 1021 | mm04873_Emb | AGTCGTTGATCGCTTACGTG |
| SEQ ID NO: 1022 | mm04874_Emb | AAGTCACCCGTAGTCTCAAG |
| SEQ ID NO: 1023 | mm04875_Emb | ACACCTTAACCAGTCAGTAC |
| SEQ ID NO: 1024 | mm04876_Emb | TTAAATTGGACTTGGTACAT |
| SEQ ID NO: 1025 | mm04885_Emp1 | ATGCATACCTTCATTGCCGT |
| SEQ ID NO: 1026 | mm04886_Emp1 | ATTACGCAAATGCATCTGTA |
| SEQ ID NO: 1027 | mm04887_Emp1 | ATACTCACAGCACACCAGCA |
| SEQ ID NO: 1028 | mm04888_Emp1 | GCATAATGGCAGTGGCAATG |
| SEQ ID NO: 1029 | mm04889_Emp2 | GGAGTGCCGTGGACACGATG |
| SEQ ID NO: 1030 | mm04890_Emp2 | AGGTTATTCTGTGATGCAGG |
| SEQ ID NO: 1031 | mm04891_Emp2 | ACAGGAACTTACATTGTCAA |
| SEQ ID NO: 1032 | mm04892_Emp2 | TGAGCTGGATGATGGACGTC |
| SEQ ID NO: 1033 | mm04897_Adgre1 | ACCCAAGATCCATTACAATG |

TABLE 1-continued mmSurf sgRNA library sequences

| SEQ ID NO | id_gRNA Target | Sequence |
|---|---|---|
| SEQ ID NO: 1034 | mm04898_Adgre1 | TTGGCAAAGAGAATCCAGCT |
| SEQ ID NO: 1035 | mm04899_Adgre1 | TATTACTGCACCTGTAAACG |
| SEQ ID NO: 1036 | mm04900_Adgre1 | AAGGAGGAGACATCCACTCT |
| SEQ ID NO: 1037 | mm04933_Eng | TCAGGGACATGAGTAGCACG |
| SEQ ID NO: 1038 | mm04934_Eng | CAAGTGCAATGGGATTTCCG |
| SEQ ID NO: 1039 | mm04935_Eng | CACACCCCAAGGCCTGATAG |
| SEQ ID NO: 1040 | mm04936_Eng | GTGGTTGATGTCGATGAACC |
| SEQ ID NO: 1041 | mm04937_Eno2 | GCCATCGCGGTAAAACTCAG |
| SEQ ID NO: 1042 | mm04938_Eno2 | GGTGTACCACACCCTCAAGG |
| SEQ ID NO: 1043 | mm04939_Eno2 | TCCTTCCCGATACATCACTG |
| SEQ ID NO: 1044 | mm04940_Eno2 | AAACAGCGTTACTTAGGCAA |
| SEQ ID NO: 1045 | mm04945_Enpep | TAGATGAGGCCGATAGTAGG |
| SEQ ID NO: 1046 | mm04946_Enpep | GGGAGTCGTCCTCTTGCACG |
| SEQ ID NO: 1047 | mm04947_Enpep | TGTTGGGTTCGTCGAAACAA |
| SEQ ID NO: 1048 | mm04948_Enpep | GGGAGCAGGTACCAATTCGA |
| SEQ ID NO: 1049 | mm04989_Epha1 | CCATGATATCAGATACAGCG |
| SEQ ID NO: 1050 | mm04990_Epha1 | GCTGTGGCTAAAACCCTATG |
| SEQ ID NO: 1051 | mm04991_Epha1 | AAGCTAAGTAGAGGCCACGG |
| SEQ ID NO: 1052 | mm04992_Epha1 | AGAATGGCACCAGATGGTGT |
| SEQ ID NO: 1053 | mm04993_Epha2 | CTTCTTGTAGTAGACGCGAA |
| SEQ ID NO: 1054 | mm04994_Epha2 | CGAGATCCACCCATCCTGTG |
| SEQ ID NO: 1055 | mm04995_Epha2 | CGTGTGCAAGACATGGACAG |
| SEQ ID NO: 1056 | mm04996_Epha2 | TGTTTGGTTAATACTGACGC |
| SEQ ID NO: 1057 | mm04997_Epha3 | ACTCCAGTCCAGGATAACCG |
| SEQ ID NO: 1058 | mm04998_Epha3 | AGCAGTTCATGAGTTCGCGA |
| SEQ ID NO: 1059 | mm04999_Epha3 | ACAGCCAAAATAATTGGCTG |
| SEQ ID NO: 1060 | mm05000_Epha3 | CTGACTGCGGCATACTGTCT |
| SEQ ID NO: 1061 | mm05001_Epha4 | TGACTGGATCACCCGCGAAG |
| SEQ ID NO: 1062 | mm05002_Epha4 | AAACTGGGCTAGATTTCGAA |
| SEQ ID NO: 1063 | mm05003_Epha4 | TCAGGACATTTCTTACAACG |
| SEQ ID NO: 1064 | mm05004_Epha4 | TGACAACCAACCAAGCAGGT |
| SEQ ID NO: 1065 | mm05017_Ephb2 | AGCAGGTGATCGGAGCAGGT |
| SEQ ID NO: 1066 | mm05018_Ephb2 | CATCAAACTCTACTGTAACG |
| SEQ ID NO: 1067 | mm05019_Ephb2 | TTGTGCAAGGCATGTCTAAG |
| SEQ ID NO: 1068 | mm05020_Ephb2 | AGGTCACTGATGTAGATGCG |
| SEQ ID NO: 1069 | mm05021_Ephb3 | ACAACGTAGAGTTTGTACCT |
| SEQ ID NO: 1070 | mm05022_Ephb3 | CTACCGTGCAGACTCAGACT |
| SEQ ID NO: 1071 | mm05023_Ephb3 | TGTGTCCTGTGTCAAGATCG |

TABLE 1-continued mmSurf sgRNA library sequences

| SEQ ID NO | id_gRNA Target | Sequence |
|---|---|---|
| SEQ ID NO: 1072 | mm05024_Ephb3 | CCCGGACCTGAACTACGTAG |
| SEQ ID NO: 1073 | mm05025_Ephb4 | GGCAGCGTACAGCATAAGTG |
| SEQ ID NO: 1074 | mm05026_Ephb4 | GGTAATACCCAATTCGACAC |
| SEQ ID NO: 1075 | mm05027_Ephb4 | ACATTGACAGGCTCAAAAGG |
| SEQ ID NO: 1076 | mm05028_Ephb4 | AGCGTATCGTGGCATACACG |
| SEQ ID NO: 1077 | mm05029_Ephb6 | AGAGTCGAGTGTTAGTTGGG |
| SEQ ID NO: 1078 | mm05030_Ephb6 | ACACACTTTGTGGAACGGCG |
| SEQ ID NO: 1079 | mm05031_Ephb6 | AGGGCTCAACCGTGTCACAG |
| SEQ ID NO: 1080 | mm05032_Ephb6 | ACCTCAAACCATAGCTCCCG |
| SEQ ID NO: 1081 | mm05041_Stx2 | CAGTGGATCTGCGGATACGA |
| SEQ ID NO: 1082 | mm05042_Stx2 | AAAACTGCTAACAGGATCCG |
| SEQ ID NO: 1083 | mm05043_Stx2 | TATCAGATTCACAAATCACT |
| SEQ ID NO: 1084 | mm05044_Stx2 | GTCATTAAATACCCACCTGA |
| SEQ ID NO: 1085 | mm05057_Epo | GAGGCTACGTAGACCACTGA |
| SEQ ID NO: 1086 | mm05058_Epo | TGAGGCGTGGGGGAGCACAG |
| SEQ ID NO: 1087 | mm05059_Epo | GCGACAGTCGAGTTCTGGAG |
| SEQ ID NO: 1088 | mm05060_Epo | CTATGCTTGGAAAAGAATGG |
| SEQ ID NO: 1089 | mm05061_Epor | GCGTCACTACTGACCGCTAG |
| SEQ ID NO: 1090 | mm05062_Epor | GTCCACTTCATATCGGATGT |
| SEQ ID NO: 1091 | mm05063_Epor | AGCGTGATGGTTGTCTGTGG |
| SEQ ID NO: 1092 | mm05064_Epor | TGGATGATGCGGTGATAGCG |
| SEQ ID NO: 1093 | mm05093_Erbb2 | TTGGAATCCTAATCAAACGA |
| SEQ ID NO: 1094 | mm05094_Erbb2 | CTGTCCCCGAACAACCAAG |
| SEQ ID NO: 1095 | mm05095_Erbb2 | CTGACTGCAGTTGACACACT |
| SEQ ID NO: 1096 | mm05096_Erbb2 | TCAATGAGTAAGCACCACTG |
| SEQ ID NO: 1097 | mm05097_Erbb3 | GCCCTTACCTAACCTCCGAG |
| SEQ ID NO: 1098 | mm05098_Erbb3 | TCCAACCTGACGACCATCGG |
| SEQ ID NO: 1099 | mm05099_Erbb3 | CTAGGGTATGTATTACCTCG |
| SEQ ID NO: 1100 | mm05100_Erbb3 | TGGACTCTAGCAATATCGAT |
| SEQ ID NO: 1101 | mm05101_Erbb4 | ATGGCAGCAGTCACTAACGT |
| SEQ ID NO: 1102 | mm05102_Erbb4 | GTAGAGCCCTTAACTCCCAG |
| SEQ ID NO: 1103 | mm05103_Erbb4 | TTGCTGATCCTCAAACAACA |
| SEQ ID NO: 1104 | mm05104_Erbb4 | AAAGAAATGTACCCGCAGGA |
| SEQ ID NO: 1105 | mm05205_Mpzl2 | TGTGGAAATTTACACCTCCG |
| SEQ ID NO: 1106 | mm05206_Mpzl2 | AGTTAGCGCATCTCCCACAG |
| SEQ ID NO: 1107 | mm05207_Mpzl2 | AATTTCCGACCTCGAGATGG |
| SEQ ID NO: 1108 | mm05208_Mpzl2 | CGGACGGTTCAAAGACCGGG |
| SEQ ID NO: 1109 | mm05285_F2r | GTTCCCGTAAAACGCTGCGG |

TABLE 1-continued mmSurf sgRNA library sequences

| SEQ ID NO | id_gRNA Target | Sequence |
|---|---|---|
| SEQ ID NO: 1110 | mm05286_F2r | GATTCCTTAGAAAGAATGAG |
| SEQ ID NO: 1111 | mm05287_F2r | GGTTCTCACTGAGGACGTCG |
| SEQ ID NO: 1112 | mm05288_F2r | AGTAGTAGCTGATCTTGAAG |
| SEQ ID NO: 1113 | mm05301_F3 | GAGGTCGCACTCGGTGTCTG |
| SEQ ID NO: 1114 | mm05302_F3 | AGATGGTAGAAAACTGAACG |
| SEQ ID NO: 1115 | mm05303_F3 | CATGAACTGAGTTCCTCCGT |
| SEQ ID NO: 1116 | mm05304_F3 | TCGGTAAGGTAAAAACTTTG |
| SEQ ID NO: 1117 | mm05365_Fap | ACCACCTACCCTCACCACGT |
| SEQ ID NO: 1118 | mm05366_Fap | ATGCACTCGTCTGCTATGGT |
| SEQ ID NO: 1119 | mm05367_Fap | AATGCTATTCAAATTACAAG |
| SEQ ID NO: 1120 | mm05368_Fap | CATAGATACTGAATTGGACG |
| SEQ ID NO: 1121 | mm05369_Fas | CAGTTAAGAGTTCATACTCA |
| SEQ ID NO: 1122 | mm05370_Fas | TATTTATATATCGAAAGTAC |
| SEQ ID NO: 1123 | mm05371_Fas | CATTTGCATACTCACACGAC |
| SEQ ID NO: 1124 | mm05372_Fas | GAGGACTGCAAAATGAATGG |
| SEQ ID NO: 1125 | mm05373_Fasl | AGGACCACAACACAAATCTG |
| SEQ ID NO: 1126 | mm05374_Fasl | CTTCACTCCAGAGATCAGAG |
| SEQ ID NO: 1127 | mm05375_Fasl | CCTCTGAAAAAAAAGAGCCG |
| SEQ ID NO: 1128 | mm05376_Fasl | GGAACTGGCAGAACTCCGTG |
| SEQ ID NO: 1129 | mm05405_Fbln2 | GTGGCAGTGTAGATAGAGTG |
| SEQ ID NO: 1130 | mm05406_Fbln2 | TACTACGACTGCGTACAAGG |
| SEQ ID NO: 1131 | mm05407_Fbln2 | AACGCACATAGGAAGTGTGT |
| SEQ ID NO: 1132 | mm05408_Fbln2 | CTGCACGAGAGTCTGCACCG |
| SEQ ID NO: 1133 | mm05409_Fbn1 | GAATGCAGCATAATGAACGG |
| SEQ ID NO: 1134 | mm05410_Fbn1 | GCTTACCGATGCATTCGCCA |
| SEQ ID NO: 1135 | mm05411_Fbn1 | AGCCCATGTCGCATTCACAG |
| SEQ ID NO: 1136 | mm05412_Fbn1 | GAGCTGTGTAGCAGTAACCA |
| SEQ ID NO: 1137 | mm05413_Fbn2 | GTTGAGGTTACGAAGCCACG |
| SEQ ID NO: 1138 | mm05414_Fbn2 | CAGACTTGGTCACCGCACCC |
| SEQ ID NO: 1139 | mm05415_Fbn2 | GAGTGTATGATAATGAATGG |
| SEQ ID NO: 1140 | mm05416_Fbn2 | AAGGTGTGACTTGCGAAGGT |
| SEQ ID NO: 1141 | mm05429_Fcer1a | GTGTACTTGAATGTAACGCA |
| SEQ ID NO: 1142 | mm05430_Fcer1a | GAAGAACTGGAATGTCCGCA |
| SEQ ID NO: 1143 | mm05431_Fcer1a | GTAAATATTCTAATCCATGG |
| SEQ ID NO: 1144 | mm05432_Fcer1a | AGTGCCACCGTTCAAGACAG |
| SEQ ID NO: 1145 | mm05433_Ms4a2 | TTGTCAGTAGCATCGCTGCA |
| SEQ ID NO: 1146 | mm05434_Ms4a2 | AAAGTCTGAAACATAGAGTA |
| SEQ ID NO: 1147 | mm05435_Ms4a2 | AAACTAGGCTATCCATTCTG |

TABLE 1-continued mmSurf sgRNA library sequences

| SEQ ID NO | id_gRNA Target | Sequence |
|---|---|---|
| SEQ ID NO: 1148 | mm05436_Ms4a2 | CAGGCAACACAAATTCTGGT |
| SEQ ID NO: 1149 | mm05437_Fcer1g | CCTACTCTACTGTCGACTCA |
| SEQ ID NO: 1150 | mm05438_Fcer1g | ACTCCAGATCCAGGTCCGAA |
| SEQ ID NO: 1151 | mm05439_Fcer1g | TCCAGGATATAGCAGAGCTG |
| SEQ ID NO: 1152 | mm05440_Fcer1g | TTTGGTGGAACAAGCAGGTA |
| SEQ ID NO: 1153 | mm05441_Fcer2a | GAACCTGACCGGACTCCAGG |
| SEQ ID NO: 1154 | mm05442_Fcer2a | CTTCCCCCTAGACTGGGAAA |
| SEQ ID NO: 1155 | mm05443_Fcer2a | ACGTGGGACACAGCTCATGT |
| SEQ ID NO: 1156 | mm05444_Fcer2a | CGATTCTCTAGAGAAACTCC |
| SEQ ID NO: 1157 | mm05445_Fcgr1 | AGAGTACCATATAGCAAGGG |
| SEQ ID NO: 1158 | mm05446_Fcgr1 | TGGGATGCTATAACTAGGCG |
| SEQ ID NO: 1159 | mm05447_Fcgr1 | TGGAAAATACTGACCCATGG |
| SEQ ID NO: 1160 | mm05448_Fcgr1 | GAATAAACTGGTGTACAATG |
| SEQ ID NO: 1161 | mm05449_Fcgr2b | AGGTCCCGACTTACTTAGCA |
| SEQ ID NO: 1162 | mm05450_Fcgr2b | CGGTGACACTGACATGCGAA |
| SEQ ID NO: 1163 | mm05451_Fcgr2b | TTCCAGAAACACCAGCTGAG |
| SEQ ID NO: 1164 | mm05452_Fcgr2b | ACTGCAAAGGAAGTCTAGGA |
| SEQ ID NO: 1165 | mm05453_Fcgr3 | TGGTGACACTGATGTGCGAA |
| SEQ ID NO: 1166 | mm05454_Fcgr3 | ATGCACACTCTGGAAGCCAA |
| SEQ ID NO: 1167 | mm05455_Fcgr3 | TGGTGAAACTGGACCCCCCA |
| SEQ ID NO: 1168 | mm05456_Fcgr3 | TGCTGCTCCAGACCCCTCAG |
| SEQ ID NO: 1169 | mm05457_Fcgrt | AAGAATCGGCAATTGGACTG |
| SEQ ID NO: 1170 | mm05458_Fcgrt | GGGCACTGAGGAATTATCCG |
| SEQ ID NO: 1171 | mm05459_Fcgrt | CGTGAGATGATACATCAGTG |
| SEQ ID NO: 1172 | mm05460_Fcgrt | AGGTGGCCTAGCAGTCGCTC |
| SEQ ID NO: 1173 | mm05465_Fcnb | CCGGCATTACCTACCCTGGG |
| SEQ ID NO: 1174 | mm05466_Fcnb | GGGACTGGACCTCATACAAG |
| SEQ ID NO: 1175 | mm05467_Fcnb | CTGAAGGTCCTAGATCTGGA |
| SEQ ID NO: 1176 | mm05468_Fcnb | ATGTCACACAGCACAGTCAG |
| SEQ ID NO: 1177 | mm05513_Fgf10 | TTTCTCACGATTGAGAAGAA |
| SEQ ID NO: 1178 | mm05514_Fgf10 | TGTCCTGGAGATAACATCAG |
| SEQ ID NO: 1179 | mm05515_Fgf10 | CCAGTGCGGGAAGGCATGTG |
| SEQ ID NO: 1180 | mm05516_Fgf10 | AGGAGAACAGCCTTCTCCAG |
| SEQ ID NO: 1181 | mm05537_Fgf17 | CTCTGCTGTCAAACACAGGT |
| SEQ ID NO: 1182 | mm05538_Fgf17 | GTGAATACCAGCTCTACAGC |
| SEQ ID NO: 1183 | mm05539_Fgf17 | TCGCATCTCTGCCACCGCAG |
| SEQ ID NO: 1184 | mm05540_Fgf17 | AACCAGTACGTGAGGGACCA |
| SEQ ID NO: 1185 | mm05565_Fgf8 | GGGAATGCACCTTACCGAAG |

TABLE 1-continued mmSurf sgRNA library sequences

| SEQ ID NO | id_gRNA Target | Sequence |
|---|---|---|
| SEQ ID NO: 1186 | mm05566_Fgf8 | ATGCTGTGTAAAATTAGGTG |
| SEQ ID NO: 1187 | mm05567_Fgf8 | CGAGTTCGCGGCGCAGAGAC |
| SEQ ID NO: 1188 | mm05568_Fgf8 | AGAGCTGGTAGGTCCGGATG |
| SEQ ID NO: 1189 | mm05573_Fgfbp1 | CTGGTGAACCCCAACGCACG |
| SEQ ID NO: 1190 | mm05574_Fgfbp1 | TTCTGGGCCTTCCCTAACGA |
| SEQ ID NO: 1191 | mm05575_Fgfbp1 | ACATCTAAATCTCTGACGCA |
| SEQ ID NO: 1192 | mm05576_Fgfbp1 | AACACAAGAAAACTCCTGAT |
| SEQ ID NO: 1193 | mm05577_Fgfr1 | TGGAGTTAATACCACCGACA |
| SEQ ID NO: 1194 | mm05578_Fgfr1 | GCATCGTGGAGAATGAGTAT |
| SEQ ID NO: 1195 | mm05579_Fgfr1 | TCTCCGAGATCAGATCCGAC |
| SEQ ID NO: 1196 | mm05580_Fgfr1 | TCTCGTGGCAGCTCCCAGCG |
| SEQ ID NO: 1197 | mm05581_Fgfr2 | CAACTCTAGCGATTCCCCGG |
| SEQ ID NO: 1198 | mm05582_Fgfr2 | GGAGACCCCTGCTAGCATCG |
| SEQ ID NO: 1199 | mm05583_Fgfr2 | GGTGCCACACCTAGAGACTC |
| SEQ ID NO: 1200 | mm05584_Fgfr2 | GGCCGCCGGTGTTAACACCA |
| SEQ ID NO: 1201 | mm05585_Fgfr3 | GTATAGTTGCCACGATCGGA |
| SEQ ID NO: 1202 | mm05586_Fgfr3 | GAGGCTGGCAGCGTGTACGC |
| SEQ ID NO: 1203 | mm05587_Fgfr3 | TGACAAGGACCTGTCGGACC |
| SEQ ID NO: 1204 | mm05588_Fgfr3 | TCTGTTACCTGTCGCTTAAG |
| SEQ ID NO: 1205 | mm05637_Smc2 | CCTCATGGAACATTGAGTGG |
| SEQ ID NO: 1206 | mm05638_Smc2 | ATGAAGAAGCTAAATTACGA |
| SEQ ID NO: 1207 | mm05639_Smc2 | CACCAAGGAACGCTCAGCTG |
| SEQ ID NO: 1208 | mm05640_Smc2 | TCATGAGCTTCAAATCCCAA |
| SEQ ID NO: 1209 | mm05673_Fkbp10 | GCTGGATGTCCACAACCCGA |
| SEQ ID NO: 1210 | mm05674_Fkbp10 | GCGGCCTACGCCCACAACGA |
| SEQ ID NO: 1211 | mm05675_Fkbp10 | TACAATACCTATGTCGGGCA |
| SEQ ID NO: 1212 | mm05676_Fkbp10 | GACCACGTCAAAATAGAGGG |
| SEQ ID NO: 1213 | mm05737_Flt1 | AGTGATGGAGTAATCTTGAG |
| SEQ ID NO: 1214 | mm05738_Flt1 | CCTCGTATTGAGCTCCGTGG |
| SEQ ID NO: 1215 | mm05739_Flt1 | CTTACCATACACATGCACGG |
| SEQ ID NO: 1216 | mm05740_Flt1 | TCTATTGTAGGCAAATCGCT |
| SEQ ID NO: 1217 | mm05741_Flt3 | CAGTACTCTAAATATGAGTG |
| SEQ ID NO: 1218 | mm05742_Flt3 | CCCACTTTCAGGAATAACTG |
| SEQ ID NO: 1219 | mm05743_Flt3 | TCCACGTGCATCGGATTCGT |
| SEQ ID NO: 1220 | mm05744_Flt3 | CTATGAATATGACCTTAAGT |
| SEQ ID NO: 1221 | mm05745_Flt3l | TAAAGATTACCCAGTCACTG |
| SEQ ID NO: 1222 | mm05746_Flt3l | GCTAACCTGGAAGGTACATG |
| SEQ ID NO: 1223 | mm05747_Flt3l | GCACCGAGAGAAATTCTGGC |

TABLE 1-continued mmSurf sgRNA library sequences

| SEQ ID NO | id_gRNA Target | Sequence |
|---|---|---|
| SEQ ID NO: 1224 | mm05748_Flt3l | CAGTTGCTCTATCCAGCGCT |
| SEQ ID NO: 1225 | mm05749_Flt4 | AGCTGTCCAGACTCTCGATG |
| SEQ ID NO: 1226 | mm05750_Flt4 | CAGTTTGAATATCCCCCGAG |
| SEQ ID NO: 1227 | mm05751_Flt4 | CTCACCTCTTACAAACACAT |
| SEQ ID NO: 1228 | mm05752_Flt4 | GGGTCTACACTCTCGCCCTG |
| SEQ ID NO: 1229 | mm05765_Fmod | GAGTTATAACCACCTTCGGA |
| SEQ ID NO: 1230 | mm05766_Fmod | ACAATGAGATCCAGGAAGTG |
| SEQ ID NO: 1231 | mm05767_Fmod | GGACCCGTGAGATCTGGTTG |
| SEQ ID NO: 1232 | mm05768_Fmod | TGCCATGTAGAGCGACCCAG |
| SEQ ID NO: 1233 | mm05773_Fn1 | CATTCCACCTTACAACACCG |
| SEQ ID NO: 1234 | mm05774_Fn1 | TGGGACGTCCTACGTCGTGG |
| SEQ ID NO: 1235 | mm05775_Fn1 | TTATGGTGGCAATTCAAACG |
| SEQ ID NO: 1236 | mm05776_Fn1 | GTGAATCGCAGATCCGTGGG |
| SEQ ID NO: 1237 | mm05789_Folr1 | GACAATTTACACGACCAGGT |
| SEQ ID NO: 1238 | mm05790_Folr1 | AGTTCGGGAACACTCATAG |
| SEQ ID NO: 1239 | mm05791_Folr1 | CCAGTTGAACCGGTACAGGT |
| SEQ ID NO: 1240 | mm05792_Folr1 | CTCCACCTACTCCTTACCCG |
| SEQ ID NO: 1241 | mm05793_Folr2 | CATCCATGCAAACGTTGAGT |
| SEQ ID NO: 1242 | mm05794_Folr2 | CTCCCGTCTGTACTTCAACT |
| SEQ ID NO: 1243 | mm05795_Folr2 | AACGCTCTTTACGCCAACTC |
| SEQ ID NO: 1244 | mm05796_Folr2 | GAGAGACTGGCATAAAGGCT |
| SEQ ID NO: 1245 | mm05857_Fshr | TCTTACAGATATCGGAGACT |
| SEQ ID NO: 1246 | mm05858_Fshr | ATCCATGTGAAGACATCATG |
| SEQ ID NO: 1247 | mm05859_Fshr | AGGTTACACATAAGGAACCG |
| SEQ ID NO: 1248 | mm05860_Fshr | ACAGTTCAATGGCGTTCCGG |
| SEQ ID NO: 1249 | mm05873_Fstl1 | CCTGGATCTTGGATCCAGTG |
| SEQ ID NO: 1250 | mm05874_Fstl1 | ACCGGTCACCTACCTCGCCG |
| SEQ ID NO: 1251 | mm05875_Fstl1 | ACCTCAATGCAGAGGCACGT |
| SEQ ID NO: 1252 | mm05876_Fstl1 | GGCGCCGTCGGAGCTCATCG |
| SEQ ID NO: 1253 | mm05901_Fut4 | GCGTCCACGAGTGGCCACCG |
| SEQ ID NO: 1254 | mm05902_Fut4 | CGCGTGTTCGACGACCAGGA |
| SEQ ID NO: 1255 | mm05903_Fut4 | AATCGCCCTCCCATACTCCA |
| SEQ ID NO: 1256 | mm05904_Fut4 | GCTGTTCCACCACCGCGACC |
| SEQ ID NO: 1257 | mm05933_Fzd1 | AGCCCGCTAGCCCAACGCCG |
| SEQ ID NO: 1258 | mm05934_Fzd1 | ACCAGTAATCCGCAGCACGG |
| SEQ ID NO: 1259 | mm05935_Fzd1 | TCACGTACCTAGTGGACATG |
| SEQ ID NO: 1260 | mm05936_Fzd1 | GCTGGGCCACACGAATCAGG |
| SEQ ID NO: 1261 | mm05941_Fzd4 | TTGGCACATAAACCGAACAA |

TABLE 1-continued mmSurf sgRNA library sequences

| SEQ ID NO | id_gRNA Target | Sequence |
|---|---|---|
| SEQ ID NO: 1262 | mm05942_Fzd4 | GGTTCTGGCACATGGCGATG |
| SEQ ID NO: 1263 | mm05943_Fzd4 | ACATACTGAGAAATATGATG |
| SEQ ID NO: 1264 | mm05944_Fzd4 | CTGGTCCTTCCATGCACATG |
| SEQ ID NO: 1265 | mm05945_Fzd5 | CCAGTTCAACCATGACACGC |
| SEQ ID NO: 1266 | mm05946_Fzd5 | GGAATCGTTCCATGTCAATG |
| SEQ ID NO: 1267 | mm05947_Fzd5 | GTCACACCCACTCTACAACA |
| SEQ ID NO: 1268 | mm05948_Fzd5 | GTACTGTGCATAACCTGCGA |
| SEQ ID NO: 1269 | mm05961_Fzd9 | CCCGCACGCACTCTGTATGG |
| SEQ ID NO: 1270 | mm05962_Fzd9 | GACCTGGTCGGTGCACATTG |
| SEQ ID NO: 1271 | mm05963_Fzd9 | GAGTGTGGCATGCGACCAGG |
| SEQ ID NO: 1272 | mm05964_Fzd9 | TACTTCCACATGGCAGCGTG |
| SEQ ID NO: 1273 | mm05997_Gaa | ACCATCCCCACTTTACAGCG |
| SEQ ID NO: 1274 | mm05998_Gaa | GAGTTACAGGCCCTACGACG |
| SEQ ID NO: 1275 | mm05999_Gaa | CTAACCTGGAGGTCAACGGG |
| SEQ ID NO: 1276 | mm06000_Gaa | ACCTGAGCTCTACAGAGTCG |
| SEQ ID NO: 1277 | mm06025_Gabra3 | TTTGTGAAACAAGATATTGG |
| SEQ ID NO: 1278 | mm06026_Gabra3 | CCATATCAGTGTCTGACACA |
| SEQ ID NO: 1279 | mm06027_Gabra3 | CCACAATGGTAAAAAATCAG |
| SEQ ID NO: 1280 | mm06028_Gabra3 | AGTCATGATACATGGCAAGT |
| SEQ ID NO: 1281 | mm06033_Gabra6 | GGAAGTTAACCAATCTCATG |
| SEQ ID NO: 1282 | mm06034_Gabra6 | GGGACTTCTACTGAGTAAAG |
| SEQ ID NO: 1283 | mm06035_Gabra6 | TCTACTCTGAAAATGTCAGT |
| SEQ ID NO: 1284 | mm06036_Gabra6 | TTAAGCTCAGAATCTCAGCA |
| SEQ ID NO: 1285 | mm06045_Gabrb3 | CCTCACGCTTGACAATCGAG |
| SEQ ID NO: 1286 | mm06046_Gabrb3 | CCTGGTAGATGGCTACACTA |
| SEQ ID NO: 1287 | mm06047_Gabrb3 | CGCCTGAGACCCGACTTCGG |
| SEQ ID NO: 1288 | mm06048_Gabrb3 | CGAAAACTCAATGAAAGTCG |
| SEQ ID NO: 1289 | mm06057_Gabrg1 | ACTTATGCTCAACAGCAACA |
| SEQ ID NO: 1290 | mm06058_Gabrg1 | CATTCCGTGTATTCTAACAG |
| SEQ ID NO: 1291 | mm06059_Gabrg1 | TTTAACTATGAACAAAACAT |
| SEQ ID NO: 1292 | mm06060_Gabrg1 | ACATCTGTTTCAATCACTGT |
| SEQ ID NO: 1293 | mm06061_Gabrg2 | AACAAACTTCGACCTGACAT |
| SEQ ID NO: 1294 | mm06062_Gabrg2 | GGTTGAATAGCAATATGGTG |
| SEQ ID NO: 1295 | mm06063_Gabrg2 | TCCTGCTATCGCTCTACCCA |
| SEQ ID NO: 1296 | mm06064_Gabrg2 | TACAACTGGAGAACTCCAGG |
| SEQ ID NO: 1297 | mm06077_Slc6a12 | CTGAATCACTCATCGGCCAG |
| SEQ ID NO: 1298 | mm06078_Slc6a12 | TCTTGGGCCTCATGTAGGTG |
| SEQ ID NO: 1299 | mm06079_Slc6a12 | GATGGAGTTTGTGCTGTCAG |

TABLE 1-continued mmSurf sgRNA library sequences

| SEQ ID NO | id_gRNA Target | Sequence |
|---|---|---|
| SEQ ID NO: 1300 | mm06080_Slc6a12 | GGGAATACCCATTTCTGAAG |
| SEQ ID NO: 1301 | mm06101_B4galnt1 | TCTAGCAGATCGAGTCTCGG |
| SEQ ID NO: 1302 | mm06102_B4galnt1 | TGACCGTAGGGTAAAAGCGT |
| SEQ ID NO: 1303 | mm06103_B4galnt1 | GTTCGCAGGTCGGAACCTGG |
| SEQ ID NO: 1304 | mm06104_B4galnt1 | TGCAGTTGTGAATCCAAGGG |
| SEQ ID NO: 1305 | mm06109_Galnt1 | CTAGTGCAGAAACCTCATGA |
| SEQ ID NO: 1306 | mm06110_Galnt1 | ATAGTGACATGCTCCCATGT |
| SEQ ID NO: 1307 | mm06111_Galnt1 | TGACACTTTCGAGTACATGG |
| SEQ ID NO: 1308 | mm06112_Galnt1 | TAACCTTCCTACAACAAGTG |
| SEQ ID NO: 1309 | mm06141_Gapdh | GCTGTGGCGTGATGGCCGTG |
| SEQ ID NO: 1310 | mm06142_Gapdh | AAACAGGCCCACTTGAAGGG |
| SEQ ID NO: 1311 | mm06143_Gapdh | TGCCATTTGCAGTGGCAAAG |
| SEQ ID NO: 1312 | mm06144_Gapdh | GGCCGGTGCTGAGTATGTCG |
| SEQ ID NO: 1313 | mm06145_Gapdhs | GCCAGCTAGAGAGCTGACAG |
| SEQ ID NO: 1314 | mm06146_Gapdhs | GGTTGAGGATCCACCACCCA |
| SEQ ID NO: 1315 | mm06147_Gapdhs | AACTTGTCTGGCTCTATCTG |
| SEQ ID NO: 1316 | mm06148_Gapdhs | CTCTATAGGGAATCCCTACG |
| SEQ ID NO: 1317 | mm06149_Gart | ACTCGTAGTTGTCGGACCAG |
| SEQ ID NO: 1318 | mm06150_Gart | TGACGGCTTCAGTTGTACTG |
| SEQ ID NO: 1319 | mm06151_Gart | GCTAGAAAGGATCACCGAAG |
| SEQ ID NO: 1320 | mm06152_Gart | GGCAAAGTAGTGACCAGCGG |
| SEQ ID NO: 1321 | mm06197_Gba | CGTTACGAGAGCACTCGACG |
| SEQ ID NO: 1322 | mm06198_Gba | GGATAACTGGAAGTCGTTAG |
| SEQ ID NO: 1323 | mm06199_Gba | GACTGGCAAAGAGTGAAATG |
| SEQ ID NO: 1324 | mm06200_Gba | CGGAGAATGAACCTACAGCA |
| SEQ ID NO: 1325 | mm06301_Gdf3 | CACGTAGCATAAGTCCTGCG |
| SEQ ID NO: 1326 | mm06302_Gdf3 | CGCAGGTTATAGTAGGACCT |
| SEQ ID NO: 1327 | mm06303_Gdf3 | TCAAAGAGGACAGATACTCC |
| SEQ ID NO: 1328 | mm06304_Gdf3 | CAATCTGCCCACCTTAGGGT |
| SEQ ID NO: 1329 | mm06337_Gfap | AGAGATTCGCACTCAATACG |
| SEQ ID NO: 1330 | mm06338_Gfap | TCCAAGATGAAACCAACCTG |
| SEQ ID NO: 1331 | mm06339_Gfap | TGCGGGACGCAGCGTCTGTG |
| SEQ ID NO: 1332 | mm06340_Gfap | TCTCGATGTAGCTAGCAAAG |
| SEQ ID NO: 1333 | mm06357_Gfra1 | GCACCAAGTACCGCACACTG |
| SEQ ID NO: 1334 | mm06358_Gfra1 | CTTACCAATCAGTCCCGAGT |
| SEQ ID NO: 1335 | mm06359_Gfra1 | CATATGGGGAATCTTCCAGT |
| SEQ ID NO: 1336 | mm06360_Gfra1 | TCAAGGCCTCCATAGCGCTG |
| SEQ ID NO: 1337 | mm06361_Gfra2 | ATGCCTGGTAGTTGTCCGCA |

TABLE 1-continued mmSurf sgRNA library sequences

| SEQ ID NO | id_gRNA Target | Sequence |
|---|---|---|
| SEQ ID NO: 1338 | mm06362_Gfra2 | TCTATTGGAGCATCCATCTG |
| SEQ ID NO: 1339 | mm06363_Gfra2 | GGCCAATAAGGAGTGCCAGG |
| SEQ ID NO: 1340 | mm06364_Gfra2 | CCGGGCCAATGAGCTGTGTG |
| SEQ ID NO: 1341 | mm06365_Gfra3 | CCGCAGATCCAGGCAATTGG |
| SEQ ID NO: 1342 | mm06366_Gfra3 | GGTCCAATAAATGTCCAGAC |
| SEQ ID NO: 1343 | mm06367_Gfra3 | GACATGGCAGACTCCTCTAA |
| SEQ ID NO: 1344 | mm06368_Gfra3 | CCTGCGCAAGGCCTACGGGG |
| SEQ ID NO: 1345 | mm06373_Ggh | AGATTCAGGTTATTCCCGAG |
| SEQ ID NO: 1346 | mm06374_Ggh | AGACTCTATATACTTCACAT |
| SEQ ID NO: 1347 | mm06375_Ggh | CCTACAACCATGGCTCCGAG |
| SEQ ID NO: 1348 | mm06376_Ggh | CATGTGATACCTTCACAGAG |
| SEQ ID NO: 1349 | mm06385_B4galt1 | GGCCAGAGAGGTAATAGACG |
| SEQ ID NO: 1350 | mm06386_B4galt1 | CAGGGCTGGAGTCGAGACCC |
| SEQ ID NO: 1351 | mm06387_B4galt1 | GCTCAATATTGGCTTTCAAG |
| SEQ ID NO: 1352 | mm06388_B4galt1 | TGATGTGGACCTCATTCCGA |
| SEQ ID NO: 1353 | mm06389_Ggt1 | ACTGACGTATCACCGTATCG |
| SEQ ID NO: 1354 | mm06390_Ggt1 | CGTACAGGGTCGCATCACCG |
| SEQ ID NO: 1355 | mm06391_Ggt1 | GAATTCAGGCTCATAGTAGG |
| SEQ ID NO: 1356 | mm06392_Ggt1 | CGACCACGTGTACTCCAGGG |
| SEQ ID NO: 1357 | mm06397_Ghr | ATTGATTCTTTGCAGAACTG |
| SEQ ID NO: 1358 | mm06398_Ghr | GCTTCCAATATGTTCGTCTG |
| SEQ ID NO: 1359 | mm06399_Ghr | AATTGCTCATGAATGGACCC |
| SEQ ID NO: 1360 | mm06400_Ghr | GTCCAGTTGAGGCCAATGGG |
| SEQ ID NO: 1361 | mm06405_Ghrhr | ACGTACCAGTGCATAGCACG |
| SEQ ID NO: 1362 | mm06406_Ghrhr | AGGTGGCAAACAGCTGCGTG |
| SEQ ID NO: 1363 | mm06407_Ghrhr | GATGGCAATAGCCACGCAGA |
| SEQ ID NO: 1364 | mm06408_Ghrhr | CATGGTGGCCAAATGTGAGA |
| SEQ ID NO: 1365 | mm06489_Ostm1 | CATCAGCCGAAACATCGGGG |
| SEQ ID NO: 1366 | mm06490_Ostm1 | TTGCCTAACAAACAATGGTG |
| SEQ ID NO: 1367 | mm06491_Ostm1 | AGCGCTGCGCACCATACAGG |
| SEQ ID NO: 1368 | mm06492_Ostm1 | CAGAATGCAGATAGTTCTCA |
| SEQ ID NO: 1369 | mm06521_Glp1r | AGAAATGGAGAGAATACCGG |
| SEQ ID NO: 1370 | mm06522_Glp1r | CCTGTACATTATCTACACAG |
| SEQ ID NO: 1371 | mm06523_Glp1r | ACATTCACGAAGGAACCTGG |
| SEQ ID NO: 1372 | mm06524_Glp1r | CACTCCGACAGGTCCCTCCA |
| SEQ ID NO: 1373 | mm06525_Glra1 | CCACTTCCACGAAATCACCA |
| SEQ ID NO: 1374 | mm06526_Glra1 | TTCCATCGCTGAGACAACCA |
| SEQ ID NO: 1375 | mm06527_Glra1 | ATGCTGCACCAGCTCGTGTG |

TABLE 1-continued mmSurf sgRNA library sequences

| SEQ ID NO | id_gRNA Target | Sequence |
|---|---|---|
| SEQ ID NO: 1376 | mm06528_Glra1 | TCCTGGATAAGCTCATGGGG |
| SEQ ID NO: 1377 | mm06533_Glrb | AGGTTACTACACTTGTGTGG |
| SEQ ID NO: 1378 | mm06534_Glrb | GGAAACAGAGTTAAGTCTAG |
| SEQ ID NO: 1379 | mm06535_Glrb | CACAGCGTACTCCACGAGGG |
| SEQ ID NO: 1380 | mm06536_Glrb | CCACCATGTATAAGTGCTTG |
| SEQ ID NO: 1381 | mm06553_Slc6a9 | ATACCTCTGCTATCGCAACG |
| SEQ ID NO: 1382 | mm06554_Slc6a9 | GTAGTACATGATACCCGTGA |
| SEQ ID NO: 1383 | mm06555_Slc6a9 | ATGGTGGTGTCCACATACAT |
| SEQ ID NO: 1384 | mm06556_Slc6a9 | TGTGCTACCAGCGTCTACGC |
| SEQ ID NO: 1385 | mm06633_Gnb2l1 | GATAGGGTTGCTGCTGTTCG |
| SEQ ID NO: 1386 | mm06634_Gnb2l1 | AAGCTAAAGACCAACCACAT |
| SEQ ID NO: 1387 | mm06635_Gnb2l1 | TGTCTGCAAGTACACGGTCC |
| SEQ ID NO: 1388 | mm06636_Gnb2l1 | CTTGCCTCCAGAAGCACAGA |
| SEQ ID NO: 1389 | mm06669_Bscl2 | GTTTCATGTTATACCAGAGG |
| SEQ ID NO: 1390 | mm06670_Bscl2 | CCTGGGCCCACAGTAAGGCG |
| SEQ ID NO: 1391 | mm06671_Bscl2 | CAAAGGATCAGACAAAGACG |
| SEQ ID NO: 1392 | mm06672_Bscl2 | AATGTCTCACTGGCTAAGAG |
| SEQ ID NO: 1393 | mm06713_Got2 | TGGAGGTCCCATTTCAACAT |
| SEQ ID NO: 1394 | mm06714_Got2 | TTTCTGCCCAAACCATCCTG |
| SEQ ID NO: 1395 | mm06715_Got2 | CATCCTCCTCACCTTCACCA |
| SEQ ID NO: 1396 | mm06716_Got2 | AGCTCACCTTCCGGACACTG |
| SEQ ID NO: 1397 | mm06717_Gp1ba | CAAGGACACAACTCCTAACG |
| SEQ ID NO: 1398 | mm06718_Gp1ba | TGGCTTCGCACAATACCAAA |
| SEQ ID NO: 1399 | mm06719_Gp1ba | CACCTGGGCGAGAACCAACT |
| SEQ ID NO: 1400 | mm06720_Gp1ba | TGCAGGCAATGCCCATCCTA |
| SEQ ID NO: 1401 | mm06725_Lrp2 | GATATGACCGTTGTTCGACG |
| SEQ ID NO: 1402 | mm06726_Lrp2 | TGGATGGCAATTATTCCGAG |
| SEQ ID NO: 1403 | mm06727_Lrp2 | GTATCCTATTGGACACACGC |
| SEQ ID NO: 1404 | mm06728_Lrp2 | TGATAGGCGCAACGACTGTG |
| SEQ ID NO: 1405 | mm06729_Pdpn | TACCAACGCAGAGAGAGCGT |
| SEQ ID NO: 1406 | mm06730_Pdpn | GAAGATGATATTGTGACCCC |
| SEQ ID NO: 1407 | mm06731_Pdpn | AGTGGTGACTAGCCACTCTG |
| SEQ ID NO: 1408 | mm06732_Pdpn | TTCTCTGTGATCATGGTCTG |
| SEQ ID NO: 1409 | mm06733_Gp49a | AATGAATCTGCCAAATAGTG |
| SEQ ID NO: 1410 | mm06734_Gp49a | AGAACAAAAGTAGCATGGGT |
| SEQ ID NO: 1411 | mm06735_Gp49a | GTGAGTCCAGGGTCCACGAG |
| SEQ ID NO: 1412 | mm06736_Gp49a | AAAGGATATGGAAACTCCAG |
| SEQ ID NO: 1413 | mm06737_Lilrb4 | TTTATACAGATGATAATACT |

TABLE 1-continued mmSurf sgRNA library sequences

| SEQ ID NO | id_gRNA Target | Sequence |
|---|---|---|
| SEQ ID NO: 1414 | mm06738_Lilrb4 | AGAACAAAAGTAGCATAGGA |
| SEQ ID NO: 1415 | mm06739_Lilrb4 | CTGATCCAGGAAGGAAAGCA |
| SEQ ID NO: 1416 | mm06740_Lilrb4 | AGCATGACAACCTCATATGC |
| SEQ ID NO: 1417 | mm06741_Gp5 | TCTGTTCGAGAACCCCTGG |
| SEQ ID NO: 1418 | mm06742_Gp5 | ATCTTATCCAGGATCGCACG |
| SEQ ID NO: 1419 | mm06743_Gp5 | GAATGGACCAGGGCATATTG |
| SEQ ID NO: 1420 | mm06744_Gp5 | GAGGTTTCCGGATAGAGTCA |
| SEQ ID NO: 1421 | mm06749_Gpc1 | GCTGCGCCTCTACTACCGTG |
| SEQ ID NO: 1422 | mm06750_Gpc1 | CCCGAGGAGAAGCGTCGCCG |
| SEQ ID NO: 1423 | mm06751_Gpc1 | GCACATTTCGGCAATAGTCG |
| SEQ ID NO: 1424 | mm06752_Gpc1 | CCGCAGGCGCAGTTCTCGAG |
| SEQ ID NO: 1425 | mm06753_Gpc3 | TTGCGGTGGTTATTGCAATG |
| SEQ ID NO: 1426 | mm06754_Gpc3 | CTTGGGTTCTGATATCAACG |
| SEQ ID NO: 1427 | mm06755_Gpc3 | GGTCACGTCTTGCTCCTCGG |
| SEQ ID NO: 1428 | mm06756_Gpc3 | CTTACTAAACTTGAGGTGGT |
| SEQ ID NO: 1429 | mm06757_Gpc4 | CCCTCTATGAGATCAACGGT |
| SEQ ID NO: 1430 | mm06758_Gpc4 | TATTGCTCAAACATCATGCG |
| SEQ ID NO: 1431 | mm06759_Gpc4 | TGTAGTAAGCAAAGTGTCCG |
| SEQ ID NO: 1432 | mm06760_Gpc4 | TAAAGATGATTTCAAAACCG |
| SEQ ID NO: 1433 | mm06765_S1pr2 | AATCAGCGATATCAGCCAAG |
| SEQ ID NO: 1434 | mm06766_S1pr2 | CATCGCCATCGAGAGACAAG |
| SEQ ID NO: 1435 | mm06767_S1pr2 | GGAACACTACAATTACACCA |
| SEQ ID NO: 1436 | mm06768_S1pr2 | CAGAAGATTCTCCACCACGA |
| SEQ ID NO: 1437 | mm06773_Lpar1 | TCTTTGGCTATGTTCGCCAG |
| SEQ ID NO: 1438 | mm06774_Lpar1 | GGAGACTGACTGTTAGCACG |
| SEQ ID NO: 1439 | mm06775_Lpar1 | AAGTAGGAGTCACTGTAGAG |
| SEQ ID NO: 1440 | mm06776_Lpar1 | ACGAATGAGCAACCGGCGCG |
| SEQ ID NO: 1441 | mm06777_Cmklr1 | ACTCGCAAGTAGTTTCCACA |
| SEQ ID NO: 1442 | mm06778_Cmklr1 | GGCCGTTGCCTAGGAGACCG |
| SEQ ID NO: 1443 | mm06779_Cmklr1 | GGAGGAGGCGAGTCCGTGGG |
| SEQ ID NO: 1444 | mm06780_Cmklr1 | AGACGCTGGTGTACATGTTG |
| SEQ ID NO: 1445 | mm06797_Gpm6b | GTGTTGCTCAAGAATTGCCA |
| SEQ ID NO: 1446 | mm06798_Gpm6b | CCACTCCCAGCACATAGGTG |
| SEQ ID NO: 1447 | mm06799_Gpm6b | TACTCACACTTCACTCAGCA |
| SEQ ID NO: 1448 | mm06800_Gpm6b | ACAGATCTGCTCCACACCCG |
| SEQ ID NO: 1449 | mm06861_Gsr | GGCTATGCAACATTCGCAGA |
| SEQ ID NO: 1450 | mm06862_Gsr | CGGCCCCACGATGACGCTG |
| SEQ ID NO: 1451 | mm06863_Gsr | GCTGTGAGGGTAAATTCAGT |

TABLE 1-continued mmSurf sgRNA library sequences

| SEQ ID NO | id_gRNA Target | Sequence |
|---|---|---|
| SEQ ID NO: 1452 | mm06864_Gsr | AACATCTGGAATCATGGTCG |
| SEQ ID NO: 1453 | mm06913_Gria1 | ATGTTCACAATATCGATCTG |
| SEQ ID NO: 1454 | mm06914_Gria1 | CGTCGCTGACAATCTCAAGT |
| SEQ ID NO: 1455 | mm06915_Gria1 | TGTCAACATTCTAACAACCA |
| SEQ ID NO: 1456 | mm06916_Gria1 | AGTTTAACGAGAAAGGGCGC |
| SEQ ID NO: 1457 | mm06917_Gria2 | TGTCAGTCTGAACTCCGAAG |
| SEQ ID NO: 1458 | mm06918_Gria2 | TTGGACAGCATCATAAGTCA |
| SEQ ID NO: 1459 | mm06919_Gria2 | AGCTCAAAACAAATGGACCC |
| SEQ ID NO: 1460 | mm06920_Gria2 | CAGGTGACTGCTATCAATGT |
| SEQ ID NO: 1461 | mm06921_Gria4 | TGCATACATTGGTGTCAGCG |
| SEQ ID NO: 1462 | mm06922_Gria4 | GCATGTCAGTGCGATATGTG |
| SEQ ID NO: 1463 | mm06923_Gria4 | ACGTAGAGTTAATTACACAA |
| SEQ ID NO: 1464 | mm06924_Gria4 | TGCACCTCTGACAATCACGT |
| SEQ ID NO: 1465 | mm06925_Grid1 | GGCCAATAATCCGTTCCAGG |
| SEQ ID NO: 1466 | mm06926_Grid1 | GAAACTCCATAACCCCTGTG |
| SEQ ID NO: 1467 | mm06927_Grid1 | ATTCAAATATGAGATATACC |
| SEQ ID NO: 1468 | mm06928_Grid1 | GGACCAGATCCAGGATCTCG |
| SEQ ID NO: 1469 | mm06929_Grid2 | GATCCCATTTGCAATCGTGG |
| SEQ ID NO: 1470 | mm06930_Grid2 | AAACTGGAGAACAACATGCG |
| SEQ ID NO: 1471 | mm06931_Grid2 | GTAATAATCCTAGATATCCG |
| SEQ ID NO: 1472 | mm06932_Grid2 | CAAATATGGAAGCCCACAAG |
| SEQ ID NO: 1473 | mm06933_Grik2 | AAGCGAGTCCCAAAGCGCCA |
| SEQ ID NO: 1474 | mm06934_Grik2 | ACAGTGGCGTAAATATGACA |
| SEQ ID NO: 1475 | mm06935_Grik2 | CGAACATAGGTAATAGCCAG |
| SEQ ID NO: 1476 | mm06936_Grik2 | CTGTGTATCATATGTTAACG |
| SEQ ID NO: 1477 | mm06945_Grin1 | AACATCACTGATCCACCGCG |
| SEQ ID NO: 1478 | mm06946_Grin1 | GTGGACATCTGGTATCCTCG |
| SEQ ID NO: 1479 | mm06947_Grin1 | CTGTCCTATGACAACAAGCG |
| SEQ ID NO: 1480 | mm06948_Grin1 | AACCAGGCCAATAAGCGACA |
| SEQ ID NO: 1481 | mm06949_Grin2a | ATGGTAAAAGAAGGCCCATG |
| SEQ ID NO: 1482 | mm06950_Grin2a | AGAAGAAATCGTAGCCGGTG |
| SEQ ID NO: 1483 | mm06951_Grin2a | ATCTTGACAAACTTCCGACA |
| SEQ ID NO: 1484 | mm06952_Grin2a | TGTGTGCGACCTCATGTCCG |
| SEQ ID NO: 1485 | mm06953_Grin2b | TATCCTACGCTTGCTCCGAA |
| SEQ ID NO: 1486 | mm06954_Grin2b | GGCACCGGTTGTAACCCACA |
| SEQ ID NO: 1487 | mm06955_Grin2b | ACATCATGGAAGAATACGAC |
| SEQ ID NO: 1488 | mm06956_Grin2b | TGACTGGCTACGGCTACACA |
| SEQ ID NO: 1489 | mm06977_Grn | CCTATCCAAGAACTACACCA |

TABLE 1-continued mmSurf sgRNA library sequences

| SEQ ID NO | id_gRNA Target | Sequence |
|---|---|---|
| SEQ ID NO: 1490 | mm06978_Grn | CCCTGCACAAAAGACCAACA |
| SEQ ID NO: 1491 | mm06979_Grn | GACACTGGACAGCACCCAAG |
| SEQ ID NO: 1492 | mm06980_Grn | CACCTAGTGAAGTCATCACA |
| SEQ ID NO: 1493 | mm06985_Pdia3 | CTTCACCAGAGACTCAATGT |
| SEQ ID NO: 1494 | mm06986_Pdia3 | ATAGTCCACATCATAGTAAG |
| SEQ ID NO: 1495 | mm06987_Pdia3 | CTGCTACTTACCCACCACTG |
| SEQ ID NO: 1496 | mm06988_Pdia3 | AAACACCTGTAATAAGTATG |
| SEQ ID NO: 1497 | mm06989_Hspa5 | TGTGTTCAAGAACGGCCGCG |
| SEQ ID NO: 1498 | mm06990_Hspa5 | CCGTGGCATAAACCCCGATG |
| SEQ ID NO: 1499 | mm06991_Hspa5 | TGTGCAGAAACTCCGGCGTG |
| SEQ ID NO: 1500 | mm06992_Hspa5 | CATTCCAAGTGCGTCCGATG |
| SEQ ID NO: 1501 | mm07157_Gypa | TCTTCAAATAACCACTCCTG |
| SEQ ID NO: 1502 | mm07158_Gypa | TCAGCAACAATGTCAACACC |
| SEQ ID NO: 1503 | mm07159_Gypa | CATATCAACATACCTAGTGC |
| SEQ ID NO: 1504 | mm07160_Gypa | ACGCAGCAGACACTTCAGTA |
| SEQ ID NO: 1505 | mm07165_Gzma | CAAGAACTTACACGTTACAG |
| SEQ ID NO: 1506 | mm07166_Gzma | ATGATGAATATACACGTGAG |
| SEQ ID NO: 1507 | mm07167_Gzma | GCCATATACGGTCTTGAGTG |
| SEQ ID NO: 1508 | mm07168_Gzma | GATGCCGAGTAGCAGGATGG |
| SEQ ID NO: 1509 | mm07197_H13 | GGTATTCGGCACCAACGTGA |
| SEQ ID NO: 1510 | mm07198_H13 | CCCCAGCCAACGGCACGACG |
| SEQ ID NO: 1511 | mm07199_H13 | GAAAAAACTTATTCATGAAG |
| SEQ ID NO: 1512 | mm07200_H13 | TGAGTTTGACACTAAGGACC |
| SEQ ID NO: 1513 | mm07201_Hist1h1d | TCTTCAGCCCGAGCTTGATG |
| SEQ ID NO: 1514 | mm07202_Hist1h1d | TTCCGGTGAGGCTAAGCCCA |
| SEQ ID NO: 1515 | mm07203_Hist1h1d | AGAAGACCGGCGCCGCTGCT |
| SEQ ID NO: 1516 | mm07204_Hist1h1d | TGTCTTCTCCACAGGTGCAG |
| SEQ ID NO: 1517 | mm07209_H2-Aa | AATCCATCAGCCGACCACGT |
| SEQ ID NO: 1518 | mm07210_H2-Aa | GCTGTAGTAAAACACAACTT |
| SEQ ID NO: 1519 | mm07211_H2-Aa | AATTCCACCCCAGCTACCAA |
| SEQ ID NO: 1520 | mm07212_H2-Aa | AATAGCAAGTCAGTCGCAGA |
| SEQ ID NO: 1521 | mm07213_H2-Ab1 | GGTGTGCAGACACAACTACG |
| SEQ ID NO: 1522 | mm07214_H2-Ab1 | CAGATACATCTACAACCGGG |
| SEQ ID NO: 1523 | mm07215_H2-Ab1 | TCGTATGCGCTGCGTCCCGT |
| SEQ ID NO: 1524 | mm07216_H2-Ab1 | AGCAGACCGAGAGTGTTGTGG |
| SEQ ID NO: 1525 | mm07217_H2-D1 | GGCCCCGACTCAGACCCGCG |
| SEQ ID NO: 1526 | mm07218_H2-D1 | CGACGCAAGTGGGAGCAGAG |
| SEQ ID NO: 1527 | mm07219_H2-D1 | TAGCCGACAGAGATGTACCG |

TABLE 1-continued mmSurf sgRNA library sequences

| SEQ ID NO | id_gRNA Target | Sequence |
|---|---|---|
| SEQ ID NO: 1528 | mm07220_H2-D1 | GTGAGCCTGAGGAACCTGCT |
| SEQ ID NO: 1529 | mm07241_H2-M2 | ATAGCCAACAGTCATGTAGT |
| SEQ ID NO: 1530 | mm07242_H2-M2 | AGAGTGGGAGGCAACTAATG |
| SEQ ID NO: 1531 | mm07243_H2-M2 | CAGGTTCTCACACCATCCAA |
| SEQ ID NO: 1532 | mm07244_H2-M2 | TGCGATGTCGAAGTACCGCA |
| SEQ ID NO: 1533 | mm07245_H2-M3 | ACTGCGCTATTTCCACACTG |
| SEQ ID NO: 1534 | mm07246_H2-M3 | ATAGCATTGAGGAAATTCCG |
| SEQ ID NO: 1535 | mm07247_H2-M3 | AAAGTGCCAGAGCAAACCTT |
| SEQ ID NO: 1536 | mm07248_H2-M3 | GGAAAGACCAGAGTACTGGA |
| SEQ ID NO: 1537 | mm07253_H2-DMa | GTTTGGCAAGCCCAACACGT |
| SEQ ID NO: 1538 | mm07254_H2-DMa | ATAGAGTGTGCCGGAATGTG |
| SEQ ID NO: 1539 | mm07255_H2-DMa | AGGACGGGATTCCCAACATA |
| SEQ ID NO: 1540 | mm07256_H2-DMa | TCTGCAAAGTCAGGCAGTCG |
| SEQ ID NO: 1541 | mm07273_H2-Q1 | GCTGCGGTATTTCGAGACCT |
| SEQ ID NO: 1542 | mm07274_H2-Q1 | TCAGATGGGCGCCTTCAAAG |
| SEQ ID NO: 1543 | mm07275_H2-Q1 | AGTATTGGGAACGGAACACA |
| SEQ ID NO: 1544 | mm07276_H2-Q1 | GAAACACAGGACCTACCTGG |
| SEQ ID NO: 1545 | mm07277_H2-Q10 | TACCTGCAATACGCATACGA |
| SEQ ID NO: 1546 | mm07278_H2-Q10 | CCCCAGGCTCACACTCCATG |
| SEQ ID NO: 1547 | mm07279_H2-Q10 | TGGTGCTGCAGAGTATTACA |
| SEQ ID NO: 1548 | mm07280_H2-Q10 | TAACCGACAATAATGAACCG |
| SEQ ID NO: 1549 | mm07281_H2-Q2 | TGACATCACCTTGAGAACTG |
| SEQ ID NO: 1550 | mm07282_H2-Q2 | GTATTGGGAGCGGAACACAC |
| SEQ ID NO: 1551 | mm07283_H2-Q2 | TGGAGGTCGATTGCTTGACG |
| SEQ ID NO: 1552 | mm07284_H2-Q2 | GAAACTGACTGAGACACGCG |
| SEQ ID NO: 1553 | mm07285_H2-Q4 | TGGTGCTACAGAGAAAAGCA |
| SEQ ID NO: 1554 | mm07286_H2-Q4 | GATATGAGCCGCGGGCACCG |
| SEQ ID NO: 1555 | mm07287_H2-Q4 | GACCCTGATCGAGATCCGCG |
| SEQ ID NO: 1556 | mm07288_H2-Q4 | TGTCGGTTACGTGGACAACA |
| SEQ ID NO: 1557 | mm07289_H2-Q7 | CTGGTTGTAGTAGCTCTGTG |
| SEQ ID NO: 1558 | mm07290_H2-Q7 | TGGTATTGCAGAGAAAGACC |
| SEQ ID NO: 1559 | mm07291_H2-Q7 | GTGGACGGCGGTGGACATGG |
| SEQ ID NO: 1560 | mm07292_H2-Q7 | CGTGCGCTTCGACAGCGATG |
| SEQ ID NO: 1561 | mm07297_H2-T23 | TACTACAATCAGAGTAACGA |
| SEQ ID NO: 1562 | mm07298_H2-T23 | CTGAAGATGAAGTCACCCTG |
| SEQ ID NO: 1563 | mm07299_H2-T23 | GTGTCTCATTTCCCAGCCGT |
| SEQ ID NO: 1564 | mm07300_H2-T23 | CTTGTGCTTAGAGATCTGTG |
| SEQ ID NO: 1565 | mm07409_Hcn1 | GAGTACCTATCCGATCGAGT |

TABLE 1-continued mmSurf sgRNA library sequences

| SEQ ID NO | id_gRNA Target | Sequence |
|---|---|---|
| SEQ ID NO: 1566 | mm07410_Hcn1 | TAATCAGATACATACACCAG |
| SEQ ID NO: 1567 | mm07411_Hon1 | GTGTGCTTCAAGGTGGACGG |
| SEQ ID NO: 1568 | mm07412_Hon1 | CAGAGCAGACGACAACACCG |
| SEQ ID NO: 1569 | mm07465_Hbegf | ACTCTCACCGGTCACCAACG |
| SEQ ID NO: 1570 | mm07466_Hbegf | CAAGGACTACTGCATCCACG |
| SEQ ID NO: 1571 | mm07467_Hbegf | ACAAACCAGCTGCTACCCAC |
| SEQ ID NO: 1572 | mm07468_Hbegf | GTGGAGCACTTACTTGCAAG |
| SEQ ID NO: 1573 | mm07477_Heph | CATGTGCAAGGGTGATACTG |
| SEQ ID NO: 1574 | mm07478_Heph | TTGGAGCATCTACATGCGAG |
| SEQ ID NO: 1575 | mm07479_Heph | GTTTATAAGGAATACAGTGA |
| SEQ ID NO: 1576 | mm07480_Heph | AAAAGTCACATACTACTGGA |
| SEQ ID NO: 1577 | mm07505_Hexa | ACGCCCCGGTGAGGGAATCG |
| SEQ ID NO: 1578 | mm07506_Hexa | AGGAGGTCATTGAATACGCA |
| SEQ ID NO: 1579 | mm07507_Hexa | AGTGAAGCTCTCATATGGGA |
| SEQ ID NO: 1580 | mm07508_Hexa | AGCAAGGTGTTAATAACCCA |
| SEQ ID NO: 1581 | mm07509_Hexb | GCTCAGCTCGAAATCTAGCA |
| SEQ ID NO: 1582 | mm07510_Hexb | TACACCAAACGATGTCCGGA |
| SEQ ID NO: 1583 | mm07511_Hexb | GCGGAGATGTACAACAGCCG |
| SEQ ID NO: 1584 | mm07512_Hexb | TAACGCTCCCCAAACGCTGT |
| SEQ ID NO: 1585 | mm07521_Hfe | TGCTCCACGTACCCTTACTG |
| SEQ ID NO: 1586 | mm07522_Hfe | TTCCTCCCGCACTCACGCGG |
| SEQ ID NO: 1587 | mm07523_Hfe | GATCCGTGCCAAACAGAACA |
| SEQ ID NO: 1588 | mm07524_Hfe | CATGAAGACAACAGTACCAG |
| SEQ ID NO: 1589 | mm07573_Hhip | TTGAAGTGAGGGTTACTCCG |
| SEQ ID NO: 1590 | mm07574_Hhip | AAGACTACGAGAAAGTGGGG |
| SEQ ID NO: 1591 | mm07575_Hhip | TGCGACTTCCAGAAACACCC |
| SEQ ID NO: 1592 | mm07576_Hhip | GTGGGTAGAAGCCACCACAC |
| SEQ ID NO: 1593 | mm07669_Hmgcr | TCATCATCCTGACGATAACG |
| SEQ ID NO: 1594 | mm07670_Hmgcr | CATTAGGTCGTGGCTCGATG |
| SEQ ID NO: 1595 | mm07671_Hmgcr | GCCAAATTGGACGACCCTCA |
| SEQ ID NO: 1596 | mm07672_Hmgcr | AACTGCCAGAGAGAAACACT |
| SEQ ID NO: 1597 | mm07749_Hnrnpk | GATGATATGAGCCCTCGTCG |
| SEQ ID NO: 1598 | mm07750_Hnrnpk | CTGTTGGGACATACCGCTCG |
| SEQ ID NO: 1599 | mm07751_Hnrnpk | ATCCCTACCTTGGAAGAGGT |
| SEQ ID NO: 1600 | mm07752_Hnrnpk | ATACCTCAGATATAAGGTCA |
| SEQ ID NO: 1601 | mm07925_Lipc | TTATCATGATCATCCACGGG |
| SEQ ID NO: 1602 | mm07926_Lipc | AGGAGAAAGGCGCTCGTTGG |
| SEQ ID NO: 1603 | mm07927_Lipc | CATAACCCAGAGTGTTGCAA |

TABLE 1-continued mmSurf sgRNA library sequences

| SEQ ID NO | id_gRNA Target | Sequence |
|---|---|---|
| SEQ ID NO: 1604 | mm07928_Lipc | GGTGTAGTGCTGGTATGCCA |
| SEQ ID NO: 1605 | mm07929_Hpn | GGTGGGTCCATCATAACGC |
| SEQ ID NO: 1606 | mm07930_Hpn | GGAGCTAGAGAGGTGGACCA |
| SEQ ID NO: 1607 | mm07931_Hpn | CTCACGCTCCAATGCCAGGG |
| SEQ ID NO: 1608 | mm07932_Hpn | ACCCCCAGTTGCACAGCATG |
| SEQ ID NO: 1609 | mm07985_Hspa8 | TTAGACCGTTACCAACGCTG |
| SEQ ID NO: 1610 | mm07986_Hspa8 | GAAAGCAACATAGCTTGGCG |
| SEQ ID NO: 1611 | mm07987_Hspa8 | TGGTGGTATTGCGCTTGATG |
| SEQ ID NO: 1612 | mm07988_Hspa8 | CTACAGGGTCCAGTGTGCCA |
| SEQ ID NO: 1613 | mm08061_Hspd1 | CGGAGAAGCTCTAAGCACGC |
| SEQ ID NO: 1614 | mm08062_Hspd1 | TCTTGAACTAGGTGTGATGT |
| SEQ ID NO: 1615 | mm08063_Hspd1 | AGGGACAATGGACTGAACAC |
| SEQ ID NO: 1616 | mm08064_Hspd1 | TGACTTAGGAAAAGTTGGGG |
| SEQ ID NO: 1617 | mm08069_Hspa2 | CAAGAGCATTAATCCCGACG |
| SEQ ID NO: 1618 | mm08070_Hspa2 | GAAGCACTGGCCGTTCCGAG |
| SEQ ID NO: 1619 | mm08071_Hspa2 | GAGATCGACTCGCTCTACGA |
| SEQ ID NO: 1620 | mm08072_Hspa2 | GGTCAGGATGGACACATCGA |
| SEQ ID NO: 1621 | mm08073_Hsp90ab1 | CATTAGAGATCAACTCGCGG |
| SEQ ID NO: 1622 | mm08074_Hsp90ab1 | CCTCGGAGTCAACCACACCG |
| SEQ ID NO: 1623 | mm08075_Hsp90ab1 | AGGTCGAAGGGAGCCCGCCG |
| SEQ ID NO: 1624 | mm08076_Hsp90ab1 | TGAAGATGTGGGATCCGATG |
| SEQ ID NO: 1625 | mm08077_Hsp90aa1 | GCTTCAGCTTGGAATTCACG |
| SEQ ID NO: 1626 | mm08078_Hsp90aa1 | CAGTAAACTGGACTCGGGGA |
| SEQ ID NO: 1627 | mm08079_Hsp90aa1 | CCTACTTACTCAGATACTCA |
| SEQ ID NO: 1628 | mm08080_Hsp90aa1 | AGACCAAACAGAGTATTTGG |
| SEQ ID NO: 1629 | mm08093_Sdc2 | GGGGAAGCAGCACTAGTGAG |
| SEQ ID NO: 1630 | mm08094_Sdc2 | GTCACCTGAAGAAACTGACA |
| SEQ ID NO: 1631 | mm08095_Sdc2 | CCTTGACAATAGCTCCATTG |
| SEQ ID NO: 1632 | mm08096_Sdc2 | GATGACTATTCTTCTGCCTC |
| SEQ ID NO: 1633 | mm08097_Hspg2 | TCTACGGCTACACCACATGT |
| SEQ ID NO: 1634 | mm08098_Hspg2 | GGGAGGACGAGGATTCAATG |
| SEQ ID NO: 1635 | mm08099_Hspg2 | TACTATGGGGATGCCCAACG |
| SEQ ID NO: 1636 | mm08100_Hspg2 | GTGCGCTATGAACTGGCACG |
| SEQ ID NO: 1637 | mm08129_Htr2c | TATTGATATTGCCCAAACGA |
| SEQ ID NO: 1638 | mm08130_Htr2c | ACATCAGGGTTTGACGGCGT |
| SEQ ID NO: 1639 | mm08131_Htr2c | AAACAAGCGTCCACCATCGG |
| SEQ ID NO: 1640 | mm08132_Htr2c | AAGAAAGAAAAGCGGCCTAG |
| SEQ ID NO: 1641 | mm08133_Htr3a | CCTGGCTAACTACAAGAAGG |

TABLE 1-continued mmSurf sgRNA library sequences

| SEQ ID NO | id_gRNA Target | Sequence |
|---|---|---|
| SEQ ID NO: 1642 | mm08134_Htr3a | CTGCCGGTACCATATGTAGG |
| SEQ ID NO: 1643 | mm08135_Htr3a | GGACTCACAACTCATTGATG |
| SEQ ID NO: 1644 | mm08136_Htr3a | AGGACATCAACATTACCCTG |
| SEQ ID NO: 1645 | mm08185_Hyal2 | AAAGTTGCGGCTGTGTACGG |
| SEQ ID NO: 1646 | mm08186_Hyal2 | GAACACTCTCCGTTACGTCA |
| SEQ ID NO: 1647 | mm08187_Hyal2 | GGGACGCGTGAAGACGTACA |
| SEQ ID NO: 1648 | mm08188_Hyal2 | ACCTTCTACTACGACCGTCT |
| SEQ ID NO: 1649 | mm08201_Icam1 | GTGAAGTGTGAAGCCCACAG |
| SEQ ID NO: 1650 | mm08202_Icam1 | GCCCTGCCACTCACAATACA |
| SEQ ID NO: 1651 | mm08203_Icam1 | GAGAACAATGCCAGCCCTTG |
| SEQ ID NO: 1652 | mm08204_Icam1 | GCGGTGCTCCACCATCCACG |
| SEQ ID NO: 1653 | mm08205_Icam2 | TCTTCACCCACAAACACCCG |
| SEQ ID NO: 1654 | mm08206_Icam2 | GGACCATATGTAGACCTCAA |
| SEQ ID NO: 1655 | mm08207_Icam2 | AACTGCGCAGCCCCAGACAT |
| SEQ ID NO: 1656 | mm08208_Icam2 | ATGTTGGAAGAGCATCCTCA |
| SEQ ID NO: 1657 | mm08269_Cxcl10 | ACTCACATGATCTCAACACG |
| SEQ ID NO: 1658 | mm08270_Cxcl10 | CAGCGGACCGTCCTTGCGAG |
| SEQ ID NO: 1659 | mm08271_Cxcl10 | ACTGCATCCATATCGATGAC |
| SEQ ID NO: 1660 | mm08272_Cxcl10 | TGACGGGCCAGTGAGAATGA |
| SEQ ID NO: 1661 | mm08333_Ifnar1 | ACAGTTGACATAAACAAGCA |
| SEQ ID NO: 1662 | mm08334_Ifnar1 | CTTCTAAACGTACTTCTGGG |
| SEQ ID NO: 1663 | mm08335_Ifnar1 | TCTCCATGTACAAGCCTCAG |
| SEQ ID NO: 1664 | mm08336_Ifnar1 | GTGCAGTGTATAAGCACCAC |
| SEQ ID NO: 1665 | mm08337_Ifnar2 | CAAAGACGAAAATCTGACGA |
| SEQ ID NO: 1666 | mm08338_Ifnar2 | GCCATCGTCATAGTGCACAG |
| SEQ ID NO: 1667 | mm08339_Ifnar2 | TAACCTGGATAATCCCTGAA |
| SEQ ID NO: 1668 | mm08340_Ifnar2 | ACTGTGGAATTACGATTATG |
| SEQ ID NO: 1669 | mm08345_Ifng | TCTATGCCACTTGAGTTCTG |
| SEQ ID NO: 1670 | mm08346_Ifng | GTTTCTGGCTGTTACTGCCA |
| SEQ ID NO: 1671 | mm08347_Ifng | TGCTGAAGAAGGTAGTAATC |
| SEQ ID NO: 1672 | mm08348_Ifng | TCAAGACTTCAAAGAGTCTG |
| SEQ ID NO: 1673 | mm08365_Cd79b | TGACCTGGTTCCGAAAGCGA |
| SEQ ID NO: 1674 | mm08366_Cd79b | TCCCCCAGGATTCAGCACGT |
| SEQ ID NO: 1675 | mm08367_Cd79b | CATAATGTCACCGACAGCTG |
| SEQ ID NO: 1676 | mm08368_Cd79b | CGAGGTTTGCAGCCAAAAAG |
| SEQ ID NO: 1677 | mm08373_Igf1r | AGAACCGAATCATCATAACG |
| SEQ ID NO: 1678 | mm08374_Igf1r | GGAAAACGACCATATCCGTG |
| SEQ ID NO: 1679 | mm08375_Igf1r | CTATGGTGGAGAGGTAACAG |

TABLE 1-continued mmSurf sgRNA library sequences

| SEQ ID NO | id_gRNA Target | Sequence |
|---|---|---|
| SEQ ID NO: 1680 | mm08376_Igf1r | CTGCTTATTAACATCCGGAG |
| SEQ ID NO: 1681 | mm08381_Igf2r | AGGACATTGACTCCACACGA |
| SEQ ID NO: 1682 | mm08382_Igf2r | TGAAAATGAACTATACTGGG |
| SEQ ID NO: 1683 | mm08383_Igf2r | GTCACACCGTCTGTCCACTG |
| SEQ ID NO: 1684 | mm08384_Igf2r | GGACAGACGAGGATCAGTGT |
| SEQ ID NO: 1685 | mm08401_Igfbp3 | GGCGTCTACACGGAGCGCTG |
| SEQ ID NO: 1686 | mm08402_Igfbp3 | ACGGTTCGCAGCGCACCACG |
| SEQ ID NO: 1687 | mm08403_Igfbp3 | GGAACTTGGAATCGGTCACT |
| SEQ ID NO: 1688 | mm08404_Igfbp3 | CCGAGGAGGAGCACAATGCT |
| SEQ ID NO: 1689 | mm08425_Igll1 | CTGTTCCAGATCATCCCACG |
| SEQ ID NO: 1690 | mm08426_Igll1 | GCTCACCAAACACACTAGTG |
| SEQ ID NO: 1691 | mm08427_Igll1 | CCAAAGACATACCAAAACTG |
| SEQ ID NO: 1692 | mm08428_Igll1 | GGAGAACTTCACACTGCCTG |
| SEQ ID NO: 1693 | mm08437_Cd74 | GCTGATGCGTCCAATGTCCA |
| SEQ ID NO: 1694 | mm08438_Cd74 | CCATGTGATGCATCTGCTCA |
| SEQ ID NO: 1695 | mm08439_Cd74 | CATGGATGGCGTGAACTGGA |
| SEQ ID NO: 1696 | mm08440_Cd74 | AGCCGTGGAGCTCTGTACAC |
| SEQ ID NO: 1697 | mm08457_Il10rb | TGGCGGATGAACATTCGGAG |
| SEQ ID NO: 1698 | mm08458_Il10rb | ATTTCAAGAACATTCTACAG |
| SEQ ID NO: 1699 | mm08459_Il10rb | CGGAGGACCTCAGAGTCGTA |
| SEQ ID NO: 1700 | mm08460_Il10rb | AGAGAAGTCGCACTGAGTCG |
| SEQ ID NO: 1701 | mm08473_Il12rb1 | GTCGGTGAGGAACCAAACCG |
| SEQ ID NO: 1702 | mm08474_Il12rb1 | CCTCCGAACCATACCCACAC |
| SEQ ID NO: 1703 | mm08475_Il12rb1 | TGAGAAGACATCGTTCCCAG |
| SEQ ID NO: 1704 | mm08476_Il12rb1 | TCAAGGTGTCACAATCACAC |
| SEQ ID NO: 1705 | mm08477_Il12rb2 | ACTGAGAACACGAACACCAG |
| SEQ ID NO: 1706 | mm08478_Il12rb2 | ATTAACATAGTGGACCTATG |
| SEQ ID NO: 1707 | mm08479_Il12rb2 | AGAGCAGACATGTTGTCCGG |
| SEQ ID NO: 1708 | mm08480_Il12rb2 | CTATCAGGTGACGTTACAAG |
| SEQ ID NO: 1709 | mm08481_Il13 | ACCATGCTGCCGTTGCACAG |
| SEQ ID NO: 1710 | mm08482_Il13 | AGAGACACAGATCTTGGCAC |
| SEQ ID NO: 1711 | mm08483_Il13 | AGATGTTGGTCAGGGAATCC |
| SEQ ID NO: 1712 | mm08484_Il13 | CAGGTTCCTTACCCCGCCAG |
| SEQ ID NO: 1713 | mm08493_Il15 | ATATCTTACATCTATCCAGT |
| SEQ ID NO: 1714 | mm08494_Il15 | GAAACACAAGTAGCACGAGA |
| SEQ ID NO: 1715 | mm08495_Il15 | AATGTGTACTCACTTGAATA |
| SEQ ID NO: 1716 | mm08496_Il15 | GTCACTGTCAGTGTATAAAG |
| SEQ ID NO: 1717 | mm08505_Il17a | CTCAGCGTGTCCAAACACTG |

TABLE 1-continued mmSurf sgRNA library sequences

| SEQ ID NO | id_gRNA Target | Sequence |
|---|---|---|
| SEQ ID NO: 1718 | mm08506_Il17a | GAACGGTTGAGGTAGTCTGA |
| SEQ ID NO: 1719 | mm08507_Il17a | CTTACGTACTGGAGAGTCCA |
| SEQ ID NO: 1720 | mm08508_Il17a | CTGAGCTTCCCAGATCACAG |
| SEQ ID NO: 1721 | mm08509_Il17ra | ACTGAAGTAGCAAACAACGT |
| SEQ ID NO: 1722 | mm08510_Il17ra | ATGAGGCCATACACCCACAG |
| SEQ ID NO: 1723 | mm08511_Il17ra | GAAGGTCTGGATCGTCTACT |
| SEQ ID NO: 1724 | mm08512_Il17ra | GACCTGGAGATGTTTGAACC |
| SEQ ID NO: 1725 | mm08521_Il1a | ATGTATGCCTACTCGTCGGG |
| SEQ ID NO: 1726 | mm08522_Il1a | TTACCTGATTCAGAGAGAGA |
| SEQ ID NO: 1727 | mm08523_Il1a | TCCATAACCCATGATCTGGA |
| SEQ ID NO: 1728 | mm08524_Il1a | GGACATCTTTGACGTTTCAG |
| SEQ ID NO: 1729 | mm08529_Il1r1 | AGCATACAATTGTAGCCGTG |
| SEQ ID NO: 1730 | mm08530_Il1r1 | CAGCAAGACCCCCATATCAG |
| SEQ ID NO: 1731 | mm08531_Il1r1 | CGTATGTCCTATACGTTCCG |
| SEQ ID NO: 1732 | mm08532_Il1r1 | ACTGTGTTAGAGAATGACCC |
| SEQ ID NO: 1733 | mm08533_Il1r2 | TGTCGGAGTGAGGTGCCAAG |
| SEQ ID NO: 1734 | mm08534_Il1r2 | AGGGCACACTAGTAACCCGG |
| SEQ ID NO: 1735 | mm08535_Il1r2 | GACTATCAGTCTTGACCCTG |
| SEQ ID NO: 1736 | mm08536_Il1r2 | GGGCTTCTCCGATGTAATGG |
| SEQ ID NO: 1737 | mm08541_Il1rap | TACACAGTAGAACTCGCCTG |
| SEQ ID NO: 1738 | mm08542_Il1rap | TTTCATAATGTACTACCCGA |
| SEQ ID NO: 1739 | mm08543_Il1rap | TGGTCCACCAGACCTCATTG |
| SEQ ID NO: 1740 | mm08544_Il1rap | CATCAAGAAAGTCACCCCGG |
| SEQ ID NO: 1741 | mm08549_Il18r1 | TCACCGATCACAAATTCATG |
| SEQ ID NO: 1742 | mm08550_Il18r1 | CTGTCCACCATAATGGGACA |
| SEQ ID NO: 1743 | mm08551_Il18r1 | ATTCTGGCCAGTTGAGATGG |
| SEQ ID NO: 1744 | mm08552_Il18r1 | TGTCAACTTCTATCTAGGAA |
| SEQ ID NO: 1745 | mm08557_Il2ra | GTGTCTGTATGACCCACCCG |
| SEQ ID NO: 1746 | mm08558_Il2ra | ATCTTGCAGATGCTAATAGC |
| SEQ ID NO: 1747 | mm08559_Il2ra | GAGAGGTTTCCGAAGACTAA |
| SEQ ID NO: 1748 | mm08560_Il2ra | GAATCTTCATGTTTCCAAGG |
| SEQ ID NO: 1749 | mm08561_Il2rb | GGACCTCCTTGACATAAATG |
| SEQ ID NO: 1750 | mm08562_Il2rb | TCTCCGTCGAGCACTTCCAG |
| SEQ ID NO: 1751 | mm08563_Il2rb | AAGCTCAACGAAACAATACC |
| SEQ ID NO: 1752 | mm08564_Il2rb | AGGTATCTGAGCCATGACAT |
| SEQ ID NO: 1753 | mm08565_Il2rg | TTCCACAGATTGGGTTATAG |
| SEQ ID NO: 1754 | mm08566_Il2rg | GGAGCAACAGAGATCGAAGC |
| SEQ ID NO: 1755 | mm08567_Il2rg | CCCGATTACCAAGATTCTGT |

TABLE 1-continued mmSurf sgRNA library sequences

| SEQ ID NO | id_gRNA Target | Sequence |
|---|---|---|
| SEQ ID NO: 1756 | mm08568_Il2rg | CATACCTATAGTGCAGCGTG |
| SEQ ID NO: 1757 | mm08573_Il3ra | TTGCACTCCACTGTCAACGT |
| SEQ ID NO: 1758 | mm08574_Il3ra | GGATGTTCTGGCGTGATGTG |
| SEQ ID NO: 1759 | mm08575_Il3ra | GACAACAGCTGCGGTCCGTG |
| SEQ ID NO: 1760 | mm08576_Il3ra | CGGCGCTGACATCACGACAG |
| SEQ ID NO: 1761 | mm08577_Il4 | CAGAGAGTGAGCTCGTCTGT |
| SEQ ID NO: 1762 | mm08578_Il4 | TGTACCAGGAGCCATATCCA |
| SEQ ID NO: 1763 | mm08579_Il4 | CTAGAGTTCTTCTTCAAGCA |
| SEQ ID NO: 1764 | mm08580_Il4 | AATCACTTGAGAGAGATCAT |
| SEQ ID NO: 1765 | mm08593_Il6 | TATACCACTTCACAAGTCGG |
| SEQ ID NO: 1766 | mm08594_Il6 | CCTACTTCACAAGTCCGGAG |
| SEQ ID NO: 1767 | mm08595_Il6 | ATGGTACTCCAGAAGACCAG |
| SEQ ID NO: 1768 | mm08596_Il6 | ACATGTTCTCTGGGAAATCG |
| SEQ ID NO: 1769 | mm08597_Il6ra | CTGTGCGTTGCAAACAGTGT |
| SEQ ID NO: 1770 | mm08598_Il6ra | GGGGCAAATCAGGGTAACGG |
| SEQ ID NO: 1771 | mm08599_Il6ra | CAGGTATGGCTGATACCACA |
| SEQ ID NO: 1772 | mm08600_Il6ra | CACCCCCTCTCCAACCACGA |
| SEQ ID NO: 1773 | mm08601_Il6st | TAACTCCGTATTCGCCACG |
| SEQ ID NO: 1774 | mm08602_Il6st | TCTAAGTACCTTTATCCACG |
| SEQ ID NO: 1775 | mm08603_Il6st | ATCCGGTCCATTAAGGACAG |
| SEQ ID NO: 1776 | mm08604_Il6st | GAGTAGTGATACGTTGTACA |
| SEQ ID NO: 1777 | mm08609_Il7r | GGGAGACTAGGCCATACGAC |
| SEQ ID NO: 1778 | mm08610_Il7r | AGACCTAGAAGATGCAGACG |
| SEQ ID NO: 1779 | mm08611_Il7r | CAGAACCCAAGAATCAAGGT |
| SEQ ID NO: 1780 | mm08612_Il7r | CCTTTGAAGTAATCGTTATG |
| SEQ ID NO: 1781 | mm08637_Lrig1 | GTAGCGAACCTAAGACTGTG |
| SEQ ID NO: 1782 | mm08638_Lrig1 | TGTCCTTCAACAACCTCACG |
| SEQ ID NO: 1783 | mm08639_Lrig1 | GGTACAATCGAGGATACCAG |
| SEQ ID NO: 1784 | mm08640_Lrig1 | GAGCATTTGATGGTCTGTCG |
| SEQ ID NO: 1785 | mm08705_Insr | CGAGGATTACCTGCACAACG |
| SEQ ID NO: 1786 | mm08706_Insr | GTGATACCAGAGCATAGGAG |
| SEQ ID NO: 1787 | mm08707_Insr | CACACTGCACCTCTCATCTG |
| SEQ ID NO: 1788 | mm08708_Insr | TATAGCCAGACGGGCACTCG |
| SEQ ID NO: 1789 | mm08773_Itga2 | TGGCCAGTATAATTTGCTCG |
| SEQ ID NO: 1790 | mm08774_Itga2 | TACAACTACAACATCCACGA |
| SEQ ID NO: 1791 | mm08775_Itga2 | TCAGAGCTATCGAATTCGCA |
| SEQ ID NO: 1792 | mm08776_Itga2 | TTTCAATGTGGCCGACGAAG |
| SEQ ID NO: 1793 | mm08777_Itga2b | GCCTATCTGCCACACCACGG |

TABLE 1-continued mmSurf sgRNA library sequences

| SEQ ID NO | id_gRNA Target | Sequence |
|---|---|---|
| SEQ ID NO: 1794 | mm08778_Itga2b | GCCACAAAAGGGTACCCGGG |
| SEQ ID NO: 1795 | mm08779_Itga2b | CCTACACAGCGTGTCCATCG |
| SEQ ID NO: 1796 | mm08780_Itga2b | CGATGTCTACAGCACCACGA |
| SEQ ID NO: 1797 | mm08781_Itga3 | GGCTATGGAGAATCACACTG |
| SEQ ID NO: 1798 | mm08782_Itga3 | GTGGGCAAGTGCTATGTGCG |
| SEQ ID NO: 1799 | mm08783_Itga3 | GTACACAGCACCAGTCCGGT |
| SEQ ID NO: 1800 | mm08784_Itga3 | AGGTAGCTGTACAAAGCGCA |
| SEQ ID NO: 1801 | mm08785_Itga5 | TTTGCTGTCAAATTGAATGG |
| SEQ ID NO: 1802 | mm08786_Itga5 | GTCTTACATAGCCATAGGTG |
| SEQ ID NO: 1803 | mm08787_Itga5 | GACCCACAGAATGACCCAGT |
| SEQ ID NO: 1804 | mm08788_Itga5 | GTCGTATTTATATTCCCGGG |
| SEQ ID NO: 1805 | mm08789_Itga6 | GAGGGGACATCGCCTTACTT |
| SEQ ID NO: 1806 | mm08790_Itga6 | GCAGAGGGCGAACAGAACAG |
| SEQ ID NO: 1807 | mm08791_Itga6 | GAGTATATATTTGACGGAGA |
| SEQ ID NO: 1808 | mm08792_Itga6 | GGAGACTGGAGTTTCTGCGA |
| SEQ ID NO: 1809 | mm08793_Itga7 | GGTTCGGAGACCATATGACA |
| SEQ ID NO: 1810 | mm08794_Itga7 | GTGTATGTGTACATGAACCA |
| SEQ ID NO: 1811 | mm08795_Itga7 | CCCACTCAATGCGAACAGGG |
| SEQ ID NO: 1812 | mm08796_Itga7 | CTTAGATTATATGTTAGATG |
| SEQ ID NO: 1813 | mm08797_Itgae | TACTCACCAAAACACCATTG |
| SEQ ID NO: 1814 | mm08798_Itgae | TCCTTCTATCCGTCGCACAA |
| SEQ ID NO: 1815 | mm08799_Itgae | ATACGGTCAGGTCAACCACA |
| SEQ ID NO: 1816 | mm08800_Itgae | CTGTGCGAGTTGATATTGAA |
| SEQ ID NO: 1817 | mm08801_Itgal | CATAACCCGCTACATCATCG |
| SEQ ID NO: 1818 | mm08802_Itgal | CGCTGCCTAGCAGAACATCG |
| SEQ ID NO: 1819 | mm08803_Itgal | GAAACACGGAGTCAAGCTCA |
| SEQ ID NO: 1820 | mm08804_Itgal | AACACCAAGGGACCAAAAGG |
| SEQ ID NO: 1821 | mm08805_Itgam | AGGGATGACCCTGATCACCG |
| SEQ ID NO: 1822 | mm08806_Itgam | TGGGCGCCTATGATCCGCTG |
| SEQ ID NO: 1823 | mm08807_Itgam | CCTGCGCCTCAATTATACAC |
| SEQ ID NO: 1824 | mm08808_Itgam | GGTCATTCGCTACGTAATTG |
| SEQ ID NO: 1825 | mm08809_Itgav | GGTGCCATCTCAAATCCTCG |
| SEQ ID NO: 1826 | mm08810_Itgav | TCATGGACCGAGGTTCCGAT |
| SEQ ID NO: 1827 | mm08811_Itgav | CCTGCATGGAGCATACTCAA |
| SEQ ID NO: 1828 | mm08812_Itgav | ATAATAACCAATTAGCAACA |
| SEQ ID NO: 1829 | mm08813_Itgax | CCATGAATACGTATTCAGCG |
| SEQ ID NO: 1830 | mm08814_Itgax | TCTTCAAGGAGACAAAGACC |
| SEQ ID NO: 1831 | mm08815_Itgax | CATGACATGCTTGATAGCCG |

TABLE 1-continued mmSurf sgRNA library sequences

| SEQ ID NO | id_gRNA Target | Sequence |
|---|---|---|
| SEQ ID NO: 1832 | mm08816_Itgax | TACAAATGTGGCTATCACAC |
| SEQ ID NO: 1833 | mm08817_Itgb1 | GAGGAATGTAACACGACTGC |
| SEQ ID NO: 1834 | mm08818_Itgb1 | TCCCAACATTCCTACCAATG |
| SEQ ID NO: 1835 | mm08819_Itgb1 | GGAAATGGGACATTTGAGTG |
| SEQ ID NO: 1836 | mm08820_Itgb1 | GCAATTGAAGGATAATCCTA |
| SEQ ID NO: 1837 | mm08825_Itgb2 | GAGTATAGGCAAATCCCGTG |
| SEQ ID NO: 1838 | mm08826_Itgb2 | TTGGCTGGCGCAATGTCACG |
| SEQ ID NO: 1839 | mm08827_Itgb2 | ATCCTGAGTTCGACCAACGG |
| SEQ ID NO: 1840 | mm08828_Itgb2 | TGGAGTAGGAGAGATCCATG |
| SEQ ID NO: 1841 | mm08833_Itgb3 | GCAGGTGGAGGATTACCCCG |
| SEQ ID NO: 1842 | mm08834_Itgb3 | AATATGGGTCTTGGCATCCG |
| SEQ ID NO: 1843 | mm08835_Itgb3 | TTCTCCTTCAGGTTACATCG |
| SEQ ID NO: 1844 | mm08836_Itgb3 | CGATACAGGCTTGTCCACGA |
| SEQ ID NO: 1845 | mm08841_Itgb5 | CAAAAGACCCGAAACCTAAG |
| SEQ ID NO: 1846 | mm08842_Itgb5 | CCGCATCAAACCCCCCCTCG |
| SEQ ID NO: 1847 | mm08843_Itgb5 | GAACCACTATATGCTCTACA |
| SEQ ID NO: 1848 | mm08844_Itgb5 | TGCTGAGAGGTAGGTTCCGG |
| SEQ ID NO: 1849 | mm08845_Itgb6 | TGTCTACACTAAAGGAACTG |
| SEQ ID NO: 1850 | mm08846_Itgb6 | TGAGGTAATACAGATCTACT |
| SEQ ID NO: 1851 | mm08847_Itgb6 | ATGGGTCCTCACTGCGAGTG |
| SEQ ID NO: 1852 | mm08848_Itgb6 | TTTGGCTAAAAGATTCGCTG |
| SEQ ID NO: 1853 | mm08849_Itgb7 | ACAGTGTGCGACTGTAACTG |
| SEQ ID NO: 1854 | mm08850_Itgb7 | CGTGACGCGGATCCGCTGCG |
| SEQ ID NO: 1855 | mm08851_Itgb7 | GTGGCTGACAACGCTCCAGT |
| SEQ ID NO: 1856 | mm08852_Itgb7 | TGATGTCCGAGTCAACCAGA |
| SEQ ID NO: 1857 | mm08853_Cd47 | ATCAGCCTGTTCTTACGAGG |
| SEQ ID NO: 1858 | mm08854_Cd47 | GGATAAGCGCGATGCCATGG |
| SEQ ID NO: 1859 | mm08855_Cd47 | CACTTCATGCAATGAAACTG |
| SEQ ID NO: 1860 | mm08856_Cd47 | GAATGATTCTCTTATTCGTA |
| SEQ ID NO: 1861 | mm08881_Stt3a | AAGGTGGTACGTAACGATGG |
| SEQ ID NO: 1862 | mm08882_Stt3a | TACCATGTAGAAATAAGCGA |
| SEQ ID NO: 1863 | mm08883_Stt3a | GTTTACCTGGAAACCAACAA |
| SEQ ID NO: 1864 | mm08884_Stt3a | ACTTTAATTATCGGACTACC |
| SEQ ID NO: 1865 | mm08901_Itpr1 | CTGTGAAATATGCCCGACTG |
| SEQ ID NO: 1866 | mm08902_Itpr1 | ACACGAACGATGTCATCGAG |
| SEQ ID NO: 1867 | mm08903_Itpr1 | AAACGTGTCAATCTCTGCCG |
| SEQ ID NO: 1868 | mm08904_Itpr1 | GGAAGCTGAGAACTCCACAG |
| SEQ ID NO: 1869 | mm08921_Jag1 | TCTGACCCCTGCCATAACCG |

TABLE 1-continued mmSurf sgRNA library sequences

| SEQ ID NO | id_gRNA Target | Sequence |
|---|---|---|
| SEQ ID NO: 1870 | mm08922_Jag1 | GAAGCCACGTGTAATAATGG |
| SEQ ID NO: 1871 | mm08923_Jag1 | TGACTTACGTACCCGACAGG |
| SEQ ID NO: 1872 | mm08924_Jag1 | ACTGGCACGATTGTAGCACT |
| SEQ ID NO: 1873 | mm08941_F11r | AGGTGGCCAGAACTACGGGG |
| SEQ ID NO: 1874 | mm08942_F11r | GTGGAGTGGAAGTTCGTCCA |
| SEQ ID NO: 1875 | mm08943_F11r | TTGAACCAGGAATATTCAGA |
| SEQ ID NO: 1876 | mm08944_F11r | CACTATTGATCCAAAGTCGG |
| SEQ ID NO: 1877 | mm08981_Kcna1 | CGACACAATGGCAATAACCC |
| SEQ ID NO: 1878 | mm08982_Kcna1 | TTCTGAACACCCTTACCAAG |
| SEQ ID NO: 1879 | mm08983_Kcna1 | GGACTGGTAGTAATAAGGA |
| SEQ ID NO: 1880 | mm08984_Kcna1 | CGCAGCATTCGTGGTCGTCG |
| SEQ ID NO: 1881 | mm08993_Kcna4 | CCACCATCATCAGACACGTG |
| SEQ ID NO: 1882 | mm08994_Kcna4 | TGTACGAACACCCATCCCCA |
| SEQ ID NO: 1883 | mm08995_Kcna4 | TGGAGACAGTGTGTATTGTG |
| SEQ ID NO: 1884 | mm08996_Kcna4 | CAATGGCTATACCCCTGGCA |
| SEQ ID NO: 1885 | mm09021_Kcnb1 | GTGCGACGACTACAGCCTCG |
| SEQ ID NO: 1886 | mm09022_Kcnb1 | GGAGAAGCCCAACTCATCGG |
| SEQ ID NO: 1887 | mm09023_Kcnb1 | AGCCAGGAGCTGGACTACTG |
| SEQ ID NO: 1888 | mm09024_Kcnb1 | CATCGAGATGATGGACATCG |
| SEQ ID NO: 1889 | mm09025_Kcnc1 | CCATGATCTACTACGCCGAG |
| SEQ ID NO: 1890 | mm09026_Kcnc1 | AGACGCCCTCGATGTAGGTG |
| SEQ ID NO: 1891 | mm09027_Kcnc1 | TGTGAGCGAAGACGCCCGGG |
| SEQ ID NO: 1892 | mm09028_Kcnc1 | CCTACTCATCCCGCTACGCG |
| SEQ ID NO: 1893 | mm09045_Kcnh1 | TTACATCGAGTATGGAGCCG |
| SEQ ID NO: 1894 | mm09046_Kcnh1 | CTGTGTCTTTAAGACCACGT |
| SEQ ID NO: 1895 | mm09047_Kcnh1 | TCTCTCCAGCATGATAGATG |
| SEQ ID NO: 1896 | mm09048_Kcnh1 | ATCTTCACAAAAAACCACAC |
| SEQ ID NO: 1897 | mm09049_Kcnh2 | GGCCTGCGCGATCTGCGCGG |
| SEQ ID NO: 1898 | mm09050_Kcnh2 | CTGCCCCGTACTCCGAGTAG |
| SEQ ID NO: 1899 | mm09051_Kcnh2 | CACCTATGTTAATGCCAACG |
| SEQ ID NO: 1900 | mm09052_Kcnh2 | CGGATGACATTGAGGCAATG |
| SEQ ID NO: 1901 | mm09081_Kcnj5 | CCACGTGATCCAGATCACCT |
| SEQ ID NO: 1902 | mm09082_Kcnj5 | ACAATGCCGTCATCTCCATG |
| SEQ ID NO: 1903 | mm09083_Kcnj5 | GGCAAGTGCAATGTACACCA |
| SEQ ID NO: 1904 | mm09084_Kcnj5 | ATTAACAATCGAGCCCAGAA |
| SEQ ID NO: 1905 | mm09085_Kcnj6 | ACCAGACTGATATCAACGTG |
| SEQ ID NO: 1906 | mm09086_Kcnj6 | GGTGACACAAGGAGTCCACG |
| SEQ ID NO: 1907 | mm09087_Kcnj6 | GGAAAATCCAGAGGTACGTG |

TABLE 1-continued mmSurf sgRNA library sequences

| SEQ ID NO | id_gRNA Target | Sequence |
|---|---|---|
| SEQ ID NO: 1908 | mm09088_Kcnj6 | GACCCGGTAGCCATAACCGA |
| SEQ ID NO: 1909 | mm09101_Kcnk2 | ATAGTGGCAGCAATAAACGC |
| SEQ ID NO: 1910 | mm09102_Kcnk2 | CTGCTCAGAACTCCAAACCG |
| SEQ ID NO: 1911 | mm09103_Kcnk2 | CATTGGATTTGGAGACTACG |
| SEQ ID NO: 1912 | mm09104_Kcnk2 | AACATCTCCCCACGAACTGA |
| SEQ ID NO: 1913 | mm09121_Kcnma1 | ATACGGGGCTCCTATAGCG |
| SEQ ID NO: 1914 | mm09122_Kcnma1 | AGTCTATGAAGTATATTACG |
| SEQ ID NO: 1915 | mm09123_Kcnma1 | CATTGCCAGGAATTAACAAG |
| SEQ ID NO: 1916 | mm09124_Kcnma1 | TGTCCACGTTACCACGCACA |
| SEQ ID NO: 1917 | mm09141_Kcnq2 | CCACGTGGCAGTACTACGAG |
| SEQ ID NO: 1918 | mm09142_Kcnq2 | ATCGCGGGCCACTTACACGT |
| SEQ ID NO: 1919 | mm09143_Kcnq2 | ATGATCCGTATGGACCGGAG |
| SEQ ID NO: 1920 | mm09144_Kcnq2 | CAAGACTCTGATCCGCACTG |
| SEQ ID NO: 1921 | mm09157_Kdr | TTACCCGCTTAACGGTCCGT |
| SEQ ID NO: 1922 | mm09158_Kdr | ATACGTTTGAGAACCTCACG |
| SEQ ID NO: 1923 | mm09159_Kdr | TTGTAAAGAATGGAGACACG |
| SEQ ID NO: 1924 | mm09160_Kdr | CATAGCTGATCATGTAACTG |
| SEQ ID NO: 1925 | mm09221_Kif21b | TCGCCTGATCAACTCCCAGG |
| SEQ ID NO: 1926 | mm09222_Kif21b | GGAGTTGATGGAGTACAAAG |
| SEQ ID NO: 1927 | mm09223_Kif21b | CCTCATGAAGCAAATGCGTG |
| SEQ ID NO: 1928 | mm09224_Kif21b | ACCCCATTCGCAGAAAAGGG |
| SEQ ID NO: 1929 | mm09281_Kit | AAGCACAATAGCTGGCACCG |
| SEQ ID NO: 1930 | mm09282_Kit | ACACGTAAATAGAACTCGTG |
| SEQ ID NO: 1931 | mm09283_Kit | AGATTTGGTTGTTGAATACG |
| SEQ ID NO: 1932 | mm09284_Kit | TGGTTGCAGCTGGCGCGATG |
| SEQ ID NO: 1933 | mm09373_Klra1 | GCAGAAACAAGTGAGACCTG |
| SEQ ID NO: 1934 | mm09374_Klra1 | TCGTCATGGACAGAAAAACA |
| SEQ ID NO: 1935 | mm09375_Klra1 | TGATCAACAAAAAAAACTGC |
| SEQ ID NO: 1936 | mm09376_Klra1 | CTGAAACAGCTACCAGAAGA |
| SEQ ID NO: 1937 | mm09381_Klra2 | TGACCTGGTACTCTTGACGG |
| SEQ ID NO: 1938 | mm09382_Klra2 | AGGATGTAAACAGATCTGCC |
| SEQ ID NO: 1939 | mm09383_Klra2 | GTTGTAGGCAAGCAAGTGGA |
| SEQ ID NO: 1940 | mm09384_Klra2 | CAGGGTTGCAGAACCCAGTG |
| SEQ ID NO: 1941 | mm09389_Klra4 | ACATACTGTGTGATAAAACC |
| SEQ ID NO: 1942 | mm09390_Klra4 | CCTGAAAAGCTCGCCTCAG |
| SEQ ID NO: 1943 | mm09391_Klra4 | CAGGGTTGCAGAACGAGATG |
| SEQ ID NO: 1944 | mm09392_Klra4 | CTGCAACAGTTACCAGTCGA |
| SEQ ID NO: 1945 | mm09401_Klra7 | AGTTGACGTCACTTTGCGTG |

TABLE 1-continued mmSurf sgRNA library sequences

| SEQ ID NO | id_gRNA Target | Sequence |
|---|---|---|
| SEQ ID NO: 1946 | mm09402_Klra7 | TCTTCTGGAATCCCTCAGCA |
| SEQ ID NO: 1947 | mm09403_Klra7 | AAAATGTTATTATTTCAACA |
| SEQ ID NO: 1948 | mm09404_Klra7 | GCAGAAACTAGTGAGGACTG |
| SEQ ID NO: 1949 | mm09413_Klrc1 | GACAAAACAGATGAGGCCCA |
| SEQ ID NO: 1950 | mm09414_Klrc1 | ATGACTGAAATGGAGCTGCG |
| SEQ ID NO: 1951 | mm09415_Klrc1 | CCAGTGGCTCACCTTTGCAG |
| SEQ ID NO: 1952 | mm09416_Klrc1 | AAAAGCATGCTTACATGGTG |
| SEQ ID NO: 1953 | mm09417_Klrc2 | TCACACGCCTTGCTCTCCAA |
| SEQ ID NO: 1954 | mm09418_Klrc2 | AATCTTGGAATGACAGTTTG |
| SEQ ID NO: 1955 | mm09419_Klrc2 | TCTGGGTTCTAACCAAGAAG |
| SEQ ID NO: 1956 | mm09420_Klrc2 | ACTGAAACGGAACTGCGCCT |
| SEQ ID NO: 1957 | mm09421_Klrd1 | ACCTTCCTGGAATTCTACAG |
| SEQ ID NO: 1958 | mm09422_Klrd1 | TTTGCCTGGACAAGTGGGTT |
| SEQ ID NO: 1959 | mm09423_Klrd1 | TTGCCAATTCATTTCTGGAT |
| SEQ ID NO: 1960 | mm09424_Klrd1 | TTTCCAAAGAAGAAAAGTCT |
| SEQ ID NO: 1961 | mm09537_Krt4 | GAGTCCTCTATGAAGCGGTG |
| SEQ ID NO: 1962 | mm09538_Krt4 | AGAAGTCTTTACAACCTCGG |
| SEQ ID NO: 1963 | mm09539_Krt4 | TCTGCTCACGCTCCGCCGTG |
| SEQ ID NO: 1964 | mm09540_Krt4 | GGCTCCTTCAACGGTCGAGG |
| SEQ ID NO: 1965 | mm09597_L1cam | CATCCAGTAGATCCTAAGTG |
| SEQ ID NO: 1966 | mm09598_L1cam | GTCCAGGCAGTGAACAACCA |
| SEQ ID NO: 1967 | mm09599_L1cam | TCAGCGTTCCATTGGCATAG |
| SEQ ID NO: 1968 | mm09600_L1cam | ACCCTGCAACTACTCAATGT |
| SEQ ID NO: 1969 | mm09613_Lag3 | GATCCTAACTTTCTACGAAG |
| SEQ ID NO: 1970 | mm09614_Lag3 | GAGAGAAGTCCCCGCGCTGG |
| SEQ ID NO: 1971 | mm09615_Lag3 | TCAGCAGCGTACACTGTCAG |
| SEQ ID NO: 1972 | mm09616_Lag3 | GTTTCAGCTAAAAAATGACG |
| SEQ ID NO: 1973 | mm09625_Lama1 | ATGTAGCTGCTCAATGAACG |
| SEQ ID NO: 1974 | mm09626_Lama1 | GGAAACCCAACCGTGCCAGG |
| SEQ ID NO: 1975 | mm09627_Lama1 | GCTACAAAATAACTCCACGG |
| SEQ ID NO: 1976 | mm09628_Lama1 | CTTGAAGGAACGAAACCCCG |
| SEQ ID NO: 1977 | mm09629_Lama2 | GATGAGAAATATGCCCAGCG |
| SEQ ID NO: 1978 | mm09630_Lama2 | ATGACGTGGAGTACAAACCC |
| SEQ ID NO: 1979 | mm09631_Lama2 | TTGTTGCTGGGCGAAATCAG |
| SEQ ID NO: 1980 | mm09632_Lama2 | GAGTGTCCTATTGGGTACAC |
| SEQ ID NO: 1981 | mm09637_Lama4 | AAAGATACAGATAAACAACT |
| SEQ ID NO: 1982 | mm09638_Lama4 | GTCTGCAGACATACTCAGAG |
| SEQ ID NO: 1983 | mm09639_Lama4 | GGAAGCTAACAAGACGACAG |

TABLE 1-continued mmSurf sgRNA library sequences

| SEQ ID NO | id_gRNA Target | Sequence |
|---|---|---|
| SEQ ID NO: 1984 | mm09640_Lama4 | ATCCGAACACCAGCTGACAA |
| SEQ ID NO: 1985 | mm09641_Lama5 | CCTACAGCATCGAGTAACGG |
| SEQ ID NO: 1986 | mm09642_Lama5 | GGCCGTTAATACCACCCGGG |
| SEQ ID NO: 1987 | mm09643_Lama5 | GATGTGACCAGTGTCGCGTG |
| SEQ ID NO: 1988 | mm09644_Lama5 | CTGCCAGCCCTACCAAACAG |
| SEQ ID NO: 1989 | mm09645_Lamb2 | ACAACTTGCTTGACCCACGG |
| SEQ ID NO: 1990 | mm09646_Lamb2 | GCAGCGGTAGCGTTCAAAGG |
| SEQ ID NO: 1991 | mm09647_Lamb2 | TAAGTGGAGGCGTATGCGAT |
| SEQ ID NO: 1992 | mm09648_Lamb2 | CAGAGGCCCTACCTGCAATG |
| SEQ ID NO: 1993 | mm09657_Lamp1 | ACCATTCGCAGTCTCGTAGG |
| SEQ ID NO: 1994 | mm09658_Lamp1 | GCCCAAATGACACATCTAGT |
| SEQ ID NO: 1995 | mm09659_Lamp1 | CATTGTACTTGGATACAGTG |
| SEQ ID NO: 1996 | mm09660_Lamp1 | CTCTTCCAAAAGTAATTGTG |
| SEQ ID NO: 1997 | mm09661_Lamp2 | GAGTGTAGTTGTAGTCGACG |
| SEQ ID NO: 1998 | mm09662_Lamp2 | CCTGACAAGGCGACACACGA |
| SEQ ID NO: 1999 | mm09663_Lamp2 | CACTTAAAGATGACATCCAA |
| SEQ ID NO: 2000 | mm09664_Lamp2 | GCTGCAGCTGAACATCACTG |
| SEQ ID NO: 2001 | mm09669_Anpep | AGAGCGTACTGAGTACCTGG |
| SEQ ID NO: 2002 | mm09670_Anpep | GTCCATGATAGTGCGCACCG |
| SEQ ID NO: 2003 | mm09671_Anpep | AGCACCCAGATATTCCACGT |
| SEQ ID NO: 2004 | mm09672_Anpep | GACCAGGGAGCTCTCACGGT |
| SEQ ID NO: 2005 | mm09673_Large | GATGTGTCTGATTTAAAGGT |
| SEQ ID NO: 2006 | mm09674_Large | CAGCAATAGAATCAGCAATG |
| SEQ ID NO: 2007 | mm09675_Large | GCAGGTAACAGCTCTGAGTG |
| SEQ ID NO: 2008 | mm09676_Large | ACAGCAGAGAGGGAACTCAT |
| SEQ ID NO: 2009 | mm09693_Lbp | ACCCAGCCTGGTGATAAACC |
| SEQ ID NO: 2010 | mm09694_Lbp | GTGGCCAGGATCACCGACAA |
| SEQ ID NO: 2011 | mm09695_Lbp | GTGCACATATCAGGAAATGT |
| SEQ ID NO: 2012 | mm09696_Lbp | TCCGATTAAAAATTTCACCC |
| SEQ ID NO: 2013 | mm09753_Ldlr | AAAATGCATCGCTAGCAAGT |
| SEQ ID NO: 2014 | mm09754_Ldlr | GGTGTCGTAGGACAAGTTAG |
| SEQ ID NO: 2015 | mm09755_Ldlr | GCAGACTGGTGTACTCGCTG |
| SEQ ID NO: 2016 | mm09756_Ldlr | TGACCGTGAACATGACTGCA |
| SEQ ID NO: 2017 | mm09777_Lfng | GGCGATGAAGACGTCGCGAG |
| SEQ ID NO: 2018 | mm09778_Lfng | AGACGCGGATCCACCGCCCG |
| SEQ ID NO: 2019 | mm09779_Lfng | CACACCCAAGACGTGTACAT |
| SEQ ID NO: 2020 | mm09780_Lfng | GGAGAGGCTATGCACCTCGC |
| SEQ ID NO: 2021 | mm09781_Lgals1 | TCTCCATGGGCATTGAAGCG |

TABLE 1-continued mmSurf sgRNA library sequences

| SEQ ID NO | id_gRNA Target | Sequence |
| --- | --- | --- |
| SEQ ID NO: 2022 | mm09782_Lgals1 | CCAGCCCGGGAGCATCACAG |
| SEQ ID NO: 2023 | mm09783_Lgals1 | GGTGTTACACACAATGGTGT |
| SEQ ID NO: 2024 | mm09784_Lgals1 | TCTCAAAGTTCGGGGAGAGG |
| SEQ ID NO: 2025 | mm09785_Lgals3 | TCTGGAAACCCAAACCCTCA |
| SEQ ID NO: 2026 | mm09786_Lgals3 | ATTGTTCTAGATTTCAGGAG |
| SEQ ID NO: 2027 | mm09787_Lgals3 | CCATGATTGTGATCAGCATG |
| SEQ ID NO: 2028 | mm09788_Lgals3 | TTCTTACCAGTGGTCCAGCG |
| SEQ ID NO: 2029 | mm09809_Lhcgr | TATACATAACCACCATACCA |
| SEQ ID NO: 2030 | mm09810_Lhcgr | AACCTGCTATACATTGAACC |
| SEQ ID NO: 2031 | mm09811_Lhcgr | GTGGCTAGGGTAGGTCAGCG |
| SEQ ID NO: 2032 | mm09812_Lhcgr | GACCAGTCGTTATAAACTGA |
| SEQ ID NO: 2033 | mm09849_Lifr | CGACGATGTGTACGGAACGG |
| SEQ ID NO: 2034 | mm09850_Lifr | CATTTGCACGCCTAACCGGT |
| SEQ ID NO: 2035 | mm09851_Lifr | TCACAGTAGAGCAAGCGGTG |
| SEQ ID NO: 2036 | mm09852_Lifr | TGTTTCGTGTTCATTGAACG |
| SEQ ID NO: 2037 | mm09873_Lipg | CGGATGTTAAAAGCCACAGA |
| SEQ ID NO: 2038 | mm09874_Lipg | GAAAGATGCTAACGTCGTGG |
| SEQ ID NO: 2039 | mm09875_Lipg | AAGGGGTGGACATCAACAGA |
| SEQ ID NO: 2040 | mm09876_Lipg | AAGAACCGTTGTAATAACAT |
| SEQ ID NO: 2041 | mm09953_Anxa1 | GTGCAAGGCAGCAACATCCG |
| SEQ ID NO: 2042 | mm09954_Anxa1 | CAAGCTGTAAAATCATACAA |
| SEQ ID NO: 2043 | mm09955_Anxa1 | GTACTTACAGGAGAATGGAA |
| SEQ ID NO: 2044 | mm09956_Anxa1 | GCTCCTGCTGGTCAGAATTG |
| SEQ ID NO: 2045 | mm09957_Lpl | GAAAAACGTACCGTCTGCTG |
| SEQ ID NO: 2046 | mm09958_Lpl | CCATCCATGGATCACCACGA |
| SEQ ID NO: 2047 | mm09959_Lpl | TGGATTCCAATACTTCGACC |
| SEQ ID NO: 2048 | mm09960_Lpl | TGACACTGGATAATGTTGCT |
| SEQ ID NO: 2049 | mm09973_Lrp1 | GCTGCGGAACAGTACCACGT |
| SEQ ID NO: 2050 | mm09974_Lrp1 | AAATGCCGGGTAAATAACGG |
| SEQ ID NO: 2051 | mm09975_Lrp1 | ACTGCGTCTTACCCAGACTG |
| SEQ ID NO: 2052 | mm09976_Lrp1 | TGACGGTAGCGATGATTGCG |
| SEQ ID NO: 2053 | mm09977_Lrp5 | CGTGTACTGGACCGACGATG |
| SEQ ID NO: 2054 | mm09978_Lrp5 | TGGGACCAATTGTATGACAC |
| SEQ ID NO: 2055 | mm09979_Lrp5 | GGAGACTAACAACAACGATG |
| SEQ ID NO: 2056 | mm09980_Lrp5 | TGGGTGAGTACAGAGCACTA |
| SEQ ID NO: 2057 | mm09981_Lrp6 | GGATCTAACACGATAGCCCG |
| SEQ ID NO: 2058 | mm09982_Lrp6 | TTGCCTTAGATCCATCAAGT |
| SEQ ID NO: 2059 | mm09983_Lrp6 | TGTGTCCTCAAATAACGTCA |

TABLE 1-continued mmSurf sgRNA library sequences

| SEQ ID NO | id_gRNA Target | Sequence |
|---|---|---|
| SEQ ID NO: 2060 | mm09984_Lrp6 | GTTGTTCATCAATCACCATG |
| SEQ ID NO: 2061 | mm09985_Lrpap1 | AGACTGCGCAGTATCAACCA |
| SEQ ID NO: 2062 | mm09986_Lrpap1 | CTGACCTGAAGATACAAGAG |
| SEQ ID NO: 2063 | mm09987_Lrpap1 | AGAATAGGAAGGTACCGTTG |
| SEQ ID NO: 2064 | mm09988_Lrpap1 | CGCCAAGCGCGAGTCCGGGG |
| SEQ ID NO: 2065 | mm09997_Lrrn1 | CACTACGGAAAGCCAAACGG |
| SEQ ID NO: 2066 | mm09998_Lrrn1 | CCATGCCACCGGAATACAGG |
| SEQ ID NO: 2067 | mm09999_Lrrn1 | GAGGTCATTACAATCCACGG |
| SEQ ID NO: 2068 | mm10000_Lrrn1 | TGGGAGTGGAATCAAACCAG |
| SEQ ID NO: 2069 | mm10025_Ltb | AGGTAATAGACGCCGTCCTG |
| SEQ ID NO: 2070 | mm10026_Ltb | GATAGGCACTGCCAACAACA |
| SEQ ID NO: 2071 | mm10027_Ltb | TGTTGCGCAGTCCTCTCGGG |
| SEQ ID NO: 2072 | mm10028_Ltb | ACCCGACGTCCCTGATCCTG |
| SEQ ID NO: 2073 | mm10033_Ltbr | GGAAGTGTCCCGGCTTACAG |
| SEQ ID NO: 2074 | mm10034_Ltbr | CTCATTGTCCAGATACACAC |
| SEQ ID NO: 2075 | mm10035_Ltbr | TGTTCATTATAGGAATTATG |
| SEQ ID NO: 2076 | mm10036_Ltbr | AGCTCCAGGTACCTCCTACT |
| SEQ ID NO: 2077 | mm10041_Ltf | AACCTGAGTATGGCTCCTCG |
| SEQ ID NO: 2078 | mm10042_Ltf | AGAAGCGCAAGTGTGATCAG |
| SEQ ID NO: 2079 | mm10043_Ltf | GATGCCATGACTCTTGATGG |
| SEQ ID NO: 2080 | mm10044_Ltf | AGTTACCAAATAAAGCCGAA |
| SEQ ID NO: 2081 | mm10049_Lum | AACAACCTGACCGAGTCCGT |
| SEQ ID NO: 2082 | mm10050_Lum | ATTTGCCCATACATGAAGAG |
| SEQ ID NO: 2083 | mm10051_Lum | TAAAGGTACTTGATGCCAGG |
| SEQ ID NO: 2084 | mm10052_Lum | TCTGATTGAAGCTCAAATCC |
| SEQ ID NO: 2085 | mm10065_Klrb1c | GAGATGCAACACTTAACTGG |
| SEQ ID NO: 2086 | mm10066_Klrb1c | TCCTGGGTGGCTTTAAACCG |
| SEQ ID NO: 2087 | mm10067_Klrb1c | TAAGACACTCATCCCAATCA |
| SEQ ID NO: 2088 | mm10068_Klrb1c | GAGGAAGGTCAAGCTGACTG |
| SEQ ID NO: 2089 | mm10077_Cd93 | ACTCCAGGAATATTTCACTG |
| SEQ ID NO: 2090 | mm10078_Cd93 | GCCTGCTATACAGCCCATTG |
| SEQ ID NO: 2091 | mm10079_Cd93 | TGGGTTGGTTACCAACCCAG |
| SEQ ID NO: 2092 | mm10080_Cd93 | AGTGGCATGAGAGTCCCTGT |
| SEQ ID NO: 2093 | mm10081_Ly6c1 | CACAAGAAGAATGAGCACAC |
| SEQ ID NO: 2094 | mm10082_Ly6c1 | CCCTGATTGGCACACCAGCA |
| SEQ ID NO: 2095 | mm10083_Ly6c1 | GCAGAAAGAAAGGCACTGAC |
| SEQ ID NO: 2096 | mm10084_Ly6c1 | ACTGTGTGCAGAAAGAGGTG |
| SEQ ID NO: 2097 | mm10085_Ly6d | CTGGCAGCATTGTGTGACCT |

TABLE 1-continued mmSurf sgRNA library sequences

| SEQ ID NO | id_gRNA Target | Sequence |
|---|---|---|
| SEQ ID NO: 2098 | mm10086_Ly6d | TGCCAACTGTAAGAACCCTC |
| SEQ ID NO: 2099 | mm10087_Ly6d | CACGTGACATCGAAGTGCCC |
| SEQ ID NO: 2100 | mm10088_Ly6d | ACCTCCGACTACAGCCAGCA |
| SEQ ID NO: 2101 | mm10097_Epcam | CGGAGTCCGAAGAACCGACA |
| SEQ ID NO: 2102 | mm10098_Epcam | GGGCGATCCAGAACAACGAT |
| SEQ ID NO: 2103 | mm10099_Epcam | GATAACATTATTCTCATACT |
| SEQ ID NO: 2104 | mm10100_Epcam | GCAAGCTCTGATGGTCGTAG |
| SEQ ID NO: 2105 | mm10101_Ly75 | GTCACGAAACTCCATAATGG |
| SEQ ID NO: 2106 | mm10102_Ly75 | TAAGCTGTGTCCGCCAGACG |
| SEQ ID NO: 2107 | mm10103_Ly75 | GCTTGCTTGAGAAAACGTAA |
| SEQ ID NO: 2108 | mm10104_Ly75 | TCCTGTGAACGATGTTATCG |
| SEQ ID NO: 2109 | mm10105_Cd180 | AACACGAAGAGACTTGAGCT |
| SEQ ID NO: 2110 | mm10106_Cd180 | GTCTCTGCCATAAATATCAG |
| SEQ ID NO: 2111 | mm10107_Cd180 | TTCACAGAGACCCTCAAACA |
| SEQ ID NO: 2112 | mm10108_Cd180 | ACATTGCAGGAATAGAGCTG |
| SEQ ID NO: 2113 | mm10109_Il1rl1 | CACTTGTCAATTCACACACG |
| SEQ ID NO: 2114 | mm10110_Il1rl1 | ACCAGTTATCCTTAACACTG |
| SEQ ID NO: 2115 | mm10111_Il1rl1 | TTGATGTACTCGACAGTACG |
| SEQ ID NO: 2116 | mm10112_Il1rl1 | AGGACGCTCGACTTATCCTG |
| SEQ ID NO: 2117 | mm10121_Ly9 | TGCAGGTATAGGGTAGGTCG |
| SEQ ID NO: 2118 | mm10122_Ly9 | GAAACAATGTGACATACACA |
| SEQ ID NO: 2119 | mm10123_Ly9 | CGAGTGGCCCGAAATTCCAA |
| SEQ ID NO: 2120 | mm10124_Ly9 | ACAGATTCCACGATGATCTG |
| SEQ ID NO: 2121 | mm10157_Tm4sf1 | TGCTGCGGCTACGAAAACTA |
| SEQ ID NO: 2122 | mm10158_Tm4sf1 | ATCCCAATGAACACAAACGC |
| SEQ ID NO: 2123 | mm10159_Tm4sf1 | GGAGACAAAGTATGCTACGG |
| SEQ ID NO: 2124 | mm10160_Tm4sf1 | GGTGTAGTTCCATACTCCAT |
| SEQ ID NO: 2125 | mm10161_M6pr | ATCATGCTGATATATAAAGG |
| SEQ ID NO: 2126 | mm10162_M6pr | GGATAAGGAGTCAAAGAACG |
| SEQ ID NO: 2127 | mm10163_M6pr | AGGAGATCATCACCACTGCA |
| SEQ ID NO: 2128 | mm10164_M6pr | GGCTGCTATCCATCTCAAAG |
| SEQ ID NO: 2129 | mm10301_Man1a2 | AGTGGAGTAGGTCGAAACTG |
| SEQ ID NO: 2130 | mm10302_Man1a2 | AATTACAGAACATACGGATG |
| SEQ ID NO: 2131 | mm10303_Man1a2 | CTGACAGGTAATATGCAGCG |
| SEQ ID NO: 2132 | mm10304_Man1a2 | GGCAAAGGAGCTAAAAACCC |
| SEQ ID NO: 2133 | mm10305_Man2a1 | TGCGTCGAAATAATCTGACA |
| SEQ ID NO: 2134 | mm10306_Man2a1 | AGGAACCGCGAAAGACTGGG |
| SEQ ID NO: 2135 | mm10307_Man2a1 | CAGCTGGAAATTGTGACCGG |

TABLE 1-continued mmSurf sgRNA library sequences

| SEQ ID NO | id_gRNA Target | Sequence |
|---|---|---|
| SEQ ID NO: 2136 | mm10308_Man2a1 | ACAATCCCTTTGAACAAGAA |
| SEQ ID NO: 2137 | mm10309_Man2b1 | ATGTTGTAAATGACTACGCG |
| SEQ ID NO: 2138 | mm10310_Man2b1 | TGAGTTCAATGCAAAAACGT |
| SEQ ID NO: 2139 | mm10311_Man2b1 | CTTGATAGTCAATGCGCCCA |
| SEQ ID NO: 2140 | mm10312_Man2b1 | AGCTCCCAGAGGTAACACGT |
| SEQ ID NO: 2141 | mm10325_Marco | TTCCAGATTAAAGGTGAACG |
| SEQ ID NO: 2142 | mm10326_Marco | TAGGTCTCACTGGCCCCAAG |
| SEQ ID NO: 2143 | mm10327_Marco | CAATGGATCACTAGCTATCG |
| SEQ ID NO: 2144 | mm10328_Marco | GTGCACCCGTAAGTCCCTGG |
| SEQ ID NO: 2145 | mm10337_Mas1 | GTGCTGGACACTAACATGAG |
| SEQ ID NO: 2146 | mm10338_Mas1 | ATATGGGTAGAGGACCGAT |
| SEQ ID NO: 2147 | mm10339_Mas1 | AATACACATGACATACTCCA |
| SEQ ID NO: 2148 | mm10340_Mas1 | TTCTCGGAGTGACTGCCGGG |
| SEQ ID NO: 2149 | mm10349_Masp1 | TTAATGTAGTCATAGGGACA |
| SEQ ID NO: 2150 | mm10350_Masp1 | GCGGCAATCTCTTTACCCAG |
| SEQ ID NO: 2151 | mm10351_Masp1 | GGAATATTACTGTCCCGGAG |
| SEQ ID NO: 2152 | mm10352_Masp1 | GACAACTCAGGAGAGAACCG |
| SEQ ID NO: 2153 | mm10429_Mc2r | ATGGGTTATCTTAAGCCTCG |
| SEQ ID NO: 2154 | mm10430_Mc2r | ACAATCGGAGTTATTTCTTG |
| SEQ ID NO: 2155 | mm10431_Mc2r | GGCGCATGGTCACAATGCTA |
| SEQ ID NO: 2156 | mm10432_Mc2r | AGATAGAGCCCAGCAAAGAG |
| SEQ ID NO: 2157 | mm10477_Cd46 | CTGTGAGCCAAATCATACAT |
| SEQ ID NO: 2158 | mm10478_Cd46 | TCCATAGCTTCAAATGGCCG |
| SEQ ID NO: 2159 | mm10479_Cd46 | GGCCTCAGCATAGACGCCCA |
| SEQ ID NO: 2160 | mm10480_Cd46 | ACAGTTGTGATCCTACCCCA |
| SEQ ID NO: 2161 | mm10497_Cma1 | AAACATCTAAAGAAGACACG |
| SEQ ID NO: 2162 | mm10498_Cma1 | GCCAAGCTAACCCTAGGTGT |
| SEQ ID NO: 2163 | mm10499_Cma1 | TTTCCAGATAGGCCATGTAG |
| SEQ ID NO: 2164 | mm10500_Cma1 | CTGCAGCTCACTGTGCGGGA |
| SEQ ID NO: 2165 | mm10537_Abcc1 | GGTGAAGTACAGATAGAACG |
| SEQ ID NO: 2166 | mm10538_Abcc1 | GGCTAGGATGACTTGCAGAG |
| SEQ ID NO: 2167 | mm10539_Abcc1 | AGCTGTAGGCACATTCACGT |
| SEQ ID NO: 2168 | mm10540_Abcc1 | GAGCGGAGGTCGATCAAGAG |
| SEQ ID NO: 2169 | mm10545_Slc3a2 | GTTCACCGGCTTATCCAAGG |
| SEQ ID NO: 2170 | mm10546_Slc3a2 | CGCCCGAACGATGATAACCA |
| SEQ ID NO: 2171 | mm10547_Slc3a2 | TATCACCAAGAACTTAAGTG |
| SEQ ID NO: 2172 | mm10548_Slc3a2 | GTACTGAATCCCTAGTCACT |
| SEQ ID NO: 2173 | mm10585_Men1 | TCCTCACTCTTGGATAACAG |

TABLE 1-continued mmSurf sgRNA library sequences

| SEQ ID NO | id_gRNA Target | Sequence |
| --- | --- | --- |
| SEQ ID NO: 2174 | mm10586_Men1 | GCGCTGCGACCGTAAGATGG |
| SEQ ID NO: 2175 | mm10587_Men1 | GGTGGTGTTTGGGCCCAACG |
| SEQ ID NO: 2176 | mm10588_Men1 | CACAGCGCCGCGGATCTGAG |
| SEQ ID NO: 2177 | mm10601_Mertk | AGGTACGGTTAGGACAGACG |
| SEQ ID NO: 2178 | mm10602_Mertk | TGTATCTGATCCCATATACG |
| SEQ ID NO: 2179 | mm10603_Mertk | GCTACCGGATATCTCACGTG |
| SEQ ID NO: 2180 | mm10604_Mertk | AGCGATGCTGTAATTAGCCA |
| SEQ ID NO: 2181 | mm10617_Met | GTATCGGACAGAGTTTACCA |
| SEQ ID NO: 2182 | mm10618_Met | TAATAACAAGCATTTCTCCG |
| SEQ ID NO: 2183 | mm10619_Met | CCCTGGTTTACTGACATACG |
| SEQ ID NO: 2184 | mm10620_Met | GGTGGATTTCATAGACAACG |
| SEQ ID NO: 2185 | mm10633_Mfge8 | CAGCAGAGTTAACTCACGGG |
| SEQ ID NO: 2186 | mm10634_Mfge8 | ACTCAAACTTGCGTCCGTCG |
| SEQ ID NO: 2187 | mm10635_Mfge8 | AGTGCTTACCGGTTTCACAG |
| SEQ ID NO: 2188 | mm10636_Mfge8 | GTGTGCAATGAGACTGAGAG |
| SEQ ID NO: 2189 | mm10673_Mif | CCCTCTGGCACGGAGGCGCG |
| SEQ ID NO: 2190 | mm10674_Mif | ACAGCAGCTTACTGTAGTTG |
| SEQ ID NO: 2191 | mm10675_Mif | GGCCACCGGCAAGCCCGCAC |
| SEQ ID NO: 2192 | mm10676_Mif | CACAGCATCGGCAAGATCGG |
| SEQ ID NO: 2193 | mm10677_Cxcl9 | ATCGTGCATTCCTTATCACT |
| SEQ ID NO: 2194 | mm10678_Cxcl9 | TTTGTTGCAATTGGGGCTTG |
| SEQ ID NO: 2195 | mm10679_Cxcl9 | CACAGTGCTACACTGAAGAA |
| SEQ ID NO: 2196 | mm10680_Cxcl9 | AGATCAAACCTGCCTAGATC |
| SEQ ID NO: 2197 | mm10741_Mme | CTTGCTCCTGACTATCATAG |
| SEQ ID NO: 2198 | mm10742_Mme | TGTTACCAGATATATATGGG |
| SEQ ID NO: 2199 | mm10743_Mme | TTTGACCAGCTGAATGACTG |
| SEQ ID NO: 2200 | mm10744_Mme | CTGGAAGGGAGGCCAAGTCG |
| SEQ ID NO: 2201 | mm10765_Mmp15 | AGACGCCGAAGTGTACGCCG |
| SEQ ID NO: 2202 | mm10766_Mmp15 | TGGGGTAGTTGTCTAGAACG |
| SEQ ID NO: 2203 | mm10767_Mmp15 | AAGCCAACCTGCGTCGACGG |
| SEQ ID NO: 2204 | mm10768_Mmp15 | AGGGTGCCATAATAGCGCTG |
| SEQ ID NO: 2205 | mm10785_Mmp7 | TGTTCCCTGGCCCATCAAAG |
| SEQ ID NO: 2206 | mm10786_Mmp7 | ATTTGATCCACTACGATCCG |
| SEQ ID NO: 2207 | mm10787_Mmp7 | GATCCCACTGAACTTCAAGA |
| SEQ ID NO: 2208 | mm10788_Mmp7 | ATAATGCAGAAACCTAGGTG |
| SEQ ID NO: 2209 | mm10829_Mog | CGATGAGAGTCAGCACACCG |
| SEQ ID NO: 2210 | mm10830_Mog | AATTCAGAGTGATAGGACCA |
| SEQ ID NO: 2211 | mm10831_Mog | TCACCTCTACCGAAATGGCA |

TABLE 1-continued mmSurf sgRNA library sequences

| SEQ ID NO | id_gRNA Target | Sequence |
|---|---|---|
| SEQ ID NO: 2212 | mm10832_Mog | TCTCACGTTCTGAATCCTAA |
| SEQ ID NO: 2213 | mm10857_Cd200 | AGGAACCCTTGATTGTGACA |
| SEQ ID NO: 2214 | mm10858_Cd200 | CACCTACAGCAAAACCCATG |
| SEQ ID NO: 2215 | mm10859_Cd200 | TTGTAGTGAAGGTGTACTAT |
| SEQ ID NO: 2216 | mm10860_Cd200 | GCCCCAAATCAGGCTGTAGG |
| SEQ ID NO: 2217 | mm10873_Mpl | GCTGTCGGATGAACACACGG |
| SEQ ID NO: 2218 | mm10874_Mpl | GGAACTTCAGATCCACTGGG |
| SEQ ID NO: 2219 | mm10875_Mpl | GTGAACGGCACCTTGCGCTG |
| SEQ ID NO: 2220 | mm10876_Mpl | GCTACGCAGCCAACCCGACG |
| SEQ ID NO: 2221 | mm10889_Mpz | GGGACAACCTTACATCGATG |
| SEQ ID NO: 2222 | mm10890_Mpz | AAAAACCCACCGGACATAGT |
| SEQ ID NO: 2223 | mm10891_Mpz | CATTGTGGTTTACACGGACA |
| SEQ ID NO: 2224 | mm10892_Mpz | CAACACCACCCCATACCTAG |
| SEQ ID NO: 2225 | mm10897_Mrc1 | TTCTGGAATGACATCAACTG |
| SEQ ID NO: 2226 | mm10898_Mrc1 | TCTCGAGCACAGGTCATCCG |
| SEQ ID NO: 2227 | mm10899_Mrc1 | AGCCATGCTGTAGTACCGGA |
| SEQ ID NO: 2228 | mm10900_Mrc1 | TTTCTCACCATATCCGAGCT |
| SEQ ID NO: 2229 | mm10901_Mrc2 | ATGGCAGTGTCGTACACTAG |
| SEQ ID NO: 2230 | mm10902_Mrc2 | GAACCAGACATTGGTCGACA |
| SEQ ID NO: 2231 | mm10903_Mrc2 | ACAGATCAGCCGGACAACCC |
| SEQ ID NO: 2232 | mm10904_Mrc2 | GTATACATGACAGCCAGACA |
| SEQ ID NO: 2233 | mm10953_Msn | CGCTTGTTAATCCGAAGCCG |
| SEQ ID NO: 2234 | mm10954_Msn | CCGGGCCAAGTTCTACCCAG |
| SEQ ID NO: 2235 | mm10955_Msn | GAAGCAACTTATCTCCAGCC |
| SEQ ID NO: 2236 | mm10956_Msn | CAGACTAAGAAGGCTCAGCA |
| SEQ ID NO: 2237 | mm11085_Muc1 | AGCTCTCCAGTAGTCCACGG |
| SEQ ID NO: 2238 | mm11086_Muc1 | TTGTAGTTGAGGTACCACTG |
| SEQ ID NO: 2239 | mm11087_Muc1 | TGGCCATGGTAGGAGAAACA |
| SEQ ID NO: 2240 | mm11088_Muc1 | AGAACTGGTAGGTAGCACCG |
| SEQ ID NO: 2241 | mm11097_Mug1 | GGGGAGATAGTTCATCACAG |
| SEQ ID NO: 2242 | mm11098_Mug1 | ACATCCTTCTCAGTTCCATG |
| SEQ ID NO: 2243 | mm11099_Mug1 | GGAAGAGCCCGAGATGCATG |
| SEQ ID NO: 2244 | mm11100_Mug1 | GCTACGTCCCCTGAATGAGT |
| SEQ ID NO: 2245 | mm11214_Myh9 | GCTGGTACTCACGAATCGAG |
| SEQ ID NO: 2246 | mm11215_Myh9 | TGGACTATAAAGCTGACGAG |
| SEQ ID NO: 2247 | mm11216_Myh9 | TCAAGGAGCGATACTACTCA |
| SEQ ID NO: 2248 | mm11217_Myh9 | ACTGCAGGTCAAGTTCAGCG |
| SEQ ID NO: 2249 | mm11330_Naga | GCTAGGAAGGCAATCCCGTG |

TABLE 1-continued mmSurf sgRNA library sequences

| SEQ ID NO | id_gRNA Target | Sequence |
|---|---|---|
| SEQ ID NO: 2250 | mm11331_Naga | TGTTGAGGTATACATAGCCC |
| SEQ ID NO: 2251 | mm11332_Naga | TCTCACAAACCAGTCCAGGA |
| SEQ ID NO: 2252 | mm11333_Naga | TGTTCAGGTGAACTACACCG |
| SEQ ID NO: 2253 | mm11382_Ncam1 | GAAGATCTTCACGTTGACAG |
| SEQ ID NO: 2254 | mm11383_Ncam1 | CTCCTGGTTCTCCCCCAATG |
| SEQ ID NO: 2255 | mm11384_Ncam1 | GCCATCGGCATCACACACCA |
| SEQ ID NO: 2256 | mm11385_Ncam1 | ACCTACCAAAGACCTTGAGG |
| SEQ ID NO: 2257 | mm11386_Ncam2 | GTGCCCACCAATCCGACTAG |
| SEQ ID NO: 2258 | mm11387_Ncam2 | TACCAAAATACTAACTGTCG |
| SEQ ID NO: 2259 | mm11388_Ncam2 | GTGAGCCTGAGAGTATCGAC |
| SEQ ID NO: 2260 | mm11389_Ncam2 | AGGAAGAAAGATGATACTCG |
| SEQ ID NO: 2261 | mm11410_Ncl | AGCCAAAGTCATTCCAACAC |
| SEQ ID NO: 2262 | mm11411_Ncl | CCTCTCTTTCAACATCACTG |
| SEQ ID NO: 2263 | mm11412_Ncl | TAAAAATGATCTTGCTGTTG |
| SEQ ID NO: 2264 | mm11413_Ncl | TCCTATGAAAGCCAAGAGTG |
| SEQ ID NO: 2265 | mm11430_Ndp | ACAGTGCTGAAGGACACCAA |
| SEQ ID NO: 2266 | mm11431_Ndp | ACTGTACAAATGTAGCTCAA |
| SEQ ID NO: 2267 | mm11432_Ndp | TGCTCCTGGCCAGATGTGAG |
| SEQ ID NO: 2268 | mm11433_Ndp | AACAGACAGTTCATTTCTGA |
| SEQ ID NO: 2269 | mm11438_Ndufa2 | GCAGGGATTTCATCGTGCAA |
| SEQ ID NO: 2270 | mm11439_Ndufa2 | TCTGATCCGCGAATGCTCGG |
| SEQ ID NO: 2271 | mm11440_Ndufa2 | ATTCGCGGATCAGAATGGGC |
| SEQ ID NO: 2272 | mm11441_Ndufa2 | GGCTGCCGCTGCTAGCCGAG |
| SEQ ID NO: 2273 | mm11462_Sept2 | AGTGGACACTCCCGGCTACG |
| SEQ ID NO: 2274 | mm11463_Sept2 | CGCTACCTACATGATGAGAG |
| SEQ ID NO: 2275 | mm11464_Sept2 | CACCGAAAATCAGTGAAGAA |
| SEQ ID NO: 2276 | mm11465_Sept2 | GCGTGAGCGGCTTAAGAAAA |
| SEQ ID NO: 2277 | mm11482_Neo1 | CGTAACCGATGGCATAACCT |
| SEQ ID NO: 2278 | mm11483_Neo1 | GGTTCCAAGATTATCCACAG |
| SEQ ID NO: 2279 | mm11484_Neo1 | AACACCGTTATCTGGCAATG |
| SEQ ID NO: 2280 | mm11485_Neo1 | ACTCCCGCTACTACACAGTC |
| SEQ ID NO: 2281 | mm11490_Neu1 | ACAGCCTTCATCGTAGACGA |
| SEQ ID NO: 2282 | mm11491_Neu1 | TTGGTTTGGAGTAAGGACGA |
| SEQ ID NO: 2283 | mm11492_Neu1 | TGTGTGTGGACACGGGACGC |
| SEQ ID NO: 2284 | mm11493_Neu1 | GAAAAAATCTGCATCCGATG |
| SEQ ID NO: 2285 | mm11514_Nf2 | GACCCCTCTGTGCACAAGCG |
| SEQ ID NO: 2286 | mm11515_Nf2 | TGTGAACTACTTTACAATCC |
| SEQ ID NO: 2287 | mm11516_Nf2 | GTCGCCTCATAAATAGGTCA |

TABLE 1-continued mmSurf sgRNA library sequences

| SEQ ID NO | id_gRNA Target | Sequence |
| --- | --- | --- |
| SEQ ID NO: 2288 | mm11517_Nf2 | CAAGAGATGAGTTAGAGAGG |
| SEQ ID NO: 2289 | mm11626_Ngfr | TGGAGCAATAGACAGGAATG |
| SEQ ID NO: 2290 | mm11627_Ngfr | ACAAGGTCTACGCCCCCGGA |
| SEQ ID NO: 2291 | mm11628_Ngfr | AGGGTAGGCACGGGTCCACG |
| SEQ ID NO: 2292 | mm11629_Ngfr | TATGTCCGCTCCCTGTGTGG |
| SEQ ID NO: 2293 | mm11642_Nid1 | TGGCTGTGTAAGAGCGCCCG |
| SEQ ID NO: 2294 | mm11643_Nid1 | AGCCCTCTACACACTCGCAG |
| SEQ ID NO: 2295 | mm11644_Nid1 | TGTGCACCGAGGCTCCATAG |
| SEQ ID NO: 2296 | mm11645_Nid1 | CTGACCCACACAATGTACCT |
| SEQ ID NO: 2297 | mm11646_Nid2 | TGAGATACATACCTTCAACA |
| SEQ ID NO: 2298 | mm11647_Nid2 | GTATCACTCAAACTGCCGAG |
| SEQ ID NO: 2299 | mm11648_Nid2 | CTTGATCATTAGATCCCACG |
| SEQ ID NO: 2300 | mm11649_Nid2 | GGATCTACACGCTTACATCG |
| SEQ ID NO: 2301 | mm11722_Cd244 | AAAGATACATTTGACCAACT |
| SEQ ID NO: 2302 | mm11723_Cd244 | CTGCTGGAGATCACCAACAC |
| SEQ ID NO: 2303 | mm11724_Cd244 | AGTGCCCCCACTTACTCGAA |
| SEQ ID NO: 2304 | mm11725_Cd244 | GTGAGCTACGCTTTGTACAG |
| SEQ ID NO: 2305 | mm11782_Notch1 | ATATACATACCCGTCCACTC |
| SEQ ID NO: 2306 | mm11783_Notch1 | CTGCCCACCAGGCTTCGTCG |
| SEQ ID NO: 2307 | mm11784_Notch1 | CAGTGTAATAATCACGCATG |
| SEQ ID NO: 2308 | mm11785_Notch1 | ACCTGCAAGGACATGACCAG |
| SEQ ID NO: 2309 | mm11786_Notch2 | GGGCTGTGTAGAGTTCGCAG |
| SEQ ID NO: 2310 | mm11787_Notch2 | CAGCAACCCTTGTCACAAGG |
| SEQ ID NO: 2311 | mm11788_Notch2 | AGGGACCAGTGAAACCCACG |
| SEQ ID NO: 2312 | mm11789_Notch2 | TGGCCACCGTTAAGGCAGTG |
| SEQ ID NO: 2313 | mm11798_Notch4 | GCTGTGACAGGCACTCATTG |
| SEQ ID NO: 2314 | mm11799_Notch4 | ACCTGCAAGACACACCTCG |
| SEQ ID NO: 2315 | mm11800_Notch4 | CTCACTACAGGTCAACCCTG |
| SEQ ID NO: 2316 | mm11801_Notch4 | CACAGGGCAGAGACACTGGT |
| SEQ ID NO: 2317 | mm11826_Npc1 | GGGGAAGGTGATCACAAGCG |
| SEQ ID NO: 2318 | mm11827_Npc1 | CATCATGTGGGTCACCTACG |
| SEQ ID NO: 2319 | mm11828_Npc1 | CGGTTCGTAGATATGAACAC |
| SEQ ID NO: 2320 | mm11829_Npc1 | CCATCCCTACCTGAAAACAC |
| SEQ ID NO: 2321 | mm11854_Npr3 | ACAGCGACGACAAACTCGAG |
| SEQ ID NO: 2322 | mm11855_Npr3 | GCTGGCGGCTCAAAAGATCG |
| SEQ ID NO: 2323 | mm11856_Npr3 | TCCAAACAGTCACCCTACTG |
| SEQ ID NO: 2324 | mm11857_Npr3 | GTGGTGATCATGTGTGCCAG |
| SEQ ID NO: 2325 | mm11886_Slc11a1 | GGGTGTGCTACCACATACTG |

TABLE 1-continued mmSurf sgRNA library sequences

| SEQ ID NO | id_gRNA Target | Sequence |
|---|---|---|
| SEQ ID NO: 2326 | mm11887_Slc11a1 | GAGAAGTAGACAGAACCCGC |
| SEQ ID NO: 2327 | mm11888_Slc11a1 | CCTAGCATGATACCGTCCAG |
| SEQ ID NO: 2328 | mm11889_Slc11a1 | GAATGGGGATCTTCTCACTC |
| SEQ ID NO: 2329 | mm11890_Slc11a2 | ATGTCACCGTCAGTATCCCA |
| SEQ ID NO: 2330 | mm11891_Slc11a2 | AAACACAAAAGTGTCTGCGA |
| SEQ ID NO: 2331 | mm11892_Slc11a2 | TGAGAAAATCCCCATTCCTG |
| SEQ ID NO: 2332 | mm11893_Slc11a2 | CCTTGACTAAGGCAGAATGC |
| SEQ ID NO: 2333 | mm11914_Nrp1 | CTCTGACTATGAGACACATG |
| SEQ ID NO: 2334 | mm11915_Nrp1 | CAAGACTCGAATCCTCCCGG |
| SEQ ID NO: 2335 | mm11916_Nrp1 | TGAACTACCCTGAAAATGGG |
| SEQ ID NO: 2336 | mm11917_Nrp1 | TGTCCTCCAAATCGAAATGT |
| SEQ ID NO: 2337 | mm11918_Nrp2 | AGCGAACAATGATGCGACCG |
| SEQ ID NO: 2338 | mm11919_Nrp2 | GGTGAACTTGATGTATAACA |
| SEQ ID NO: 2339 | mm11920_Nrp2 | CCAAACTCCGCTCGTCCACG |
| SEQ ID NO: 2340 | mm11921_Nrp2 | CAGAGCGGCTACTAACCAGG |
| SEQ ID NO: 2341 | mm11926_Nrxn1 | GCTCTACATCGACCGCGCCG |
| SEQ ID NO: 2342 | mm11927_Nrxn1 | GTATTCAGATCCCTTGAACG |
| SEQ ID NO: 2343 | mm11928_Nrxn1 | TGAATGGCACACAGTGCGTG |
| SEQ ID NO: 2344 | mm11929_Nrxn1 | GACGACGAGCCTCCCAACAG |
| SEQ ID NO: 2345 | mm11958_Musk | CACCCGCAGAGAGTCGACCG |
| SEQ ID NO: 2346 | mm11959_Musk | AGAAAAGTTCAGTACCGCAA |
| SEQ ID NO: 2347 | mm11960_Musk | TGCAGGACAGTACCGCTGTG |
| SEQ ID NO: 2348 | mm11961_Musk | ATGGAAGGAAAGGCCCACCG |
| SEQ ID NO: 2349 | mm11978_Ntn1 | TCTGTTTGGTGATAGGCGCG |
| SEQ ID NO: 2350 | mm11979_Ntn1 | TGGGATCCGAAGAGTTGCAG |
| SEQ ID NO: 2351 | mm11980_Ntn1 | TGTCCATTCTCATCCGAGCA |
| SEQ ID NO: 2352 | mm11981_Ntn1 | GTGTGACTGTAGGCACAACA |
| SEQ ID NO: 2353 | mm11986_Ntrk1 | GCGGAGGCCACTCTTCACGA |
| SEQ ID NO: 2354 | mm11987_Ntrk1 | GACACAACACCAGTTGTGGT |
| SEQ ID NO: 2355 | mm11988_Ntrk1 | ACTAATGAGACCATGCGGCA |
| SEQ ID NO: 2356 | mm11989_Ntrk1 | ACCCAGTGTCATGAAGTGTA |
| SEQ ID NO: 2357 | mm11990_Ntrk2 | ATGACGTTGAAGCTTACGTG |
| SEQ ID NO: 2358 | mm11991_Ntrk2 | AACCTGCAGATACCCAATTG |
| SEQ ID NO: 2359 | mm11992_Ntrk2 | AATGCACCAGTGGTGATCTG |
| SEQ ID NO: 2360 | mm11993_Ntrk2 | CTCAGTACACCAAATCCTAG |
| SEQ ID NO: 2361 | mm11994_Ntrk3 | ACTCACATATAACGCAAGTG |
| SEQ ID NO: 2362 | mm11995_Ntrk3 | CCACTGCATCACATCAACCA |
| SEQ ID NO: 2363 | mm11996_Ntrk3 | CCAGGCTCACCACACGTGGA |

TABLE 1-continued mmSurf sgRNA library sequences

| SEQ ID NO | id_gRNA Target | Sequence |
|---|---|---|
| SEQ ID NO: 2364 | mm11997_Ntrk3 | GTCAACCTGACTGTCCGAGA |
| SEQ ID NO: 2365 | mm12002_Ntsr1 | CCTGGTGTGCACACCCACGG |
| SEQ ID NO: 2366 | mm12003_Ntsr1 | AGCACTGTGCATTACCACCT |
| SEQ ID NO: 2367 | mm12004_Ntsr1 | AGGATGGAGATGATCAGCAT |
| SEQ ID NO: 2368 | mm12005_Ntsr1 | CCCACATCCACAGTTCGGAC |
| SEQ ID NO: 2369 | mm12006_Ntsr2 | CGAGATCGCCGAAGACCCAG |
| SEQ ID NO: 2370 | mm12007_Ntsr2 | GAAGATGAGCGAATAGAGCG |
| SEQ ID NO: 2371 | mm12008_Ntsr2 | TGTCCCATGATAACCGCCAT |
| SEQ ID NO: 2372 | mm12009_Ntsr2 | TAGCACCGTGCACACACGCG |
| SEQ ID NO: 2373 | mm12066_Ocln | CTTTCCGCATAGTCAGATGG |
| SEQ ID NO: 2374 | mm12067_Ocln | TCCCATTATGTACACGATCG |
| SEQ ID NO: 2375 | mm12068_Ocln | TCCGGATAAAAGAGTACGC |
| SEQ ID NO: 2376 | mm12069_Ocln | ATATTTGTATCACTACTGTG |
| SEQ ID NO: 2377 | mm12122_Olfr13 | GTAAGGGTAAAAGTAACACG |
| SEQ ID NO: 2378 | mm12123_Olfr13 | CAGGCAGATGAGCCCCACGA |
| SEQ ID NO: 2379 | mm12124_Olfr13 | AGGACATCACCACTAGGAGA |
| SEQ ID NO: 2380 | mm12125_Olfr13 | TGATGGCAGAGTAACGGAGT |
| SEQ ID NO: 2381 | mm12294_Omg | AAATACCCTAAGAAGTCTCG |
| SEQ ID NO: 2382 | mm12295_Omg | ATATACCAATCTGAGAACCC |
| SEQ ID NO: 2383 | mm12296_Omg | AACTTGACTACATTACCACC |
| SEQ ID NO: 2384 | mm12297_Omg | ACAAGGAGTCCCTATCACAT |
| SEQ ID NO: 2385 | mm12370_Osmr | TATACCTGGCAAATCACTGA |
| SEQ ID NO: 2386 | mm12371_Osmr | CCCGTATCTGGAGACACGAT |
| SEQ ID NO: 2387 | mm12372_Osmr | AGAGGTAGTTTGCGCTCATG |
| SEQ ID NO: 2388 | mm12373_Osmr | ATCAATTGTCAAGCCACGAA |
| SEQ ID NO: 2389 | mm12422_Mybbp1a | ACAGGCACTAGACCTGATCG |
| SEQ ID NO: 2390 | mm12423_Mybbp1a | CCAGAGATAAGTACATACGT |
| SEQ ID NO: 2391 | mm12424_Mybbp1a | TTTGGACGACCGCAACCGTG |
| SEQ ID NO: 2392 | mm12425_Mybbp1a | AGATATGACCAAATACACTC |
| SEQ ID NO: 2393 | mm12426_P2rx1 | ACTGCTGATAAGGCCACTTG |
| SEQ ID NO: 2394 | mm12427_P2rx1 | ACTCTCGCACCACATAGCCA |
| SEQ ID NO: 2395 | mm12428_P2rx1 | GCTGGTACGAAACAAGAAGG |
| SEQ ID NO: 2396 | mm12429_P2rx1 | GGCATATGCCAAGATGACAG |
| SEQ ID NO: 2397 | mm12430_P2rx4 | AGTGGGGCTCATGAACCGCG |
| SEQ ID NO: 2398 | mm12431_P2rx4 | GTCACCGTGAACCAGACGCA |
| SEQ ID NO: 2399 | mm12432_P2rx4 | CTGAGCTGGGACCACATAGT |
| SEQ ID NO: 2400 | mm12433_P2rx4 | CTACCAGGAAACGGACTCTG |
| SEQ ID NO: 2401 | mm12434_P2rx7 | CTGACCGGCGTTGTAAAAAG |

TABLE 1-continued mmSurf sgRNA library sequences

| SEQ ID NO | id_gRNA Target | Sequence |
|---|---|---|
| SEQ ID NO: 2402 | mm12435_P2rx7 | GTTACCTGAAGTTGTAGCCG |
| SEQ ID NO: 2403 | mm12436_P2rx7 | GTGTTCCATCTTCCGACTAG |
| SEQ ID NO: 2404 | mm12437_P2rx7 | ACCTCTTACCAAGCCAAAGT |
| SEQ ID NO: 2405 | mm12442_P2ry1 | TGCTACCGTAGAGATTTACG |
| SEQ ID NO: 2406 | mm12443_P2ry1 | AGCCTGCCCAGAGACTTGAG |
| SEQ ID NO: 2407 | mm12444_P2ry1 | CGGTCTTGGTCAGGGCACAT |
| SEQ ID NO: 2408 | mm12445_P2ry1 | AGCCAAATTGAACATGTACA |
| SEQ ID NO: 2409 | mm12450_P4ha1 | TCATGGAAACGGATAATCCG |
| SEQ ID NO: 2410 | mm12451_P4ha1 | GATCCATAATGAGAAAGACC |
| SEQ ID NO: 2411 | mm12452_P4ha1 | TGAAACGTCTGAACACTGAG |
| SEQ ID NO: 2412 | mm12453_P4ha1 | GGACACAAATACCATCTCAA |
| SEQ ID NO: 2413 | mm12454_P4ha2 | CTGTCAAATCAGACAGACGC |
| SEQ ID NO: 2414 | mm12455_P4ha2 | CACCAGGGACTTGGTAACAG |
| SEQ ID NO: 2415 | mm12456_P4ha2 | ATCCGGACACGATTTCCAGA |
| SEQ ID NO: 2416 | mm12457_P4ha2 | CTTCTCTGCGTAAATCAGAT |
| SEQ ID NO: 2417 | mm12458_P4hb | TAGGGTAATAAGCCGCACAG |
| SEQ ID NO: 2418 | mm12459_P4hb | TTTGGAATCACGTCCAACAG |
| SEQ ID NO: 2419 | mm12460_P4hb | GGTGGACTCAAGCGAAGTGA |
| SEQ ID NO: 2420 | mm12461_P4hb | AAGAGTGTATCTGACTATGA |
| SEQ ID NO: 2421 | mm12506_Pam | ATGGTGAGTATGGACTCGGT |
| SEQ ID NO: 2422 | mm12507_Pam | AGAATCTTACCCGATGTGGG |
| SEQ ID NO: 2423 | mm12508_Pam | ACTGGATATTCGCATGCCTG |
| SEQ ID NO: 2424 | mm12509_Pam | AATTCCTGTAAAATCCGACA |
| SEQ ID NO: 2425 | mm12510_Cntn3 | CATCGTTACAAACTGAATGG |
| SEQ ID NO: 2426 | mm12511_Cntn3 | TGTCGTGGAGTTAAACCCAT |
| SEQ ID NO: 2427 | mm12512_Cntn3 | AACATTCAATTGAAACACAG |
| SEQ ID NO: 2428 | mm12513_Cntn3 | CGCACCTGTCACAACCAAGT |
| SEQ ID NO: 2429 | mm12602_Pcna | ATACGTGCAAATTCACCCGA |
| SEQ ID NO: 2430 | mm12603_Pcna | GCGCAGAGTAAGCTGTACCA |
| SEQ ID NO: 2431 | mm12604_Pcna | GATATCCTGTGCAAAGAATG |
| SEQ ID NO: 2432 | mm12605_Pcna | TGCTTCGAATACTAGTGCTA |
| SEQ ID NO: 2433 | mm12626_Pcsk2 | TCCTGGGCTAGACTTGAACG |
| SEQ ID NO: 2434 | mm12627_Pcsk2 | AGAGCAACTCTCATCATACA |
| SEQ ID NO: 2435 | mm12628_Pcsk2 | GGATTTGACCGTAAAAGAG |
| SEQ ID NO: 2436 | mm12629_Pcsk2 | TTATCACAATGGGCTTGCAA |
| SEQ ID NO: 2437 | mm12630_Furin | ACCCTGTCTTACAATCGCCG |
| SEQ ID NO: 2438 | mm12631_Furin | ACAGCCCGTAGCCATACGAA |
| SEQ ID NO: 2439 | mm12632_Furin | GGGCACATTGCCGAACTGTG |

TABLE 1-continued mmSurf sgRNA library sequences

| SEQ ID NO | id_gRNA Target | Sequence |
|---|---|---|
| SEQ ID NO: 2440 | mm12633_Furin | ACAATGCCCGAATTGGAGGT |
| SEQ ID NO: 2441 | mm12642_Pcsk6 | GTTGCTGGCGTCATATCTCG |
| SEQ ID NO: 2442 | mm12643_Pcsk6 | CTGATAAGAACAGTCGCTGT |
| SEQ ID NO: 2443 | mm12644_Pcsk6 | GGCCACGCATACGTGCTGGG |
| SEQ ID NO: 2444 | mm12645_Pcsk6 | GGAAAGACAGTAGATGGACC |
| SEQ ID NO: 2445 | mm12666_Pdcd1 | CAATACAGGGATACCCACTA |
| SEQ ID NO: 2446 | mm12667_Pdcd1 | GACACACGGCGCAATGACAG |
| SEQ ID NO: 2447 | mm12668_Pdcd1 | CAGCTTGTCCAACTGGTCGG |
| SEQ ID NO: 2448 | mm12669_Pdcd1 | GCTCAAACCATTACAGAAGG |
| SEQ ID NO: 2449 | mm12738_Pdgfa | AGCCGCTCGATCAACTCCCG |
| SEQ ID NO: 2450 | mm12739_Pdgfa | CGGTCATTTACGAGATACCT |
| SEQ ID NO: 2451 | mm12740_Pdgfa | CTCTTGGAGATAGACTCCGT |
| SEQ ID NO: 2452 | mm12741_Pdgfa | ATTCGCAGGAAGAGAAGTAT |
| SEQ ID NO: 2453 | mm12742_Pdgfb | CCTCGGCGCTGACCAGACGC |
| SEQ ID NO: 2454 | mm12743_Pdgfb | CGAGTGCAAGACGCGCACAG |
| SEQ ID NO: 2455 | mm12744_Pdgfb | TGGAAAGCTCATCTCGAGGG |
| SEQ ID NO: 2456 | mm12745_Pdgfb | AGGCCCGGCATTGCACATTG |
| SEQ ID NO: 2457 | mm12746_Pdgfra | TAAGGCAGGAGAAACGATCG |
| SEQ ID NO: 2458 | mm12747_Pdgfra | TAACCTTGCACAATAACGGG |
| SEQ ID NO: 2459 | mm12748_Pdgfra | AGATATACTCATGTCCATCG |
| SEQ ID NO: 2460 | mm12749_Pdgfra | CACAGAATACTGCTTCTATG |
| SEQ ID NO: 2461 | mm12750_Pdgfrb | CGGACAGTGGCTGATCCACG |
| SEQ ID NO: 2462 | mm12751_Pdgfrb | CCGCAGAGAATGGCTACGTG |
| SEQ ID NO: 2463 | mm12752_Pdgfrb | ATGGACGTACCCCGCATGA |
| SEQ ID NO: 2464 | mm12753_Pdgfrb | CGGTCATGAGTACATCTACG |
| SEQ ID NO: 2465 | mm12782_Enpp1 | TACAACGCAAGTTGCCACTG |
| SEQ ID NO: 2466 | mm12783_Enpp1 | GGTGACCGCTAATCATCAGG |
| SEQ ID NO: 2467 | mm12784_Enpp1 | ATGTGAAAGCATCGATACCC |
| SEQ ID NO: 2468 | mm12785_Enpp1 | AACGTCTTGGTAGGGTACAT |
| SEQ ID NO: 2469 | mm12922_Abcb1a | ACTGAATGCTCCAATTAACA |
| SEQ ID NO: 2470 | mm12923_Abcb1a | CAGGAAGCTTAGTACCAAAG |
| SEQ ID NO: 2471 | mm12924_Abcb1a | CAAAGATCAGCATCATAAGT |
| SEQ ID NO: 2472 | mm12925_Abcb1a | AATGACGTCAGCATTACGAA |
| SEQ ID NO: 2473 | mm12926_Phb | GTGATGACTGGTACGTTCCG |
| SEQ ID NO: 2474 | mm12927_Phb | TTACCAGGGACACGTCATCC |
| SEQ ID NO: 2475 | mm12928_Phb | CCAATGCTGGTGTAGATACG |
| SEQ ID NO: 2476 | mm12929_Phb | CACTCACCACCACCGACTTG |
| SEQ ID NO: 2477 | mm13110_Pkd1 | ATTCCCGTACCGATATACCT |

TABLE 1-continued mmSurf sgRNA library sequences

| SEQ ID NO | id_gRNA Target | Sequence |
| --- | --- | --- |
| SEQ ID NO: 2478 | mm13111_Pkd1 | ACAGTTGCGTAGATCAACAT |
| SEQ ID NO: 2479 | mm13112_Pkd1 | AGCTCGCAGACATAACTATG |
| SEQ ID NO: 2480 | mm13113_Pkd1 | TGATGGTGTCCTATATACGT |
| SEQ ID NO: 2481 | mm13158_Pla2g1b | CCTTCAGGGGATCACTCCCG |
| SEQ ID NO: 2482 | mm13159_Pla2g1b | CCTGTCTAAGTCGTCCACTG |
| SEQ ID NO: 2483 | mm13160_Pla2g1b | GCATGAGTAGGAGTAAGTGT |
| SEQ ID NO: 2484 | mm13161_Pla2g1b | TGGTGCACTTGATCATATTG |
| SEQ ID NO: 2485 | mm13162_Pla2r1 | TGGATCGCCTACACGTCCAG |
| SEQ ID NO: 2486 | mm13163_Pla2r1 | ATTCCCAATCCATATAGCAG |
| SEQ ID NO: 2487 | mm13164_Pla2r1 | TCTGTGATGCTACGTGGCAA |
| SEQ ID NO: 2488 | mm13165_Pla2r1 | TTTGCATATATAAGGCAAGG |
| SEQ ID NO: 2489 | mm13174_Pla2g5 | CCGTTGTTATGGGCAACTGG |
| SEQ ID NO: 2490 | mm13175_Pla2g5 | GGTCGCGGGACACCCAAGGA |
| SEQ ID NO: 2491 | mm13176_Pla2g5 | GTCATAGGACTGGGTCCGAA |
| SEQ ID NO: 2492 | mm13177_Pla2g5 | TGAGTTCTAGCAAGCCCCCT |
| SEQ ID NO: 2493 | mm13194_Plat | TGAAGCCCTACAATGCAAGG |
| SEQ ID NO: 2494 | mm13195_Plat | CGAACCAAGATGCTTCAATG |
| SEQ ID NO: 2495 | mm13196_Plat | CCTCCTTTAATTCTAAACTG |
| SEQ ID NO: 2496 | mm13197_Plat | GACCACTTTAAGATGATTGG |
| SEQ ID NO: 2497 | mm13198_Plau | CCCCCAACAATCTTAAAGCG |
| SEQ ID NO: 2498 | mm13199_Plau | ACTCCCACCACATTTAAAGG |
| SEQ ID NO: 2499 | mm13200_Plau | CCAACACTGATACCAAAGGT |
| SEQ ID NO: 2500 | mm13201_Plau | GCTGGTACGTATCTTCAGCA |
| SEQ ID NO: 2501 | mm13202_Plaur | AGGACCATGAGTTACCGCAT |
| SEQ ID NO: 2502 | mm13203_Plaur | AAGGATGAGGACTACACCCG |
| SEQ ID NO: 2503 | mm13204_Plaur | AGGTGCAGGACGCACACTCG |
| SEQ ID NO: 2504 | mm13205_Plaur | TGCAACTACACCCACTGCAA |
| SEQ ID NO: 2505 | mm13238_Pld3 | TATCGGGTGTCAAAGGACCG |
| SEQ ID NO: 2506 | mm13239_Pld3 | ATGCGAACCTTTACACCTCG |
| SEQ ID NO: 2507 | mm13240_Pld3 | ACTGCCCTTGAATGAAATCG |
| SEQ ID NO: 2508 | mm13241_Pld3 | GCTGTTTCTATGGGAATACG |
| SEQ ID NO: 2509 | mm13254_Pa2g4 | CAGGACTATATACTCAAGGA |
| SEQ ID NO: 2510 | mm13255_Pa2g4 | TCAGGCCATATTGTTTAGAG |
| SEQ ID NO: 2511 | mm13256_Pa2g4 | TGCTGAAGCTGCCTTACGAC |
| SEQ ID NO: 2512 | mm13257_Pa2g4 | GTGACCAAGTATAAGATGGG |
| SEQ ID NO: 2513 | mm13258_Prl7d1 | TGAGGATGTCCGAAAGACAT |
| SEQ ID NO: 2514 | mm13259_Prl7d1 | GAACGTTGATGGGAACAGTG |
| SEQ ID NO: 2515 | mm13260_Prl7d1 | GATGTCAAATCTCTTCCTGT |

TABLE 1-continued mmSurf sgRNA library sequences

| SEQ ID NO | id_gRNA Target | Sequence |
|---|---|---|
| SEQ ID NO: 2516 | mm13261_Prl7d1 | CCTTTGATAGGATCCTATAA |
| SEQ ID NO: 2517 | mm13262_Plg | GCAGCAATGCGTGATCATGG |
| SEQ ID NO: 2518 | mm13263_Plg | GAAGAGGTGAAAATTACCGA |
| SEQ ID NO: 2519 | mm13264_Plg | AGAGCTTACTTGGGTACGTG |
| SEQ ID NO: 2520 | mm13265_Plg | AGGAATGCTACCAGAGCGAT |
| SEQ ID NO: 2521 | mm13266_Serpinf2 | ACGTTCCACTCAAAATAAGT |
| SEQ ID NO: 2522 | mm13267_Serpinf2 | TCCAGCAGGAACCATCGAAG |
| SEQ ID NO: 2523 | mm13268_Serpinf2 | AGCCATTTCTACCAGAACCT |
| SEQ ID NO: 2524 | mm13269_Serpinf2 | GTGACCATGCTACCCTCAAG |
| SEQ ID NO: 2525 | mm13278_Plod1 | AGCATATCTACCCGGACCGG |
| SEQ ID NO: 2526 | mm13279_Plod1 | CACTGGATACTCACACACGA |
| SEQ ID NO: 2527 | mm13280_Plod1 | TGTCAACGAAGAGAATAACC |
| SEQ ID NO: 2528 | mm13281_Plod1 | CCGTAGGCCCTCGTCACACA |
| SEQ ID NO: 2529 | mm13298_Pltp | ACATCTCCAACGCATCCTTG |
| SEQ ID NO: 2530 | mm13299_Pltp | AAAATGAATATGGCCTTCGG |
| SEQ ID NO: 2531 | mm13300_Pltp | AGTGGGGAGTTAATCACTGT |
| SEQ ID NO: 2532 | mm13301_Pltp | CGACGAGAGGATGGTGTACG |
| SEQ ID NO: 2533 | mm13306_Plxna1 | TGACTACCAAGGCCGCACCG |
| SEQ ID NO: 2534 | mm13307_Plxna1 | TCCAACAGTACTCCTATGAG |
| SEQ ID NO: 2535 | mm13308_Plxna1 | AGTATACGAACTGCTCGCTG |
| SEQ ID NO: 2536 | mm13309_Plxna1 | CGGCGCCCGGCACACCATGG |
| SEQ ID NO: 2537 | mm13310_Plxna2 | ACTGTTCACATGATTCAACA |
| SEQ ID NO: 2538 | mm13311_Plxna2 | CTGCAGACTGCTATCCACCC |
| SEQ ID NO: 2539 | mm13312_Plxna2 | TACAATGCACAGGTTCACGT |
| SEQ ID NO: 2540 | mm13313_Plxna2 | ATGTGGTACCTATAACGGCA |
| SEQ ID NO: 2541 | mm13366_Sept5 | GACATCGACAAGCAGTACGT |
| SEQ ID NO: 2542 | mm13367_Sept5 | TTTCCGGTCCTTATACAGGT |
| SEQ ID NO: 2543 | mm13368_Sept5 | CACACACCCGTGTCCGAACG |
| SEQ ID NO: 2544 | mm13369_Sept5 | AAAGCCGGGCGTGTCCACAA |
| SEQ ID NO: 2545 | mm13410_Pon1 | CTGGATGGTTTACCACCAGT |
| SEQ ID NO: 2546 | mm13411_Pon1 | CTTACTGATAGGAAGACCGA |
| SEQ ID NO: 2547 | mm13412_Pon1 | AAATGTACTTGGGTCTGTCG |
| SEQ ID NO: 2548 | mm13413_Pon1 | GAAGGGTTTGATTTCGCGAA |
| SEQ ID NO: 2549 | mm13478_Ppap2a | AAAGTATATCCATTTCAGAG |
| SEQ ID NO: 2550 | mm13479_Ppap2a | GTATGGCGAGTATACGGGAC |
| SEQ ID NO: 2551 | mm13480_Ppap2a | CCCGAGTAGAAAGACAACCT |
| SEQ ID NO: 2552 | mm13481_Ppap2a | ATACTTAGCGATGTCAGTCA |
| SEQ ID NO: 2553 | mm13514_Ctsa | GTGGTGCTTTGGCTTAACGG |

TABLE 1-continued mmSurf sgRNA library sequences

| SEQ ID NO | id_gRNA Target | Sequence |
| --- | --- | --- |
| SEQ ID NO: 2554 | mm13515_Ctsa | GGACTCGATATACAGCACGT |
| SEQ ID NO: 2555 | mm13516_Ctsa | CTCCGGCTACCTCAGAGCAT |
| SEQ ID NO: 2556 | mm13517_Ctsa | CATGACCAGTACAGCCAAGG |
| SEQ ID NO: 2557 | mm13522_Ppib | GTGGCCAACGATAAGAAGAA |
| SEQ ID NO: 2558 | mm13523_Ppib | GGGCAGCAAAAGGAAGACGA |
| SEQ ID NO: 2559 | mm13524_Ppib | TGAAGTCCTTGATGACACGA |
| SEQ ID NO: 2560 | mm13525_Ppib | CCAGGGTGGAGACTTCACCA |
| SEQ ID NO: 2561 | mm13530_Lgals3bp | AGAAACCATTGCCTCACACG |
| SEQ ID NO: 2562 | mm13531_Lgals3bp | TGTCCATCCCAGATACCACG |
| SEQ ID NO: 2563 | mm13532_Lgals3bp | GCGTACGCATAAAGGTCCAA |
| SEQ ID NO: 2564 | mm13533_Lgals3bp | AACGGGCCTCAGCCAATGA |
| SEQ ID NO: 2565 | mm13666_Prkcsh | AAGACCAGGTAGAAACACTG |
| SEQ ID NO: 2566 | mm13667_Prkcsh | CAGGGACAAGTACCGCTCTG |
| SEQ ID NO: 2567 | mm13668_Prkcsh | GGCACAGACGAGTACAACAG |
| SEQ ID NO: 2568 | mm13669_Prkcsh | AACTTGACGACAACATGGAT |
| SEQ ID NO: 2569 | mm13670_Prkdc | AGAGCCAATTCAGTGACCCG |
| SEQ ID NO: 2570 | mm13671_Prkdc | TGGCCCTTGTAAGTAGACGA |
| SEQ ID NO: 2571 | mm13672_Prkdc | CATGCAGGGTAAGTAATCGT |
| SEQ ID NO: 2572 | mm13673_Prkdc | ACAGAGGATGCTCAAAAATG |
| SEQ ID NO: 2573 | mm13722_Prlr | ATCCACATAAAGTGGATCCG |
| SEQ ID NO: 2574 | mm13723_Prlr | ATGTCAATGAATAATTGGTG |
| SEQ ID NO: 2575 | mm13724_Prlr | ATTTGATACTCATCTGCTAG |
| SEQ ID NO: 2576 | mm13725_Prlr | TCCCATTCCAAAGAGTATCC |
| SEQ ID NO: 2577 | mm13734_Prnp | TGGCCCCATCCACCGCCATG |
| SEQ ID NO: 2578 | mm13735_Prnp | GTGACTATGTGGACTGATGT |
| SEQ ID NO: 2579 | mm13736_Prnp | AAAAACCAACCTCAAGCATG |
| SEQ ID NO: 2580 | mm13737_Prnp | ACCCTAACCAAGTGTACTAC |
| SEQ ID NO: 2581 | mm13742_Procr | TCCAAGACAACCATCATGTG |
| SEQ ID NO: 2582 | mm13743_Procr | TGCGCCCTTTGTAACTCCGA |
| SEQ ID NO: 2583 | mm13744_Procr | GCTGGTATATCGCGAGCGCA |
| SEQ ID NO: 2584 | mm13745_Procr | GCCACATCGAAGAAGACATG |
| SEQ ID NO: 2585 | mm13750_Prom1 | GAGTGAAGACTCACGCCATG |
| SEQ ID NO: 2586 | mm13751_Prom1 | AAGGACTCCGATCTCATAGA |
| SEQ ID NO: 2587 | mm13752_Prom1 | CAGCAACAGATACTTAAACC |
| SEQ ID NO: 2588 | mm13753_Prom1 | CAAAGCCATATATAATGCCA |
| SEQ ID NO: 2589 | mm13794_St14 | AGGAGCCCACTGGTACGTTG |
| SEQ ID NO: 2590 | mm13795_St14 | GGGTCCCTACCACAAGAAGT |
| SEQ ID NO: 2591 | mm13796_St14 | GGGGCTCAGGCTATCATACA |

TABLE 1-continued mmSurf sgRNA library sequences

| SEQ ID NO | id_gRNA Target | Sequence |
|---|---|---|
| SEQ ID NO: 2592 | mm13797_St14 | GTGACAGTGTCAACGACTGT |
| SEQ ID NO: 2593 | mm13818_Psap | CTACGTGGACCAGTATTCCG |
| SEQ ID NO: 2594 | mm13819_Psap | GTCAACCACCTCCTTGCACG |
| SEQ ID NO: 2595 | mm13820_Psap | CCTCAGCTAACCTTAGGTTG |
| SEQ ID NO: 2596 | mm13821_Psap | TCTGGCATAAAATCACATTG |
| SEQ ID NO: 2597 | mm13834_Psen1 | TTTCAACCAGCATACGAAGT |
| SEQ ID NO: 2598 | mm13835_Psen1 | TGCTACTGTAACGTAGTCCA |
| SEQ ID NO: 2599 | mm13836_Psen1 | CTGAGCCAATATCTAATGGG |
| SEQ ID NO: 2600 | mm13837_Psen1 | AGTCAGCTTCTATACCCGGA |
| SEQ ID NO: 2601 | mm13838_Psen2 | TGTCACGCTGTGTATGATCG |
| SEQ ID NO: 2602 | mm13839_Psen2 | GAGCCCCACTGCATGCGTAG |
| SEQ ID NO: 2603 | mm13840_Psen2 | GATACTTGTAGAGTACCACG |
| SEQ ID NO: 2604 | mm13841_Psen2 | AGTGCTCAAGACCTACAATG |
| SEQ ID NO: 2605 | mm13922_Pstpip1 | CTGGTTACAGTGCACCCACA |
| SEQ ID NO: 2606 | mm13923_Pstpip1 | TGTTTGTAGAAAGAGTGTAC |
| SEQ ID NO: 2607 | mm13924_Pstpip1 | ATTGGCACTCACACGCTCGA |
| SEQ ID NO: 2608 | mm13925_Pstpip1 | GTCGCTCTACAAGAAGACCA |
| SEQ ID NO: 2609 | mm13934_Ptafr | ATTGTCTACTACTACAACGA |
| SEQ ID NO: 2610 | mm13935_Ptafr | CATCAATACCTACTGCAGTG |
| SEQ ID NO: 2611 | mm13936_Ptafr | AGAGATGCCACGCTTGCGGG |
| SEQ ID NO: 2612 | mm13937_Ptafr | AAGACATGAACAACAAGGAT |
| SEQ ID NO: 2613 | mm13942_Ptch1 | AGCTAATCTCGAGACCAACG |
| SEQ ID NO: 2614 | mm13943_Ptch1 | TGTGAGGGTCATACTCTGTG |
| SEQ ID NO: 2615 | mm13944_Ptch1 | CTGGCAGAGGACTTACGTGG |
| SEQ ID NO: 2616 | mm13945_Ptch1 | TAAAAATGGATCAGATGACG |
| SEQ ID NO: 2617 | mm13978_Ptger3 | TCAAGTACTACCGACGACTG |
| SEQ ID NO: 2618 | mm13979_Ptger3 | ATGTGGCTGGCATACCAGTG |
| SEQ ID NO: 2619 | mm13980_Ptger3 | GGGAGCAGCTCGACCCATCG |
| SEQ ID NO: 2620 | mm13981_Ptger3 | TGGCGCTCACCGACTTAGTG |
| SEQ ID NO: 2621 | mm13990_Ptgfrn | GGTCACGCTTACACCAGACG |
| SEQ ID NO: 2622 | mm13991_Ptgfrn | CATTCTATAGTACCACGACA |
| SEQ ID NO: 2623 | mm13992_Ptgfrn | ATCCTAGCCCTAAGCCACGA |
| SEQ ID NO: 2624 | mm13993_Ptgfrn | AGCGGGTGATATCCTGTTG |
| SEQ ID NO: 2625 | mm14006_Ptgs2 | AACATCATATTTGAGCCTTG |
| SEQ ID NO: 2626 | mm14007_Ptgs2 | TAGTGCACATTGTAAGTAGG |
| SEQ ID NO: 2627 | mm14008_Ptgs2 | GACTACGTGCAACACCTGAG |
| SEQ ID NO: 2628 | mm14009_Ptgs2 | CGTGGGAATGTATGAGCAC |
| SEQ ID NO: 2629 | mm14018_Pth1r | TCCAGGGCACAACCGGACGT |

TABLE 1-continued mmSurf sgRNA library sequences

| SEQ ID NO | id_gRNA Target | Sequence |
|---|---|---|
| SEQ ID NO: 2630 | mm14019_Pth1r | TCATAAATGTAATCGGGACA |
| SEQ ID NO: 2631 | mm14020_Pth1r | CCGCCCACCTAAAATAGGCT |
| SEQ ID NO: 2632 | mm14021_Pth1r | GAGCAACCTTGGCCAACACT |
| SEQ ID NO: 2633 | mm14042_Ptn | TGTGTGCGTGCCTACCAGCG |
| SEQ ID NO: 2634 | mm14043_Ptn | AAGGTGAAAAGTCTGACTG |
| SEQ ID NO: 2635 | mm14044_Ptn | AAGTACCAGTTCCAGGCTTG |
| SEQ ID NO: 2636 | mm14045_Ptn | CCAAGATGAAAATCAATGCC |
| SEQ ID NO: 2637 | mm14106_Sirpa | TAATTCTAAGGTCATCTGCG |
| SEQ ID NO: 2638 | mm14107_Sirpa | TGGAGAATGGAAACGTATCA |
| SEQ ID NO: 2639 | mm14108_Sirpa | GGAACAGAGGTCTATGTACT |
| SEQ ID NO: 2640 | mm14109_Sirpa | CACCTGGTTCATTGACGTCG |
| SEQ ID NO: 2641 | mm14118_Ptprc | GTAGCAGAAATCTTATATCG |
| SEQ ID NO: 2642 | mm14119_Ptprc | TTTCACAATGGAGTGTACGA |
| SEQ ID NO: 2643 | mm14120_Ptprc | TTGTCAAGCTAAGGCGACAG |
| SEQ ID NO: 2644 | mm14121_Ptprc | ACCACAACGAAGCAAACATG |
| SEQ ID NO: 2645 | mm14130_Ptprf | GGGTTCCCGACTATCGACAT |
| SEQ ID NO: 2646 | mm14131_Ptprf | GGCAGCGAGCCGGAAGACGT |
| SEQ ID NO: 2647 | mm14132_Ptprf | CTGTACACCTGACTAGCGAG |
| SEQ ID NO: 2648 | mm14133_Ptprf | CGAAGACCGTAAGCGACATG |
| SEQ ID NO: 2649 | mm14134_Ptprg | TAAAAGCCTATGTCCCGAG |
| SEQ ID NO: 2650 | mm14135_Ptprg | TCCACTATTTCACTACAGGG |
| SEQ ID NO: 2651 | mm14136_Ptprg | AGCATAGTGTCAATGGCCGG |
| SEQ ID NO: 2652 | mm14137_Ptprg | GGCACTTCACGGGAACGTCG |
| SEQ ID NO: 2653 | mm14138_Ptprj | ACTGACCGATGTAATATTAG |
| SEQ ID NO: 2654 | mm14139_Ptprj | CCTGGAAAAGCAATTACGAT |
| SEQ ID NO: 2655 | mm14140_Ptprj | AGACACCAGGGATTAACTCA |
| SEQ ID NO: 2656 | mm14141_Ptprj | GAGTGACAAATGTCAGCACA |
| SEQ ID NO: 2657 | mm14142_Ptprk | TACCAGAACGCCCTAAGTGG |
| SEQ ID NO: 2658 | mm14143_Ptprk | TGCGTAACTCAGTCAGAACG |
| SEQ ID NO: 2659 | mm14144_Ptprk | ACCTACCGCAAGGATAACTC |
| SEQ ID NO: 2660 | mm14145_Ptprk | AGAAGCGCAAAGATGCAATG |
| SEQ ID NO: 2661 | mm14150_Ptprm | AGAGCCGACACAAACATATG |
| SEQ ID NO: 2662 | mm14151_Ptprm | GTAGTGAAAGTCGATGCAGT |
| SEQ ID NO: 2663 | mm14152_Ptprm | TAAAAATAGATCCCATGCG |
| SEQ ID NO: 2664 | mm14153_Ptprm | CAAAATTGACTGTGTCCGAG |
| SEQ ID NO: 2665 | mm14154_Ptprn2 | CTCACCATCATCCATACTCG |
| SEQ ID NO: 2666 | mm14155_Ptprn2 | AGATCACAGACTATCAGAGG |
| SEQ ID NO: 2667 | mm14156_Ptprn2 | TGCTGATGTGTGGGCCACGT |

TABLE 1-continued mmSurf sgRNA library sequences

| SEQ ID NO | id_gRNA Target | Sequence |
|---|---|---|
| SEQ ID NO: 2668 | mm14157_Ptprn2 | CAAGGCCTACCTATGGCATG |
| SEQ ID NO: 2669 | mm14166_Ptprs | ATGATGTCCTTGATGCGCGG |
| SEQ ID NO: 2670 | mm14167_Ptprs | CAATTACGTAGTAGGACACG |
| SEQ ID NO: 2671 | mm14168_Ptprs | AGAAGCGTGGGGCCACACGG |
| SEQ ID NO: 2672 | mm14169_Ptprs | ATGGAGCCGGAACACCCAGT |
| SEQ ID NO: 2673 | mm14170_Ptprt | ACCTCCCAATGAGACCAATG |
| SEQ ID NO: 2674 | mm14171_Ptprt | CAAAGTAGTGTAGCGAATCG |
| SEQ ID NO: 2675 | mm14172_Ptprt | CCTGCGACTCCAAAACGTTG |
| SEQ ID NO: 2676 | mm14173_Ptprt | ACAGGGTCACAAGTCCGGTA |
| SEQ ID NO: 2677 | mm14190_Igdcc3 | ACAGCTCGGACATTGCGTGG |
| SEQ ID NO: 2678 | mm14191_Igdcc3 | CCTGACAGTGCACCAGACTG |
| SEQ ID NO: 2679 | mm14192_Igdcc3 | CAAAGCCTACACACCACGAG |
| SEQ ID NO: 2680 | mm14193_Igdcc3 | AGGTACACACTACTGCCCAA |
| SEQ ID NO: 2681 | mm14206_Pvrl2 | TCCCAACGGTACCCGCAGGG |
| SEQ ID NO: 2682 | mm14207_Pvrl2 | GCGGGTACGAGTGCTTCCCG |
| SEQ ID NO: 2683 | mm14208_Pyrl2 | TTTCCACCCATCCTTCGGAG |
| SEQ ID NO: 2684 | mm14209_Pyrl2 | TGACCATTCGATCCACAGAG |
| SEQ ID NO: 2685 | mm14494_Robo3 | TCTGCGTAGACCAATAAACC |
| SEQ ID NO: 2686 | mm14495_Robo3 | GGCCTCGACCCAACATCGAG |
| SEQ ID NO: 2687 | mm14496_Robo3 | CATCACTGAAGTAAAGATCG |
| SEQ ID NO: 2688 | mm14497_Robo3 | TGTGGCCAAGAGTTCCATAG |
| SEQ ID NO: 2689 | mm14578_Rdx | AAAAACAGTTGGCTTACGTG |
| SEQ ID NO: 2690 | mm14579_Rdx | GAGAATACAGAACTGGCATG |
| SEQ ID NO: 2691 | mm14580_Rdx | ACCATGAACTGTACATGCGA |
| SEQ ID NO: 2692 | mm14581_Rdx | AATAAAGAGATTCACAAACC |
| SEQ ID NO: 2693 | mm14670_Rfng | CGGGACGCGCACCTGCCGTG |
| SEQ ID NO: 2694 | mm14671_Rfng | AGCAATTGGTGTTGATCATG |
| SEQ ID NO: 2695 | mm14672_Rfng | TCCGGGTCGGGACCCGATCG |
| SEQ ID NO: 2696 | mm14673_Rfng | AGCACTGTGCTGCAAAATGT |
| SEQ ID NO: 2697 | mm14734_Rhag | CCTGCATAATCGTACCCCAT |
| SEQ ID NO: 2698 | mm14735_Rhag | GCAATGGCTGAATTAAAGCT |
| SEQ ID NO: 2699 | mm14736_Rhag | GGCATAGGCTGTGATCACAC |
| SEQ ID NO: 2700 | mm14737_Rhag | TCATGATCAACATTTGAATG |
| SEQ ID NO: 2701 | mm14810_Robo1 | TTCGATGTAAGCGCTCCACG |
| SEQ ID NO: 2702 | mm14811_Robo1 | GCTGGACGTTCGTAATGGTG |
| SEQ ID NO: 2703 | mm14812_Robo1 | GATACAGTTACACTTCGGGG |
| SEQ ID NO: 2704 | mm14813_Robo1 | CTGGGTCTCTTCACAAACGA |
| SEQ ID NO: 2705 | mm14830_Mst1r | AAGTATCAGACTTTAGACGA |

TABLE 1-continued mmSurf sgRNA library sequences

| SEQ ID NO | id_gRNA Target | Sequence |
|---|---|---|
| SEQ ID NO: 2706 | mm14831_Mst1r | GGGAACACACCAGATCACCG |
| SEQ ID NO: 2707 | mm14832_Mst1r | ATGTGGTCCGAAACCCTCAG |
| SEQ ID NO: 2708 | mm14833_Mst1r | AAGACGTGTCACATGCAGTG |
| SEQ ID NO: 2709 | mm14842_Ros1 | GGGTTGTAGAACATGTTGCG |
| SEQ ID NO: 2710 | mm14843_Ros1 | AGAGATATGAGATACGGACA |
| SEQ ID NO: 2711 | mm14844_Ros1 | GTCATGGTGTGACATTACGC |
| SEQ ID NO: 2712 | mm14845_Ros1 | GTCACTCCTTATACCTACTG |
| SEQ ID NO: 2713 | mm14878_Rpl18 | TGTGACCGTCCCCACAACCA |
| SEQ ID NO: 2714 | mm14879_Rpl18 | TGGCTGACTACTAACCATGC |
| SEQ ID NO: 2715 | mm14880_Rpl18 | TTACCTTGACAAGCAGCCGC |
| SEQ ID NO: 2716 | mm14881_Rpl18 | TCGCCACAACAAGGACCGAA |
| SEQ ID NO: 2717 | mm14886_Rpl21 | ATTCGCATGTATGTGGCCAA |
| SEQ ID NO: 2718 | mm14887_Rpl21 | AAGGCCTAGAGAACATGTAC |
| SEQ ID NO: 2719 | mm14888_Rpl21 | GGGCATCATTGTCAACAAGC |
| SEQ ID NO: 2720 | mm14889_Rpl21 | ATGCCCCATAAGTGCTACCA |
| SEQ ID NO: 2721 | mm14918_Rpl32 | TGTGTCTTCAGCGAAACTGG |
| SEQ ID NO: 2722 | mm14919_Rpl32 | ACCAAGCACATGCTGCCCAG |
| SEQ ID NO: 2723 | mm14920_Rpl32 | GAGGCATTGACAACAGGGTG |
| SEQ ID NO: 2724 | mm14921_Rpl32 | CCACAATGTCAAGGAGCTGG |
| SEQ ID NO: 2725 | mm14938_Rpl9 | AGGGCTTCCGATACAAGATG |
| SEQ ID NO: 2726 | mm14939_Rpl9 | CTGTCCTCATCCGAACCCTG |
| SEQ ID NO: 2727 | mm14940_Rpl9 | ACTGCAGATGGTCCTGACGG |
| SEQ ID NO: 2728 | mm14941_Rpl9 | GGACTTCAATCACATCAACG |
| SEQ ID NO: 2729 | mm14942_Rpn2 | GCACAACCACCACTGGTACG |
| SEQ ID NO: 2730 | mm14943_Rpn2 | TGGACGGTTCGGTCCCCACG |
| SEQ ID NO: 2731 | mm14944_Rpn2 | TGTGAAGGGCGGTCCAGTG |
| SEQ ID NO: 2732 | mm14945_Rpn2 | TGCAACTGCATGGTAGATCT |
| SEQ ID NO: 2733 | mm14958_Polr1a | TGTCAAACACAATATTGACG |
| SEQ ID NO: 2734 | mm14959_Polr1a | GATTGATATGAAGTTCAAGG |
| SEQ ID NO: 2735 | mm14960_Polr1a | GAGGAGGGTCGACACAACCT |
| SEQ ID NO: 2736 | mm14961_Polr1a | GAATTGACAAGGCTCAGATG |
| SEQ ID NO: 2737 | mm15046_Rps8 | ACGGCCCGCTGCCAACACGA |
| SEQ ID NO: 2738 | mm15047_Rps8 | CACGATGCAGTTCTTCACCA |
| SEQ ID NO: 2739 | mm15048_Rps8 | TTTCATTCAGACTCCTGAGG |
| SEQ ID NO: 2740 | mm15049_Rps8 | ACAGCACGCCGTACCGACAG |
| SEQ ID NO: 2741 | mm15130_Ryk | ACTGATGTAAAACACACGCG |
| SEQ ID NO: 2742 | mm15131_Ryk | TGAGCAGAAATATTGACCTG |
| SEQ ID NO: 2743 | mm15132_Ryk | TGCACACATGAGTAATAGGA |

TABLE 1-continued mmSurf sgRNA library sequences

| SEQ ID NO | id_gRNA Target | Sequence |
|---|---|---|
| SEQ ID NO: 2744 | mm15133_Ryk | CCTCAGGTTATCCTACCTTG |
| SEQ ID NO: 2745 | mm15318_Scn5a | AGTCGAAGCTGGTGTAACCG |
| SEQ ID NO: 2746 | mm15319_Scn5a | GCAAATCCCAGACCTCGGGG |
| SEQ ID NO: 2747 | mm15320_Scn5a | CTGGTCAAGATTCTAGCTCG |
| SEQ ID NO: 2748 | mm15321_Scn5a | GCATGGTGGACACTTACGGT |
| SEQ ID NO: 2749 | mm15330_Scn9a | GCCAGTTCCAAGGGTCACGG |
| SEQ ID NO: 2750 | mm15331_Scn9a | GTGTCCGTAGAGATTTAATG |
| SEQ ID NO: 2751 | mm15332_Scn9a | TATCTCAAACCGTACCCTTG |
| SEQ ID NO: 2752 | mm15333_Scn9a | CTGAGTACACGAGTTTAGGG |
| SEQ ID NO: 2753 | mm15334_Scnn1a | CCAGACATACTCATCCGGGG |
| SEQ ID NO: 2754 | mm15335_Scnn1a | TGTAGCAGTTCCCATACATG |
| SEQ ID NO: 2755 | mm15336_Scnn1a | CTGCCAGTACATCATGCCGA |
| SEQ ID NO: 2756 | mm15337_Scnn1a | AAAGCGTCTGTTCCGTGATG |
| SEQ ID NO: 2757 | mm15338_Scnn1b | CAAGACGATGAACTTCCCGG |
| SEQ ID NO: 2758 | mm15339_Scnn1b | GACGTACCCCTTCATTAGAG |
| SEQ ID NO: 2759 | mm15340_Scnn1b | AGCTAGGATTATGCGATCAG |
| SEQ ID NO: 2760 | mm15341_Scnn1b | AGAGAAATACTGCAACAACA |
| SEQ ID NO: 2761 | mm15342_Scnn1g | TACCCTTTCATCGAAGACGT |
| SEQ ID NO: 2762 | mm15343_Scnn1g | GGCGCACTGCCAGATAATGA |
| SEQ ID NO: 2763 | mm15344_Scnn1g | GGGTGGTGTGCCTTCCCACG |
| SEQ ID NO: 2764 | mm15345_Scnn1g | ACGAAGATGGTGGAAAAATG |
| SEQ ID NO: 2765 | mm15362_Msr1 | GTATTAGTACTGCAAACACA |
| SEQ ID NO: 2766 | mm15363_Msr1 | TTTCGTCAGTCCAGGAACAT |
| SEQ ID NO: 2767 | mm15364_Msr1 | AAAAGCCGACCTTATAGACA |
| SEQ ID NO: 2768 | mm15365_Msr1 | GAAAGAAGAACAAGCGCACG |
| SEQ ID NO: 2769 | mm15442_Cx3cl1 | GGGTGGACAATGTGACACCT |
| SEQ ID NO: 2770 | mm15443_Cx3cl1 | GATGACCTCACGAATCCCAG |
| SEQ ID NO: 2771 | mm15444_Cx3cl1 | ACTGACTACTATTTCCCAGG |
| SEQ ID NO: 2772 | mm15445_Cx3cl1 | GGCCAACCCCCATGGGTCCA |
| SEQ ID NO: 2773 | mm15446_Cxcl12 | CTAGGACTTACACAATCTGA |
| SEQ ID NO: 2774 | mm15447_Cxcl12 | ACCGTCACTGATGCAGAGCG |
| SEQ ID NO: 2775 | mm15448_Cxcl12 | TGGCTCTCGAAGAACCGGCA |
| SEQ ID NO: 2776 | mm15449_Cxcl12 | GGGCACAGTTTGGAGTGTTG |
| SEQ ID NO: 2777 | mm15466_Nptn | TGACAAAATGATATACACAG |
| SEQ ID NO: 2778 | mm15467_Nptn | GTTGCTGGCATTCTTACGGG |
| SEQ ID NO: 2779 | mm15468_Nptn | GAGCTATTAGAAATCTCCTG |
| SEQ ID NO: 2780 | mm15469_Nptn | ATGATGTACTGCAAGTCAGT |
| SEQ ID NO: 2781 | mm15470_Frrs1 | GCTTTAGGTGTCGTAAGGG |

TABLE 1-continued mmSurf sgRNA library sequences

| SEQ ID NO | id_gRNA Target | Sequence |
|---|---|---|
| SEQ ID NO: 2782 | mm15471_Frrs1 | TCAGTGATGGTTGAAATGAG |
| SEQ ID NO: 2783 | mm15472_Frrs1 | CAGGACTCCAATGCTGACCG |
| SEQ ID NO: 2784 | mm15473_Frrs1 | CAGAAATCGTATGTGATCTG |
| SEQ ID NO: 2785 | mm15498_Sel1l | CAAGCCCGCTCTGTCCCACG |
| SEQ ID NO: 2786 | mm15499_Sel1l | AAAACCCGGGGATGAACAGT |
| SEQ ID NO: 2787 | mm15500_Sel1l | GCCAGCAACTACTTTGCCCG |
| SEQ ID NO: 2788 | mm15501_Sel1l | TCGGCTCTATGTACTACAGT |
| SEQ ID NO: 2789 | mm15506_Glg1 | CATTCAAAGCTCGATCAATG |
| SEQ ID NO: 2790 | mm15507_Glg1 | TCCTGCTTGGTGGATCATCG |
| SEQ ID NO: 2791 | mm15508_Glg1 | GTCTAAATGAAAGTCATCCG |
| SEQ ID NO: 2792 | mm15509_Glg1 | GTGGAATGCAGAGACATCGT |
| SEQ ID NO: 2793 | mm15518_Sell | TGACGCCTGTCACAAACGAA |
| SEQ ID NO: 2794 | mm15519_Sell | GTCCATGGTACCCAACTCAG |
| SEQ ID NO: 2795 | mm15520_Sell | ACACGTGCATCTGTGATGCA |
| SEQ ID NO: 2796 | mm15521_Sell | TTCTGAAAAGCCCATGAACT |
| SEQ ID NO: 2797 | mm15522_Selp | ATGTACCGTCACACTTCGGG |
| SEQ ID NO: 2798 | mm15523_Selp | GGGAACAAATAAGACACTCA |
| SEQ ID NO: 2799 | mm15524_Selp | TGGTACGTCAAGGTACCGAA |
| SEQ ID NO: 2800 | mm15525_Selp | TTGTAGGTGGAATTCCCAAG |
| SEQ ID NO: 2801 | mm15530_Sema3a | TAGAATAGGTCAGATATGCA |
| SEQ ID NO: 2802 | mm15531_Sema3a | GTGAACACTCCATAGACGAT |
| SEQ ID NO: 2803 | mm15532_Sema3a | GAACGGAGTAGACTATATGT |
| SEQ ID NO: 2804 | mm15533_Sema3a | ACAAATTGTTGTAGACCGAG |
| SEQ ID NO: 2805 | mm15538_Sema3c | GTGTGCACCTACCTGAACCG |
| SEQ ID NO: 2806 | mm15539_Sema3c | TATCTCTCCCATCTAGATCG |
| SEQ ID NO: 2807 | mm15540_Sema3c | ATCAAGACCGGATATATGTG |
| SEQ ID NO: 2808 | mm15541_Sema3c | ACATGTGCGTCCACAAACAT |
| SEQ ID NO: 2809 | mm15554_Sema4b | TCGGGCAACTCGGGACACGA |
| SEQ ID NO: 2810 | mm15555_Sema4b | CTACTGATACCTACCGCTCC |
| SEQ ID NO: 2811 | mm15556_Sema4b | GGGTCTTGCGCCAATCCTGA |
| SEQ ID NO: 2812 | mm15557_Sema4b | TCCCTCAACTGGCTACAAGG |
| SEQ ID NO: 2813 | mm15558_Sema4d | GATGGCATACTCCGTCCTCA |
| SEQ ID NO: 2814 | mm15559_Sema4d | GGCTGGATTCAGGACATGAG |
| SEQ ID NO: 2815 | mm15560_Sema4d | CTTGGGTCTGTTGTCTATCG |
| SEQ ID NO: 2816 | mm15561_Sema4d | ATTGGTCCCACACACATAGA |
| SEQ ID NO: 2817 | mm15570_Sema5b | GTTCGGCCTATCATAGCCAG |
| SEQ ID NO: 2818 | mm15571_Sema5b | TTATACTGGGCAGTGCGAAG |
| SEQ ID NO: 2819 | mm15572_Sema5b | CCAGAGCAAAGGGAAAACGG |

TABLE 1-continued mmSurf sgRNA library sequences

| SEQ ID NO | id_gRNA Target | Sequence |
|---|---|---|
| SEQ ID NO: 2820 | mm15573_Sema5b | CTCTATCACGTACTCTACAT |
| SEQ ID NO: 2821 | mm15586_Sema7a | CCTCGGTTTCGACGCATTCG |
| SEQ ID NO: 2822 | mm15587_Sema7a | TGGTACTTAGAATGGAACAA |
| SEQ ID NO: 2823 | mm15588_Sema7a | GGTGAACATCGGCTCCACAA |
| SEQ ID NO: 2824 | mm15589_Sema7a | ACAACGAACTCTCACCACCC |
| SEQ ID NO: 2825 | mm15606_Sez6 | GAGTCGGACTGGTAAAGACG |
| SEQ ID NO: 2826 | mm15607_Sez6 | CCGCAATGGAAATAACGTGG |
| SEQ ID NO: 2827 | mm15608_Sez6 | AGGAACGACTGGTTAGCCAA |
| SEQ ID NO: 2828 | mm15609_Sez6 | CTACCCTGTGGGTACAACTG |
| SEQ ID NO: 2829 | mm15618_Sfrp1 | GACATCGGCTCGTATCAGAG |
| SEQ ID NO: 2830 | mm15619_Sfrp1 | CAAATGTGACAAGTTCCCCG |
| SEQ ID NO: 2831 | mm15620_Sfrp1 | TTCAACTCGTTGTCGCATGG |
| SEQ ID NO: 2832 | mm15621_Sfrp1 | CTGAGGCTGTGCCACAACGT |
| SEQ ID NO: 2833 | mm15626_Sfrp4 | TTGCAATGAGGTCACAACTG |
| SEQ ID NO: 2834 | mm15627_Sfrp4 | AGGGCTTGATGGGATCGTGC |
| SEQ ID NO: 2835 | mm15628_Sfrp4 | TGTGGTTATACATCTTCATG |
| SEQ ID NO: 2836 | mm15629_Sfrp4 | GAGCTGCCGGTCTATGACCG |
| SEQ ID NO: 2837 | mm15658_Sgce | GATGGCTTCGATATATCCAA |
| SEQ ID NO: 2838 | mm15659_Sgce | AGAATGTGCCAGTGGTCGCG |
| SEQ ID NO: 2839 | mm15660_Sgce | CGACTGGTGCAAGATTTCAC |
| SEQ ID NO: 2840 | mm15661_Sgce | GCTTCCTATTAATGACATGA |
| SEQ ID NO: 2841 | mm15730_Shh | TGGCGCCGCACAACGACTCG |
| SEQ ID NO: 2842 | mm15731_Shh | AGGAAAACACGGGAGCAGAC |
| SEQ ID NO: 2843 | mm15732_Shh | GTGCTGGCGGCTGACGACCA |
| SEQ ID NO: 2844 | mm15733_Shh | AAACTGCTTGTAGGCTAAAG |
| SEQ ID NO: 2845 | mm15770_St3gal1 | ACCAGCCTCTTGTTCAACAT |
| SEQ ID NO: 2846 | mm15771_St3gal1 | GTCGATCTCAGGCCCATACG |
| SEQ ID NO: 2847 | mm15772_St3gal1 | AGGATACACGAGATGGTGGG |
| SEQ ID NO: 2848 | mm15773_St3gal1 | GCTGTGACTTGATGAACCTG |
| SEQ ID NO: 2849 | mm15774_St3gal4 | CAACACAGCGACGACACTCG |
| SEQ ID NO: 2850 | mm15775_St3gal4 | TCAAGATGGTCTCAATCCAG |
| SEQ ID NO: 2851 | mm15776_St3gal4 | TGTCATCAACAAGTACGACG |
| SEQ ID NO: 2852 | mm15777_St3gal4 | AAGGGCAGCTCATAGGTGGA |
| SEQ ID NO: 2853 | mm15798_St8sia1 | GTGTACTCACTTGACAAGGG |
| SEQ ID NO: 2854 | mm15799_St8sia1 | CCGCGTACCCGGCTACCCGT |
| SEQ ID NO: 2855 | mm15800_St8sia1 | GGAGTACGTGGAATTATCGA |
| SEQ ID NO: 2856 | mm15801_St8sia1 | ACCCCAGCATAATTCGCCAG |
| SEQ ID NO: 2857 | mm15802_St8sia2 | AGGACCTTGTGAACGCCACG |

TABLE 1-continued mmSurf sgRNA library sequences

| SEQ ID NO | id_gRNA Target | Sequence |
|---|---|---|
| SEQ ID NO: 2858 | mm15803_St8sia2 | TTTCCAGACTTGTGCCATCG |
| SEQ ID NO: 2859 | mm15804_St8sia2 | ACAACCAGACGCTCTCTCTG |
| SEQ ID NO: 2860 | mm15805_St8sia2 | AGGATATTTCTGTCCTTAAG |
| SEQ ID NO: 2861 | mm15806_St8sia3 | GCGTGGAACATGTACATTCG |
| SEQ ID NO: 2862 | mm15807_St8sia3 | TGCTCGGATTGAAGGTTGTG |
| SEQ ID NO: 2863 | mm15808_St8sia3 | TCATAATGGGCGACACATCT |
| SEQ ID NO: 2864 | mm15809_St8sia3 | GAAACAGTGGAATCTTGACA |
| SEQ ID NO: 2865 | mm15814_St3gal5 | GTTCGGGCAGCATATCCAAG |
| SEQ ID NO: 2866 | mm15815_St3gal5 | TAGTATTCAACGTCCGACAG |
| SEQ ID NO: 2867 | mm15816_St3gal5 | CGCCCTCAACCAGTTCGATG |
| SEQ ID NO: 2868 | mm15817_St3gal5 | AGCTGAGAAGTGATTGCTCA |
| SEQ ID NO: 2869 | mm15910_Slc12a1 | CATCATCGGTTCCATCACCG |
| SEQ ID NO: 2870 | mm15911_Slc12a1 | ACAAACGGAGTGGTGCGAGG |
| SEQ ID NO: 2871 | mm15912_Slc12a1 | GTGGGTTATATCCAAGAGAG |
| SEQ ID NO: 2872 | mm15913_Slc12a1 | CCATGGCTATCACAAAAGTG |
| SEQ ID NO: 2873 | mm15914_Slc12a2 | CGGTTTCCGAGAACGCGGG |
| SEQ ID NO: 2874 | mm15915_Slc12a2 | AAACGTCCCTATGACGAAGT |
| SEQ ID NO: 2875 | mm15916_Slc12a2 | GTTAAGATGTAACCACGAAG |
| SEQ ID NO: 2876 | mm15917_Slc12a2 | TCCGACAACATACATAGCAA |
| SEQ ID NO: 2877 | mm15922_Slc12a4 | AGCAAACGGTGAACCGACGT |
| SEQ ID NO: 2878 | mm15923_Slc12a4 | GGTGGCGCTTGACATGTCAT |
| SEQ ID NO: 2879 | mm15924_Slc12a4 | GTTACTCACGGAAACACGGG |
| SEQ ID NO: 2880 | mm15925_Slc12a4 | CCCAGAAGTCTATCCCAGTG |
| SEQ ID NO: 2881 | mm15926_Slc12a7 | AATGAAAGATGTAGTCACGA |
| SEQ ID NO: 2882 | mm15927_Slc12a7 | AACAACGTTACTGAGATACA |
| SEQ ID NO: 2883 | mm15928_Slc12a7 | TGGTCATGGAAAGGCCAACG |
| SEQ ID NO: 2884 | mm15929_Slc12a7 | AGCAGATGAACATCAGCGCG |
| SEQ ID NO: 2885 | mm15950_Slc34a1 | AGTTGAGCATCTTCACAAGG |
| SEQ ID NO: 2886 | mm15951_Slc34a1 | TGACCCACTACCTACCAAGC |
| SEQ ID NO: 2887 | mm15952_Slc34a1 | GTGTCACCCAGACACAACAG |
| SEQ ID NO: 2888 | mm15953_Slc34a1 | TGCCATCCTATCCAACCCAG |
| SEQ ID NO: 2889 | mm15962_Slc1a1 | CGACTCACCTAGTACCACGG |
| SEQ ID NO: 2890 | mm15963_Slc1a1 | TAGGATTACAGCAATGACGG |
| SEQ ID NO: 2891 | mm15964_Slc1a1 | ATCATGCTGGATACGATCAG |
| SEQ ID NO: 2892 | mm15965_Slc1a1 | TCACCTGATCAGGTCCAACA |
| SEQ ID NO: 2893 | mm15966_Slc1a2 | CATGTTGATAGCCTTCCCGG |
| SEQ ID NO: 2894 | mm15967_Slc1a2 | CCATAGCTCTCGTGCCTAGG |
| SEQ ID NO: 2895 | mm15968_Slc1a2 | TAATTGCCCATAGGTCTGAT |

TABLE 1-continued mmSurf sgRNA library sequences

| SEQ ID NO | id_gRNA Target | Sequence |
|---|---|---|
| SEQ ID NO: 2896 | mm15969_Slc1a2 | GTTCATGGTTTCATTCAACA |
| SEQ ID NO: 2897 | mm15970_Slc1a3 | GTATAAAATGAGCTACCGGG |
| SEQ ID NO: 2898 | mm15971_Slc1a3 | GACTCTGACCCGGATCCGGG |
| SEQ ID NO: 2899 | mm15972_Slc1a3 | GAGGCCGACAATGACTGTCA |
| SEQ ID NO: 2900 | mm15973_Slc1a3 | AGGCTTCTACCAGATTGGGA |
| SEQ ID NO: 2901 | mm15978_Slc1a5 | AATCCCTATCGATTCCTGTG |
| SEQ ID NO: 2902 | mm15979_Slc1a5 | TACAACAGAGTCGTTGATGG |
| SEQ ID NO: 2903 | mm15980_Slc1a5 | GCGGGAGATCAATTCAACCA |
| SEQ ID NO: 2904 | mm15981_Slc1a5 | GTGGTGTGCAGCCTGATCGG |
| SEQ ID NO: 2905 | mm15986_Slc20a2 | ATACTGTACACAAAGACTCG |
| SEQ ID NO: 2906 | mm15987_Slc20a2 | GCCTTACCATAGGAAGCCCG |
| SEQ ID NO: 2907 | mm15988_Slc20a2 | AAGTGGCGATATAAACCAGG |
| SEQ ID NO: 2908 | mm15989_Slc20a2 | ATGGTAGCAGCATAAAACAG |
| SEQ ID NO: 2909 | mm16002_Slc22a5 | TTTATGATCTGATCCGAACA |
| SEQ ID NO: 2910 | mm16003_Slc22a5 | GGGTCAGATCTCCAACTACG |
| SEQ ID NO: 2911 | mm16004_Slc22a5 | CACAAGGCAACGGTGCTCCG |
| SEQ ID NO: 2912 | mm16005_Slc22a5 | CACACCCACGAAAAACAAGG |
| SEQ ID NO: 2913 | mm16022_Slc2a1 | CCTGCTCATCAATCGTAACG |
| SEQ ID NO: 2914 | mm16023_Slc2a1 | TCAGCATGGAGTTCCGCCTG |
| SEQ ID NO: 2915 | mm16024_Slc2a1 | GTGTCACCTACAGCTCTACG |
| SEQ ID NO: 2916 | mm16025_Slc2a1 | CAAACATGGAACCACCGCTA |
| SEQ ID NO: 2917 | mm16030_Slc2a3 | TTAGAAGACCTACCAAGTGA |
| SEQ ID NO: 2918 | mm16031_Slc2a3 | GACCACGCCTGCTCCAATCG |
| SEQ ID NO: 2919 | mm16032_Slc2a3 | CTGGAATGATGGTTAAGCCA |
| SEQ ID NO: 2920 | mm16033_Slc2a3 | TGTGCCTATGTACATTGGAG |
| SEQ ID NO: 2921 | mm16034_Slc2a4 | GCAGCCTCTGATCATCGCAG |
| SEQ ID NO: 2922 | mm16035_Slc2a4 | AACAGAGCTACAATGCAACG |
| SEQ ID NO: 2923 | mm16036_Slc2a4 | AACCAGAATGCCAATGACGA |
| SEQ ID NO: 2924 | mm16037_Slc2a4 | CCAGGTCTAAAGCGCCTGAC |
| SEQ ID NO: 2925 | mm16046_Slc34a2 | TCATAGAGGAGCATCCCGAG |
| SEQ ID NO: 2926 | mm16047_Slc34a2 | CTCCATCACCAACACGATCG |
| SEQ ID NO: 2927 | mm16048_Slc34a2 | AGAGGTGCAGTTATCAGTCG |
| SEQ ID NO: 2928 | mm16049_Slc34a2 | CTCACCGATGAGTGGAGTCA |
| SEQ ID NO: 2929 | mm16054_Slc4a1 | CTCCATGGCGCATAACCGAG |
| SEQ ID NO: 2930 | mm16055_Slc4a1 | AATAACCTGGAGTATATCGT |
| SEQ ID NO: 2931 | mm16056_Slc4a1 | TCTACAACAGACTTGAACGG |
| SEQ ID NO: 2932 | mm16057_Slc4a1 | CTTACCCACTAGCACCAGTG |
| SEQ ID NO: 2933 | mm16062_Slc4a2 | GGAAGTCACTTAGGTAGTGG |

TABLE 1-continued mmSurf sgRNA library sequences

| SEQ ID NO | id_gRNA Target | Sequence |
|---|---|---|
| SEQ ID NO: 2934 | mm16063_Slc4a2 | GGGTACGGCGACACTTGGTG |
| SEQ ID NO: 2935 | mm16064_Slc4a2 | TAGCGGATGATGGATATGGT |
| SEQ ID NO: 2936 | mm16065_Slc4a2 | GAGCCCGCTGAGATGTTTCG |
| SEQ ID NO: 2937 | mm16074_Slc6a2 | CTTCACCACTAGTAGATCGG |
| SEQ ID NO: 2938 | mm16075_Slc6a2 | AGCAGTGGGATCCATGACAT |
| SEQ ID NO: 2939 | mm16076_Slc6a2 | AGCCGACATAGAGGGCAATG |
| SEQ ID NO: 2940 | mm16077_Slc6a2 | ATAAGGGAACCGCCACACGT |
| SEQ ID NO: 2941 | mm16086_Slc8a1 | CTGATTATGAATTCACGGAA |
| SEQ ID NO: 2942 | mm16087_Slc8a1 | AATCGCACTCTGTGTTTACG |
| SEQ ID NO: 2943 | mm16088_Slc8a1 | ACTCACGTGAGCGAGAGCAT |
| SEQ ID NO: 2944 | mm16089_Slc8a1 | CTGCAATAATAGAAACTCCA |
| SEQ ID NO: 2945 | mm16090_Slc9a1 | ACGGCCAACAGGTCGACCAG |
| SEQ ID NO: 2946 | mm16091_Slc9a1 | GGGGCGCATCACTACTCCTG |
| SEQ ID NO: 2947 | mm16092_Slc9a1 | CGCCCACAAACACCCCACCG |
| SEQ ID NO: 2948 | mm16093_Slc9a1 | GAAGGTCCAGTTCCACTGGT |
| SEQ ID NO: 2949 | mm16110_Slit1 | CAACCCCATCGAGACAACTG |
| SEQ ID NO: 2950 | mm16111_Slit1 | GTCGGCCCTTCAAAGCCGGA |
| SEQ ID NO: 2951 | mm16112_Slit1 | TGATACCGTTCAACTCCAGG |
| SEQ ID NO: 2952 | mm16113_Slit1 | TCCGCAAGCCATCTAGACCC |
| SEQ ID NO: 2953 | mm16114_Slit2 | TACATCGATAAAAATCAACG |
| SEQ ID NO: 2954 | mm16115_Slit2 | GTGAGAAATTACCTGAACAA |
| SEQ ID NO: 2955 | mm16116_Slit2 | TAAGATCACGGATATCGAGG |
| SEQ ID NO: 2956 | mm16117_Slit2 | GGATGGGAACCAGTTTACGC |
| SEQ ID NO: 2957 | mm16118_Slit3 | CAACCCTATTGAGACAAGCG |
| SEQ ID NO: 2958 | mm16119_Slit3 | GGAGATTCCCATCCAAGACG |
| SEQ ID NO: 2959 | mm16120_Slit3 | ACAGCGTCTTGAGGCTACTG |
| SEQ ID NO: 2960 | mm16121_Slit3 | CAGATTGGCTGCGACAACGG |
| SEQ ID NO: 2961 | mm16218_Siglec1 | ACTGAGTGTAACATGACGTG |
| SEQ ID NO: 2962 | mm16219_Siglec1 | GCGCTCCAGTCCATTGAGTG |
| SEQ ID NO: 2963 | mm16220_Siglec1 | TGCTATCACTGATCTCAAAG |
| SEQ ID NO: 2964 | mm16221_Siglec1 | CTCATACTACTGTAGGACGC |
| SEQ ID NO: 2965 | mm16322_Sorl1 | TCACGTCCTCTGACACAAGG |
| SEQ ID NO: 2966 | mm16323_Sorl1 | ACTGCTAGAGATGTACACAT |
| SEQ ID NO: 2967 | mm16324_Sorl1 | CTTCTCCATCCCATTCCGGG |
| SEQ ID NO: 2968 | mm16325_Sorl1 | GCACCCGGGAGGACTACGAA |
| SEQ ID NO: 2969 | mm16326_Sort1 | TTGTTATATAGACCCCACGG |
| SEQ ID NO: 2970 | mm16327_Sort1 | GCTGACCAACAATACGCACC |
| SEQ ID NO: 2971 | mm16328_Sort1 | TACCGCAAAGAACAAGAACG |

TABLE 1-continued mmSurf sgRNA library sequences

| SEQ ID NO | id_gRNA Target | Sequence |
|---|---|---|
| SEQ ID NO: 2972 | mm16329_Sort1 | TGGGCAGGTGATACTAACAG |
| SEQ ID NO: 2973 | mm16414_Spa17 | ACCCACTACCGAATTCCACA |
| SEQ ID NO: 2974 | mm16415_Spa17 | AAGACTATACCTTGAATGCG |
| SEQ ID NO: 2975 | mm16416_Spa17 | AAGGTTCTCAAAATACGCTG |
| SEQ ID NO: 2976 | mm16417_Spa17 | CTTTGATCCAGCAGAATGGG |
| SEQ ID NO: 2977 | mm16430_Spam1 | GTCCCAACTGAACGTTGTGT |
| SEQ ID NO: 2978 | mm16431_Spam1 | AACTCGGTAGCGGACATAGA |
| SEQ ID NO: 2979 | mm16432_Spam1 | GCTTGATAATCGCCCCTCTG |
| SEQ ID NO: 2980 | mm16433_Spam1 | TACCTCTGAATACCTTCTAG |
| SEQ ID NO: 2981 | mm16434_Sparc | AGAATTTGAGGACGGTGCAG |
| SEQ ID NO: 2982 | mm16435_Sparc | AGCCAGTCACGCATGCGCAG |
| SEQ ID NO: 2983 | mm16436_Sparc | ATGGTCCGATGTAGTCCAGG |
| SEQ ID NO: 2984 | mm16437_Sparc | ACCTTGTACGAGAGAGATGA |
| SEQ ID NO: 2985 | mm16502_Serpine2 | GTTGTACCATAAGCCATTCG |
| SEQ ID NO: 2986 | mm16503_Serpine2 | TGAAATACACTGCATTAACG |
| SEQ ID NO: 2987 | mm16504_Serpine2 | TACATTATATCGCATCACCG |
| SEQ ID NO: 2988 | mm16505_Serpine2 | GAGACAACAACGTTCTCATG |
| SEQ ID NO: 2989 | mm16546_Spn | ACAAGCTCTAACGAGACCAG |
| SEQ ID NO: 2990 | mm16547_Spn | GCAGCCAATCCTGTGACAGA |
| SEQ ID NO: 2991 | mm16548_Spn | GGGATCTTGGGTAGACGTCG |
| SEQ ID NO: 2992 | mm16549_Spn | CGAGCCCAGACAGTCTGCAG |
| SEQ ID NO: 2993 | mm16558_Sptb | AGAGGGCCTAGATACTGACT |
| SEQ ID NO: 2994 | mm16559_Sptb | CAGAACAACTCTCAGCCGCG |
| SEQ ID NO: 2995 | mm16560_Sptb | GAAGGTTGTGGAGTCAACCA |
| SEQ ID NO: 2996 | mm16561_Sptb | TCAACGAGTTGGCAAACTTG |
| SEQ ID NO: 2997 | mm16654_Scarb1 | GGGGCCGTGAAGCGATACGT |
| SEQ ID NO: 2998 | mm16655_Scarb1 | TGCGGTTCATAAAAGCACGC |
| SEQ ID NO: 2999 | mm16656_Scarb1 | GATGAACAACTCGAATTCTG |
| SEQ ID NO: 3000 | mm16657_Scarb1 | GAGGATTCGGGTGTCATGAA |
| SEQ ID NO: 3001 | mm16754_Stat4 | AATGTCTAAACTCCACTGAG |
| SEQ ID NO: 3002 | mm16755_Stat4 | GCATGCCAACGCACCCTCAG |
| SEQ ID NO: 3003 | mm16756_Stat4 | AAATCCAATGCATGTAGCTG |
| SEQ ID NO: 3004 | mm16757_Stat4 | TGGCCTCACCATTAACCTAG |
| SEQ ID NO: 3005 | mm16802_Stim1 | TGAGGATAAGCTTATCAGCG |
| SEQ ID NO: 3006 | mm16803_Stim1 | GAATACAGGAGCTAGCTCCG |
| SEQ ID NO: 3007 | mm16804_Stim1 | GAGCCGTCAAAAATATGCTG |
| SEQ ID NO: 3008 | mm16805_Stim1 | CAGCAGATCGAGATCCTCTG |
| SEQ ID NO: 3009 | mm16842_Wnt8a | GGGAGGCTGCAGCGACAACG |

TABLE 1-continued mmSurf sgRNA library sequences

| SEQ ID NO | id_gRNA Target | Sequence |
|---|---|---|
| SEQ ID NO: 3010 | mm16843_Wnt8a | CCGCGCGCTGAAAATTGAGA |
| SEQ ID NO: 3011 | mm16844_Wnt8a | TCTGACCTACACCGCCAGTG |
| SEQ ID NO: 3012 | mm16845_Wnt8a | AAAAGGACCTGCAAGTGTCA |
| SEQ ID NO: 3013 | mm16874_Stx4a | TGCTGGAATGGTGTCTGACG |
| SEQ ID NO: 3014 | mm16875_Stx4a | TCTCGTTTAGGCATGAAGCA |
| SEQ ID NO: 3015 | mm16876_Stx4a | ATTACAACTCAGTCAACACA |
| SEQ ID NO: 3016 | mm16877_Stx4a | CGAATACCGAGAGAAGAATG |
| SEQ ID NO: 3017 | mm16982_Sdc1 | GTCACATCTCATCCGCACGG |
| SEQ ID NO: 3018 | mm16983_Sdc1 | AGGAAAAGGAGGTCACCACC |
| SEQ ID NO: 3019 | mm16984_Sdc1 | CACACGTCCTTCCAAGTGGA |
| SEQ ID NO: 3020 | mm16985_Sdc1 | TGTCATCAAAGAGGTTGTCG |
| SEQ ID NO: 3021 | mm16986_Sdc3 | CACAACCGTTATCCAGCCCG |
| SEQ ID NO: 3022 | mm16987_Sdc3 | AGGAAGGGCTCGTGGCCTCG |
| SEQ ID NO: 3023 | mm16988_Sdc3 | AACTAGACGACCTCTACTCG |
| SEQ ID NO: 3024 | mm16989_Sdc3 | GGCGCAATGAGAACTTCGAG |
| SEQ ID NO: 3025 | mm16990_Sdc4 | GGACATGTCATCCCCCACGT |
| SEQ ID NO: 3026 | mm16991_Sdc4 | TTCTTAGATTCGAGAGACAG |
| SEQ ID NO: 3027 | mm16992_Sdc4 | TCAGGGATGTGGTTATCCAG |
| SEQ ID NO: 3028 | mm16993_Sdc4 | CAGCATCTTCGTCGTCGGGG |
| SEQ ID NO: 3029 | mm17010_Syp | GCACCCTCCTGCGTTAAAGG |
| SEQ ID NO: 3030 | mm17011_Syp | GTAGCTGCCGCACGTAGCAA |
| SEQ ID NO: 3031 | mm17012_Syp | CAAATTCGACTTCGATGTTG |
| SEQ ID NO: 3032 | mm17013_Syp | AAGTACCGAGAGAACAACAA |
| SEQ ID NO: 3033 | mm17046_Tacr1 | CATGGCTGCATTCAATACAG |
| SEQ ID NO: 3034 | mm17047_Tacr1 | GGTGGTCAAAATGATGATCG |
| SEQ ID NO: 3035 | mm17048_Tacr1 | GATTGGCTATGCATACACTG |
| SEQ ID NO: 3036 | mm17049_Tacr1 | CACCACGATGACCGTATAGG |
| SEQ ID NO: 3037 | mm17110_Slc6a6 | GGCCCCAGGCAGATTGCGT |
| SEQ ID NO: 3038 | mm17111_Slc6a6 | GGCCAGTACACATCAGAAGG |
| SEQ ID NO: 3039 | mm17112_Slc6a6 | AAACAGAATAGACCAAAAGG |
| SEQ ID NO: 3040 | mm17113_Slc6a6 | CATGGCAAACGGGAAAGTAG |
| SEQ ID NO: 3041 | mm17114_Cntn2 | GACCCCGTGAAAACCCACGA |
| SEQ ID NO: 3042 | mm17115_Cntn2 | CTCACCACCACACCCCCAGG |
| SEQ ID NO: 3043 | mm17116_Cntn2 | TGTGAATATCGAGGGCAACG |
| SEQ ID NO: 3044 | mm17117_Cntn2 | AAGGGCCGTGACACCGTCCA |
| SEQ ID NO: 3045 | mm17170_Tbxa2r | GACGTGCCATCGCGTCGCCA |
| SEQ ID NO: 3046 | mm17171_Tbxa2r | CTGACACTCGGGACACAGCG |
| SEQ ID NO: 3047 | mm17172_Tbxa2r | AGTGGCTCGCCAGTCCAACA |

TABLE 1-continued mmSurf sgRNA library sequences

| SEQ ID NO | id_gRNA Target | Sequence |
|---|---|---|
| SEQ ID NO: 3048 | mm17173_Tbxa2r | AGCGCTTCGTGGGCATCACA |
| SEQ ID NO: 3049 | mm17342_Tdgf1 | GGGTCCAAATTCAAACGCAC |
| SEQ ID NO: 3050 | mm17343_Tdgf1 | CAGTTGCGTCCATAGAAGGA |
| SEQ ID NO: 3051 | mm17344_Tdgf1 | CTGTTCTGTATCCCCACGGA |
| SEQ ID NO: 3052 | mm17345_Tdgf1 | AAGAACCTGCCGTACGCGAT |
| SEQ ID NO: 3053 | mm17394_Tek | TTAACTATGACCGTGGACAG |
| SEQ ID NO: 3054 | mm17395_Tek | AGTACAAGGACGGCTACAGT |
| SEQ ID NO: 3055 | mm17396_Tek | CTATACAGATCGTTTCTCAG |
| SEQ ID NO: 3056 | mm17397_Tek | CTGGTCCGTAGTAACCAGAT |
| SEQ ID NO: 3057 | mm17502_Tfpi | TGTGAACGATTCGTGTACGG |
| SEQ ID NO: 3058 | mm17503_Tfpi | TGTGAAGAATTTATATACGG |
| SEQ ID NO: 3059 | mm17504_Tfpi | ACCTTGTAGATTCTGAGCTG |
| SEQ ID NO: 3060 | mm17505_Tfpi | GATACCTCTTCATGTAACCT |
| SEQ ID NO: 3061 | mm17510_Tgfa | AACAGCACATCCCCCCTGAG |
| SEQ ID NO: 3062 | mm17511_Tgfa | GGGAATACTTACACACATGC |
| SEQ ID NO: 3063 | mm17512_Tgfa | ATGGAAGCAGTACTGAGTGT |
| SEQ ID NO: 3064 | mm17513_Tgfa | TTCCTGCACCAAAAACCGGC |
| SEQ ID NO: 3065 | mm17514_Tgfb1 | CCACTCAGGCGTATCAGTGG |
| SEQ ID NO: 3066 | mm17515_Tgfb1 | GGGATCAGCCCCAAACGTCG |
| SEQ ID NO: 3067 | mm17516_Tgfb1 | GCGGTCCACCATTAGCACGC |
| SEQ ID NO: 3068 | mm17517_Tgfb1 | TCTGCACGGGACAGCAATGG |
| SEQ ID NO: 3069 | mm17526_Tgfb2 | GTAATTATTAGACGGCACGA |
| SEQ ID NO: 3070 | mm17527_Tgfb2 | GCTCCGGATAGTCTTCCGGG |
| SEQ ID NO: 3071 | mm17528_Tgfb2 | CCAGCGCTACATCGATAGCA |
| SEQ ID NO: 3072 | mm17529_Tgfb2 | GCATAAACTGATCCATGTCG |
| SEQ ID NO: 3073 | mm17530_Tgfb3 | AAAGTGCCAGGACCTGATAG |
| SEQ ID NO: 3074 | mm17531_Tgfb3 | GGCATAGTACTCAGACTCCG |
| SEQ ID NO: 3075 | mm17532_Tgfb3 | GCCAAGCAGCGCTACATAGG |
| SEQ ID NO: 3076 | mm17533_Tgfb3 | AAGAGGGTGGAAGCCATTAG |
| SEQ ID NO: 3077 | mm17538_Tgfbr1 | AGAGCGTTCATGGTTCCGAG |
| SEQ ID NO: 3078 | mm17539_Tgfbr1 | ATGAAAGGGCGATCTAGTGA |
| SEQ ID NO: 3079 | mm17540_Tgfbr1 | ATTGTGTTACAAGAAAGCAT |
| SEQ ID NO: 3080 | mm17541_Tgfbr1 | GTGTCAGATTATCATGAGCA |
| SEQ ID NO: 3081 | mm17542_Tgfbr2 | CCTACGAGGAGTACTCCTCG |
| SEQ ID NO: 3082 | mm17543_Tgfbr2 | ACCTGCAGGAGTACCTCACG |
| SEQ ID NO: 3083 | mm17544_Tgfbr2 | GAAGCCGCATGAAGTCTGCG |
| SEQ ID NO: 3084 | mm17545_Tgfbr2 | CCTTGTAGACCTCGGCGAAG |
| SEQ ID NO: 3085 | mm17546_Tgfbr3 | GCTGTGGTACTAGACATAGG |

TABLE 1-continued mmSurf sgRNA library sequences

| SEQ ID NO | id_gRNA Target | Sequence |
|---|---|---|
| SEQ ID NO: 3086 | mm17547_Tgfbr3 | CATCTTCGGCTTGAGAACAA |
| SEQ ID NO: 3087 | mm17548_Tgfbr3 | ATTGTCACATTTGACTGACA |
| SEQ ID NO: 3088 | mm17549_Tgfbr3 | AACCTCCGCAGTACAGACCA |
| SEQ ID NO: 3089 | mm17582_Thbd | TACCTACAACACCCCGTTCG |
| SEQ ID NO: 3090 | mm17583_Thbd | GTGTGAGACAGGCTACCAGT |
| SEQ ID NO: 3091 | mm17584_Thbd | CTGTGAAGTAAAACTCACAG |
| SEQ ID NO: 3092 | mm17585_Thbd | TCGCAGTTAGATCCGAAACA |
| SEQ ID NO: 3093 | mm17586_Thbs1 | CCAGTGCAAAGACGTCGATG |
| SEQ ID NO: 3094 | mm17587_Thbs1 | GTCACAGAACAGGACGACCA |
| SEQ ID NO: 3095 | mm17588_Thbs1 | GAACTTGTCATCCGGCACAG |
| SEQ ID NO: 3096 | mm17589_Thbs1 | CTGTGATAAGATGGAGAGCG |
| SEQ ID NO: 3097 | mm17622_Thy1 | CCTTGGTGTTATTCTCATGG |
| SEQ ID NO: 3098 | mm17623_Thy1 | TAAGGACCTTGATATAGGGC |
| SEQ ID NO: 3099 | mm17624_Thy1 | CAGTCTTGCAGGTGTCCCGA |
| SEQ ID NO: 3100 | mm17625_Thy1 | CGTGTGCTCGGGTATCCCAA |
| SEQ ID NO: 3101 | mm17650_Trim28 | ATGAAGGAGCTGAATAAGCG |
| SEQ ID NO: 3102 | mm17651_Trim28 | CGCCGCAGCGAATAATTCGG |
| SEQ ID NO: 3103 | mm17652_Trim28 | GCACTCCACACAATAGCTAG |
| SEQ ID NO: 3104 | mm17653_Trim28 | AGGCGTTCAAGGCTCACACG |
| SEQ ID NO: 3105 | mm17670_Timp1 | GTAGGCGTACCGGATATCTG |
| SEQ ID NO: 3106 | mm17671_Timp1 | GCAGGGCTCAGAGTACGCCA |
| SEQ ID NO: 3107 | mm17672_Timp1 | CTTATAACGCTGGTATAAGG |
| SEQ ID NO: 3108 | mm17673_Timp1 | TGATGAGAAACTCTTCACTG |
| SEQ ID NO: 3109 | mm17674_Timp2 | AGACATCGAGTTTATCTACA |
| SEQ ID NO: 3110 | mm17675_Timp2 | CATACTGAATCCTCTTGATG |
| SEQ ID NO: 3111 | mm17676_Timp2 | GTGATGCTAAGCGTGTCCCA |
| SEQ ID NO: 3112 | mm17677_Timp2 | GCATTGCAAAACGCCTGTTG |
| SEQ ID NO: 3113 | mm17686_Tjp1 | TTCTGTTCGCTAAAGCACCG |
| SEQ ID NO: 3114 | mm17687_Tjp1 | AGAGCGAATGTCTAAACCTG |
| SEQ ID NO: 3115 | mm17688_Tjp1 | GTTCTACTGTCGTACGACAG |
| SEQ ID NO: 3116 | mm17689_Tjp1 | ATTAGATGTAACGCCAAATG |
| SEQ ID NO: 3117 | mm17690_Tjp2 | GCTTATGAACCCGACTACGG |
| SEQ ID NO: 3118 | mm17691_Tjp2 | TATGGGCCAAACAGAACCA |
| SEQ ID NO: 3119 | mm17692_Tjp2 | CCTCGGTCGTCATGACTGAG |
| SEQ ID NO: 3120 | mm17693_Tjp2 | CCACGCCGTTCAAGTCCACG |
| SEQ ID NO: 3121 | mm17730_Tlr1 | TAACGTGCCGAAGAGATTCG |
| SEQ ID NO: 3122 | mm17731_Tlr1 | TACTGTATATGTAACTTTGG |
| SEQ ID NO: 3123 | mm17732_Tlr1 | TGAACAATGTGGAAACAACG |

TABLE 1-continued mmSurf sgRNA library sequences

| SEQ ID NO | id_gRNA Target | Sequence |
|---|---|---|
| SEQ ID NO: 3124 | mm17733_Tlr1 | GCTTGAGGCTGACTGTTGGG |
| SEQ ID NO: 3125 | mm17734_Tlr4 | ATTCTCCCAAGATCAACCGA |
| SEQ ID NO: 3126 | mm17735_Tlr4 | TCTGACGAACCTAGTACATG |
| SEQ ID NO: 3127 | mm17736_Tlr4 | CAGAAACATTCGCCAAGCAA |
| SEQ ID NO: 3128 | mm17737_Tlr4 | TCAGTATCAAGTTTGAGAGG |
| SEQ ID NO: 3129 | mm17738_Tlr6 | GAGTTATCATATAAAAGGCG |
| SEQ ID NO: 3130 | mm17739_Tlr6 | GATAACTGAGAGAATCGACA |
| SEQ ID NO: 3131 | mm17740_Tlr6 | TTGCCAAATTCCTTACACAC |
| SEQ ID NO: 3132 | mm17741_Tlr6 | AACATCCAAAGTTTCCAGAG |
| SEQ ID NO: 3133 | mm17758_Tspan7 | TCAGCATCCATGGACTACCA |
| SEQ ID NO: 3134 | mm17759_Tspan7 | TGGAACCGGCACCACCATCG |
| SEQ ID NO: 3135 | mm17760_Tspan7 | ATCCGTGTAAGTCCTCAGGA |
| SEQ ID NO: 3136 | mm17761_Tspan7 | TCTCCTTTCGCAGATCACTG |
| SEQ ID NO: 3137 | mm17770_Tmpo | GCCCGACTTCTCGAGCGACG |
| SEQ ID NO: 3138 | mm17771_Tmpo | ATAGTGGAAAATATTTGCCG |
| SEQ ID NO: 3139 | mm17772_Tmpo | AATAAATAAACTCCGTCCAG |
| SEQ ID NO: 3140 | mm17773_Tmpo | CAAGAAAGTGAAGTCCGCTA |
| SEQ ID NO: 3141 | mm17786_Tnf | AAGAAATCTTACCTACGACG |
| SEQ ID NO: 3142 | mm17787_Tnf | GTAGACAAGGTACAACCCAT |
| SEQ ID NO: 3143 | mm17788_Tnf | TGGGCCATAGAACTGATGAG |
| SEQ ID NO: 3144 | mm17789_Tnf | CAGTAGACAGAAGAGCGTGG |
| SEQ ID NO: 3145 | mm17806_Tnfrsf10b | TAGAATGTACCTGCTAGACA |
| SEQ ID NO: 3146 | mm17807_Tnfrsf10b | AAATGACTCTAACCACAACA |
| SEQ ID NO: 3147 | mm17808_Tnfrsf10b | ACGGTGTGTCGATGCAAACC |
| SEQ ID NO: 3148 | mm17809_Tnfrsf10b | TGGTTGCTCTGTATAAAAAG |
| SEQ ID NO: 3149 | mm17810_Tnfrsf11a | ACCAGCACAACGGTCCCCTG |
| SEQ ID NO: 3150 | mm17811_Tnfrsf11a | ACACTGAGGAGACCACCCAA |
| SEQ ID NO: 3151 | mm17812_Tnfrsf11a | GTTTAAGCCAGTGTTTCACC |
| SEQ ID NO: 3152 | mm17813_Tnfrsf11a | AGACGCAAGGAGACCTCTCG |
| SEQ ID NO: 3153 | mm17818_Tnfrsf18 | GCCAAACACAATATCCCCTG |
| SEQ ID NO: 3154 | mm17819_Tnfrsf18 | GTCACACCTGAGTACCACTG |
| SEQ ID NO: 3155 | mm17820_Tnfrsf18 | GCAGTGACCGTCACGACCTG |
| SEQ ID NO: 3156 | mm17821_Tnfrsf18 | TTATTCTTGTCCAGGCAAGG |
| SEQ ID NO: 3157 | mm17822_Tnfrsf1a | AGTTGCAAGACATGTCGGAA |
| SEQ ID NO: 3158 | mm17823_Tnfrsf1a | AGACCTAGCAAGATAACCAG |
| SEQ ID NO: 3159 | mm17824_Tnfrsf1a | GATGGGGATACATCCATCAG |
| SEQ ID NO: 3160 | mm17825_Tnfrsf1a | GGATCCCGTGCCTGTCAAAG |
| SEQ ID NO: 3161 | mm17830_Cd40 | ATTCGCCTGAGTCACATGGG |

TABLE 1-continued mmSurf sgRNA library sequences

| SEQ ID NO | id_gRNA Target | Sequence |
|---|---|---|
| SEQ ID NO: 3162 | mm17831_Cd40 | GGGATGACAGACGGTATCAG |
| SEQ ID NO: 3163 | mm17832_Cd40 | AGTCAGACTAATGTCATCTG |
| SEQ ID NO: 3164 | mm17833_Cd40 | CTGCACCAGCAAGGATTGCG |
| SEQ ID NO: 3165 | mm17834_Cd27 | TCTCTCCAGACTACCACACC |
| SEQ ID NO: 3166 | mm17835_Cd27 | TGCTGCATACCTGTGCCATG |
| SEQ ID NO: 3167 | mm17836_Cd27 | AGACAAACACTACTGGACTG |
| SEQ ID NO: 3168 | mm17837_Cd27 | CTCAGGTACATTCTTTGTGA |
| SEQ ID NO: 3169 | mm17838_Tnfrsf8 | AGACCTCAGCCACTACCCAG |
| SEQ ID NO: 3170 | mm17839_Tnfrsf8 | GCAATTGGGACCAGATCCCG |
| SEQ ID NO: 3171 | mm17840_Tnfrsf8 | ATCTACCACAAGGCTTAGGG |
| SEQ ID NO: 3172 | mm17841_Tnfrsf8 | TACAGGCCTTCCAGTAACAC |
| SEQ ID NO: 3173 | mm17842_Tnfrsf9 | GTGCATACGTACTTCGTCCA |
| SEQ ID NO: 3174 | mm17843_Tnfrsf9 | TGTGCTTAAGACCGGGACCA |
| SEQ ID NO: 3175 | mm17844_Tnfrsf9 | CCAAGTACCTTCTCCAGCAT |
| SEQ ID NO: 3176 | mm17845_Tnfrsf9 | ACCAGGCTGACAGTTATCAC |
| SEQ ID NO: 3177 | mm17846_Tnfsf11 | GCCTCGATCGTGGTACCAAG |
| SEQ ID NO: 3178 | mm17847_Tnfsf11 | GACCCTCGTGTGGGACGCCG |
| SEQ ID NO: 3179 | mm17848_Tnfsf11 | GTTAAGCAACGGAAAACTAA |
| SEQ ID NO: 3180 | mm17849_Tnfsf11 | AGATTTGCAGGACTCGACTC |
| SEQ ID NO: 3181 | mm17862_Cd40lg | TATTTCAAAACAGGTCGAAG |
| SEQ ID NO: 3182 | mm17863_Cd40lg | AAGCTAAAGAGATGCAACAA |
| SEQ ID NO: 3183 | mm17864_Cd40lg | TTATACCATGAAAAGCAACT |
| SEQ ID NO: 3184 | mm17865_Cd40lg | TGAACTGTGAGGAGATGAGA |
| SEQ ID NO: 3185 | mm17870_Tnfsf8 | CACAACAAGGCACACCAGTG |
| SEQ ID NO: 3186 | mm17871_Tnfsf8 | CTGGTATATGAGTCCGTGGA |
| SEQ ID NO: 3187 | mm17872_Tnfsf8 | AATGATTTGAGCACTGCACG |
| SEQ ID NO: 3188 | mm17873_Tnfsf8 | GCTCTTACCTCCTTTAAGGG |
| SEQ ID NO: 3189 | mm17874_Tnfsf9 | GGGAGCTCATACCTATCTCA |
| SEQ ID NO: 3190 | mm17875_Tnfsf9 | AAAAATACGTAGTAGAGCCC |
| SEQ ID NO: 3191 | mm17876_Tnfsf9 | GGTTAATGTTCGGGATCGCG |
| SEQ ID NO: 3192 | mm17877_Tnfsf9 | AGTGTTGGGGCAGCCAATGT |
| SEQ ID NO: 3193 | mm17914_Tnr | GCACGTTGATGTTATACACA |
| SEQ ID NO: 3194 | mm17915_Tnr | ACGGAGTACTGGCTTAAGGG |
| SEQ ID NO: 3195 | mm17916_Tnr | TAAAGGACGTCACATCGCTG |
| SEQ ID NO: 3196 | mm17917_Tnr | CTGAGGAGGCTGTTACCATG |
| SEQ ID NO: 3197 | mm17954_Tpbg | GCCAGCCGAGAGATGCCCCG |
| SEQ ID NO: 3198 | mm17955_Tpbg | GAATCACATCGTGCCCCTG |
| SEQ ID NO: 3199 | mm17956_Tpbg | AAAAGGTTGCGCACGTAAGG |

TABLE 1-continued mmSurf sgRNA library sequences

| SEQ ID NO | id_gRNA Target | Sequence |
|---|---|---|
| SEQ ID NO: 3200 | mm17957_Tpbg | GCTGGGTTGGGTCTCCGCGT |
| SEQ ID NO: 3201 | mm17990_Tpo | GGTTTGGATCCGATAGTGAG |
| SEQ ID NO: 3202 | mm17991_Tpo | TCTAAATGAGTACCAACCGG |
| SEQ ID NO: 3203 | mm17992_Tpo | TGGCAGCGGTACACACCTTG |
| SEQ ID NO: 3204 | mm17993_Tpo | TGAGGGAAATTACCTGTATG |
| SEQ ID NO: 3205 | mm17998_Tpst2 | TGCCATAGCGGTACTCCACG |
| SEQ ID NO: 3206 | mm17999_Tpst2 | GCACTCCATGATCACGCGCA |
| SEQ ID NO: 3207 | mm18000_Tpst2 | CTGTGCGTACATCACCTCGA |
| SEQ ID NO: 3208 | mm18001_Tpst2 | GCCGCATGGCCAGCACACGA |
| SEQ ID NO: 3209 | mm18014_Hsp90b1 | AAGACCACTCAAATCGAACA |
| SEQ ID NO: 3210 | mm18015_Hsp90b1 | TCCACAGACAGAGACTGTTG |
| SEQ ID NO: 3211 | mm18016_Hsp90b1 | TATTCATCAAACAGACCTCG |
| SEQ ID NO: 3212 | mm18017_Hsp90b1 | AGAGGAAACACACTAGGTCG |
| SEQ ID NO: 3213 | mm18058_Trf | GGGGACCCTTAACAGCCCAA |
| SEQ ID NO: 3214 | mm18059_Trf | ACAGACCTACTACTACGCTG |
| SEQ ID NO: 3215 | mm18060_Trf | GTAGCCAAAGAATGGTTGAG |
| SEQ ID NO: 3216 | mm18061_Trf | AGAGAACCAAGTGTGACGAG |
| SEQ ID NO: 3217 | mm18062_Tfrc | CTACACGCTTACAATAGCCC |
| SEQ ID NO: 3218 | mm18063_Tfrc | GAATACATACACTCCTCGTG |
| SEQ ID NO: 3219 | mm18064_Tfrc | GGGCTCCTACTACAACATAA |
| SEQ ID NO: 3220 | mm18065_Tfrc | AACCCTCGGGAGACTCCACT |
| SEQ ID NO: 3221 | mm18070_Trhr | AGATACTGTCGGTTATGTTG |
| SEQ ID NO: 3222 | mm18071_Trhr | GGTGGTTACCATCTTACTTG |
| SEQ ID NO: 3223 | mm18072_Trhr | CACCTACAAAAACGCTGTTG |
| SEQ ID NO: 3224 | mm18073_Trhr | CTAAAGAAAACTCTAAGATG |
| SEQ ID NO: 3225 | mm18106_Trpc4 | AACTCCGTGTCTGATCTAGG |
| SEQ ID NO: 3226 | mm18107_Trpc4 | ATTAACTGCATCGACCCCCT |
| SEQ ID NO: 3227 | mm18108_Trpc4 | GGAGTGGATGATATTACCGT |
| SEQ ID NO: 3228 | mm18109_Trpc4 | GACATTATATGTGCCAAACA |
| SEQ ID NO: 3229 | mm18206_Tgoln1 | CAAACTGTGATCGGTCGCGG |
| SEQ ID NO: 3230 | mm18207_Tgoln1 | AAGACTACAAGGCCGACCGA |
| SEQ ID NO: 3231 | mm18208_Tgoln1 | CCGAGTTGAACGAAACTGCG |
| SEQ ID NO: 3232 | mm18209_Tgoln1 | GGAGTGGAGGACTGTTTGGA |
| SEQ ID NO: 3233 | mm18246_Tubb2a | CGGGCACCATGGACTCAGTG |
| SEQ ID NO: 3234 | mm18247_Tubb2a | GAGGTGATAAGCGATGAGCA |
| SEQ ID NO: 3235 | mm18248_Tubb2a | ACTCTGTCCTAGATGTGGTG |
| SEQ ID NO: 3236 | mm18249_Tubb2a | AACCTATTCCATTGACAATG |
| SEQ ID NO: 3237 | mm18258_Tubb5 | GAGGTGATAAGCGATGAACA |

TABLE 1-continued mmSurf sgRNA library sequences

| SEQ ID NO | id_gRNA Target | Sequence |
|---|---|---|
| SEQ ID NO: 3238 | mm18259_Tubb5 | GATCCACCAAGATAGCTCGA |
| SEQ ID NO: 3239 | mm18260_Tubb5 | TATCATGAATACCTTCAGTG |
| SEQ ID NO: 3240 | mm18261_Tubb5 | GGGTAAGTTCAGGCACAGTG |
| SEQ ID NO: 3241 | mm18278_Tnfrsf4 | GAGCCGCTGTGATCATACCA |
| SEQ ID NO: 3242 | mm18279_Tnfrsf4 | TCACACTTGGAGTTACAGCA |
| SEQ ID NO: 3243 | mm18280_Tnfrsf4 | TTCCAGATAAGGTACAACTG |
| SEQ ID NO: 3244 | mm18281_Tnfrsf4 | GTAGACCAGGCACCCAACCT |
| SEQ ID NO: 3245 | mm18282_Tnfsf4 | GAATGAGTATCAAACTATGG |
| SEQ ID NO: 3246 | mm18283_Tnfsf4 | ACTGGTGCATCTTACCGGAG |
| SEQ ID NO: 3247 | mm18284_Tnfsf4 | AGATGGGATTATGATCCTCC |
| SEQ ID NO: 3248 | mm18285_Tnfsf4 | CGGTTGTCATCAAGTGCGAT |
| SEQ ID NO: 3249 | mm18306_Tyro3 | GGAGTTTGACCATCCACACG |
| SEQ ID NO: 3250 | mm18307_Tyro3 | TAGGAGAGTTTGGATCAGTG |
| SEQ ID NO: 3251 | mm18308_Tyro3 | ACAGCTTATAAGGTCCTAGG |
| SEQ ID NO: 3252 | mm18309_Tyro3 | AACCCGTAACCATTTACTGG |
| SEQ ID NO: 3253 | mm18310_Tyrobp | CTGTACGGGACTTAATCCTA |
| SEQ ID NO: 3254 | mm18311_Tyrobp | AAGGAACAGAAGGCACCAGG |
| SEQ ID NO: 3255 | mm18312_Tyrobp | CAATCCCAGCCAGTACACCA |
| SEQ ID NO: 3256 | mm18313_Tyrobp | CTTGACCTCGGGAGACCAGG |
| SEQ ID NO: 3257 | mm18494_Unc5c | AGGCACTACGAAGAGTCGGA |
| SEQ ID NO: 3258 | mm18495_Unc5c | CTTACCATACACGATGACAG |
| SEQ ID NO: 3259 | mm18496_Unc5c | TCAGACCCTACTTACCCCTG |
| SEQ ID NO: 3260 | mm18497_Unc5c | ATGATGTGGCTCTCTACGTG |
| SEQ ID NO: 3261 | mm18638_Vamp1 | CCAACATGACCAGTAACAGG |
| SEQ ID NO: 3262 | mm18639_Vamp1 | GCTCTCAAATTGTGATGCTC |
| SEQ ID NO: 3263 | mm18640_Vamp1 | TCTGCAATCTCCTTAGGTGG |
| SEQ ID NO: 3264 | mm18641_Vamp1 | GGACATCATGCGTGTGAATG |
| SEQ ID NO: 3265 | mm18646_Vamp3 | TGACATCATGAGAGTCAATG |
| SEQ ID NO: 3266 | mm18647_Vamp3 | AGCACTTGTTTCAAACTGCG |
| SEQ ID NO: 3267 | mm18648_Vamp3 | GAGTCTTCGATTACTGCCAG |
| SEQ ID NO: 3268 | mm18649_Vamp3 | TGACCGCGCAGATGCACTGC |
| SEQ ID NO: 3269 | mm18650_Vamp8 | CCACCTCCGAAACAAGACAG |
| SEQ ID NO: 3270 | mm18651_Vamp8 | TTATGACCCAGAATGTGGAG |
| SEQ ID NO: 3271 | mm18652_Vamp8 | CTTCAAGACAACGTCCCAGA |
| SEQ ID NO: 3272 | mm18653_Vamp8 | GGAGCGGATCTTGGCCAGAG |
| SEQ ID NO: 3273 | mm18674_Vcam1 | GCTGGAACGAAGTATCCACG |
| SEQ ID NO: 3274 | mm18675_Vcam1 | AGACAGCCCACTAAACGCGA |
| SEQ ID NO: 3275 | mm18676_Vcam1 | CACAGAGCTCAACACAAGCG |

TABLE 1-continued mmSurf sgRNA library sequences

| SEQ ID NO | id_gRNA Target | Sequence |
|---|---|---|
| SEQ ID NO: 3276 | mm18677_Vcam1 | TCCCTCCACAAGGCTTCAAG |
| SEQ ID NO: 3277 | mm18682_Vdac1 | AAGAGGGAGCACATCAACCT |
| SEQ ID NO: 3278 | mm18683_Vdac1 | CGGCGAGAATGACGAATCAA |
| SEQ ID NO: 3279 | mm18684_Vdac1 | TGGAACACAGACAACACCCT |
| SEQ ID NO: 3280 | mm18685_Vdac1 | CTTCGCAGTTGGCTATAAGA |
| SEQ ID NO: 3281 | mm18694_Vegfa | AGATGTACTCTATCTCGTCG |
| SEQ ID NO: 3282 | mm18695_Vegfa | TGGTTTCGGAGGCCCGTCCG |
| SEQ ID NO: 3283 | mm18696_Vegfa | GCGCGGGCTTCGGTTCCTCG |
| SEQ ID NO: 3284 | mm18697_Vegfa | GCCGCAGGAGACAAACCGAT |
| SEQ ID NO: 3285 | mm18754_Vldlr | TTGATGAATGCCAAAACCCG |
| SEQ ID NO: 3286 | mm18755_Vldlr | TAGAATACAAACCCCGACAA |
| SEQ ID NO: 3287 | mm18756_Vldlr | AGTGCATTCACAAAAAATGG |
| SEQ ID NO: 3288 | mm18757_Vldlr | AGAGCAACTAAGGAACACGG |
| SEQ ID NO: 3289 | mm18762_Vnn1 | CATGCTCGTAAACAGCCGCG |
| SEQ ID NO: 3290 | mm18763_Vnn1 | CTATGCACCCGATTCTCCAA |
| SEQ ID NO: 3291 | mm18764_Vnn1 | TACCAGATTTGGCTCTACCC |
| SEQ ID NO: 3292 | mm18765_Vnn1 | AGGAAGGACGTCCATCCAGG |
| SEQ ID NO: 3293 | mm18766_Vpreb1 | AGGGAAGAAGATGCTAATGG |
| SEQ ID NO: 3294 | mm18767_Vpreb1 | CCGGGTCCAAAGATACGACC |
| SEQ ID NO: 3295 | mm18768_Vpreb1 | GCTGGCCTATCTCACAGGTA |
| SEQ ID NO: 3296 | mm18769_Vpreb1 | TCACACTCAGACAAGCACCA |
| SEQ ID NO: 3297 | mm18786_Trpv2 | TGCACCGATGAGTTCTACCG |
| SEQ ID NO: 3298 | mm18787_Trpv2 | CCGTGACCGACTCTTCAGTG |
| SEQ ID NO: 3299 | mm18788_Trpv2 | TGACAGCCTTCTCCAAATGG |
| SEQ ID NO: 3300 | mm18789_Trpv2 | TTTCCCGAAAGTTCACCGAG |
| SEQ ID NO: 3301 | mm18790_Vtn | GGACGTGTTCACTATGCCAG |
| SEQ ID NO: 3302 | mm18791_Vtn | CGAGGATTTAGGTCACCGGG |
| SEQ ID NO: 3303 | mm18792_Vtn | GCCTAAAGTGGAGCAACAGG |
| SEQ ID NO: 3304 | mm18793_Vtn | AGATGTTTCGGGGATAACCA |
| SEQ ID NO: 3305 | mm18794_Vwf | AAATTCCTAGCCATCCGTGG |
| SEQ ID NO: 3306 | mm18795_Vwf | GCAACTTACGACAGGCACTG |
| SEQ ID NO: 3307 | mm18796_Vwf | CATTGATGTACCATGGAATG |
| SEQ ID NO: 3308 | mm18797_Vwf | TGGTCTGAGAAAATGTCCGC |
| SEQ ID NO: 3309 | mm18854_Wisp2 | GCTGTCGAGTGTGTGCACGG |
| SEQ ID NO: 3310 | mm18855_Wisp2 | TTGTGCCGCTGTGATGACGG |
| SEQ ID NO: 3311 | mm18856_Wisp2 | GCTGTGAGGTGAATGGCCGC |
| SEQ ID NO: 3312 | mm18857_Wisp2 | CCTGGTCACACACCCACTCG |
| SEQ ID NO: 3313 | mm18862_Wnt1 | CCTGCACCTGCGACTACCGG |

TABLE 1-continued mmSurf sgRNA library sequences

| SEQ ID NO | id_gRNA Target | Sequence |
|---|---|---|
| SEQ ID NO: 3314 | mm18863_Wnt1 | TTCGGCAAGATCGTCAACCG |
| SEQ ID NO: 3315 | mm18864_Wnt1 | ATCCGTCAACAGGTTCGTGG |
| SEQ ID NO: 3316 | mm18865_Wnt1 | CCACGAACTCTCGGCCAAAG |
| SEQ ID NO: 3317 | mm18894_Wnt3a | ACCGTCACAACAATGAGGCT |
| SEQ ID NO: 3318 | mm18895_Wnt3a | GTGAAGTGAAGACCTGCTGG |
| SEQ ID NO: 3319 | mm18896_Wnt3a | GTGCTCAGAGAGGAGTACTG |
| SEQ ID NO: 3320 | mm18897_Wnt3a | CACTGCGAAAGCTACTCCAG |
| SEQ ID NO: 3321 | mm18898_Wnt4 | GTGATGGACTCAGTGCGCCG |
| SEQ ID NO: 3322 | mm18899_Wnt4 | GGTGGAGTGCAAGTGTCACG |
| SEQ ID NO: 3323 | mm18900_Wnt4 | TTACAGCCAATTGCTCGCGG |
| SEQ ID NO: 3324 | mm18901_Wnt4 | TTTGGGAAGGTGGTGACACA |
| SEQ ID NO: 3325 | mm18902_Wnt5a | AGGGAACGAATCCACGCTAA |
| SEQ ID NO: 3326 | mm18903_Wnt5a | ACAACAATGAAGCAGGCCGT |
| SEQ ID NO: 3327 | mm18904_Wnt5a | CTGGGCGAAGGAGAAAAACG |
| SEQ ID NO: 3328 | mm18905_Wnt5a | GCATGTGGTCCTGATACAAG |
| SEQ ID NO: 3329 | mm18906_Wnt5b | GGAGCACATGTCCTACATCG |
| SEQ ID NO: 3330 | mm18907_Wnt5b | GACATCAGCCATCTTATACA |
| SEQ ID NO: 3331 | mm18908_Wnt5b | GCGCCAATGATGAACATCTC |
| SEQ ID NO: 3332 | mm18909_Wnt5b | GGCGCTCACTGCATACGTGA |
| SEQ ID NO: 3333 | mm18910_Wnt6 | CCGCGCACGTCGATGGACTG |
| SEQ ID NO: 3334 | mm18911_Wnt6 | TGTGCAGTTGCACCAATGCA |
| SEQ ID NO: 3335 | mm18912_Wnt6 | GTAGTGGCAGAGCTTGCCCG |
| SEQ ID NO: 3336 | mm18913_Wnt6 | AAGCCCATGGCACTTACACT |
| SEQ ID NO: 3337 | mm18914_Wnt7a | GCCCGCAGCGATAATCGCAT |
| SEQ ID NO: 3338 | mm18915_Wnt7a | CATGAACTTACACAATAACG |
| SEQ ID NO: 3339 | mm18916_Wnt7a | GGCCAGTACCACCGGGACGA |
| SEQ ID NO: 3340 | mm18917_Wnt7a | TAGCCTAGCTCTCGGAACTG |
| SEQ ID NO: 3341 | mm18918_Wnt7b | CACGCTACCTAAGTTCCGCG |
| SEQ ID NO: 3342 | mm18919_Wnt7b | GAAGCAAGGCTACTACAACC |
| SEQ ID NO: 3343 | mm18920_Wnt7b | TCACAATGATGGCATCGGGT |
| SEQ ID NO: 3344 | mm18921_Wnt7b | CAGAGCATTGTCATCCGTGG |
| SEQ ID NO: 3345 | mm19006_Ybx1 | GTCTTACAGGAATGACACCA |
| SEQ ID NO: 3346 | mm19007_Ybx1 | TTGTTGAAGGAGAAAAGGTG |
| SEQ ID NO: 3347 | mm19008_Ybx1 | GCCGGCCCTATCGCAGGCGA |
| SEQ ID NO: 3348 | mm19009_Ybx1 | GAGAGTGGGAAAAGAACGA |
| SEQ ID NO: 3349 | mm19338_Slc30a1 | TGGGCCAGCGTCACGCATCG |
| SEQ ID NO: 3350 | mm19339_Slc30a1 | CCAGGAGGGAGACCAACACGC |
| SEQ ID NO: 3351 | mm19340_Slc30a1 | GGCATTCACGACCACGATCA |

TABLE 1-continued mmSurf sgRNA library sequences

| SEQ ID NO | id_gRNA Target | Sequence |
|---|---|---|
| SEQ ID NO: 3352 | mm19341_Slc30a1 | GGAGTCTGACAATCTGGAAG |
| SEQ ID NO: 3353 | mm19358_Zp3 | AGAGACTCTCCAGTTCACGG |
| SEQ ID NO: 3354 | mm19359_Zp3 | GGTGTCCGTGGATACCGACG |
| SEQ ID NO: 3355 | mm19360_Zp3 | CATCCTCAGGACTAACCGTG |
| SEQ ID NO: 3356 | mm19361_Zp3 | TCTCAGATAGACCATCCACA |
| SEQ ID NO: 3357 | mm19382_Adam23 | CGTGTGTTCTCGAATAAGAG |
| SEQ ID NO: 3358 | mm19383_Adam23 | TCTGCAGTTTCATTCCAGTG |
| SEQ ID NO: 3359 | mm19384_Adam23 | TTTGCTATCTTCTGACTACG |
| SEQ ID NO: 3360 | mm19385_Adam23 | GAAGTGTTCGCTCTCCAATG |
| SEQ ID NO: 3361 | mm19470_Cdh20 | AGAGATGAAGTATACCATTG |
| SEQ ID NO: 3362 | mm19471_Cdh20 | TTAGACAATCCCTCCCAAGT |
| SEQ ID NO: 3363 | mm19472_Cdh20 | TTGGATAACAGATGTACCTG |
| SEQ ID NO: 3364 | mm19473_Cdh20 | AACAACAGTGCACATCAGTG |
| SEQ ID NO: 3365 | mm19482_Clec5a | AGTGGTTCCGTAGCTCTCCG |
| SEQ ID NO: 3366 | mm19483_Clec5a | ACGAAAGTACCATGCCTACA |
| SEQ ID NO: 3367 | mm19484_Clec5a | AGTGTTGACAATTGCCAGTG |
| SEQ ID NO: 3368 | mm19485_Clec5a | TCCAGTCTGTCCCAGAAACT |
| SEQ ID NO: 3369 | mm19566_Ggt5 | GTGCGGAGGTCTTATACACA |
| SEQ ID NO: 3370 | mm19567_Ggt5 | AGATCTGCTCGGATATTGGA |
| SEQ ID NO: 3371 | mm19568_Ggt5 | TGCAGAGAAGTTGAACCCTG |
| SEQ ID NO: 3372 | mm19569_Ggt5 | GCTGGGCTAGATCTTCCCGG |
| SEQ ID NO: 3373 | mm19578_Grem1 | GGGAAAAAGAAAGGTTCCCA |
| SEQ ID NO: 3374 | mm19579_Grem1 | CCTGAAGCAGACCATCCACG |
| SEQ ID NO: 3375 | mm19580_Grem1 | TGCACTGGCCATAACAGAAG |
| SEQ ID NO: 3376 | mm19581_Grem1 | CTTGCGCTCTGTCACGTGCA |
| SEQ ID NO: 3377 | mm19594_Hcst | CATGTCACTCCTAATTGTAG |
| SEQ ID NO: 3378 | mm19595_Hcst | AGTGGCTGCAAGTCAGACAT |
| SEQ ID NO: 3379 | mm19596_Hcst | CAGAGACAGAGTCCCACATC |
| SEQ ID NO: 3380 | mm19597_Hcst | TGACCGCATCTGCAGCCACT |
| SEQ ID NO: 3381 | mm19598_Hs2st1 | GTAGGCTATATTGGTGAACG |
| SEQ ID NO: 3382 | mm19599_Hs2st1 | GTCCCGGGCGAAGCTAGGTG |
| SEQ ID NO: 3383 | mm19600_Hs2st1 | AATTTATATCAATGTCATCA |
| SEQ ID NO: 3384 | mm19601_Hs2st1 | TTGTGAAGAACATAACCACC |
| SEQ ID NO: 3385 | mm19650_Ly6h | CCGCTTAACGAAGTCGCAGG |
| SEQ ID NO: 3386 | mm19651_Ly6h | CTGGCACAAACGGTATCGGT |
| SEQ ID NO: 3387 | mm19652_Ly6h | TAGGGCCTGAAAGAGGCGCG |
| SEQ ID NO: 3388 | mm19653_Ly6h | GTCCTGGCACCACAGGCCAT |
| SEQ ID NO: 3389 | mm19714_Nt5e | TCATGAATTTGATAACGGTG |

TABLE 1-continued mmSurf sgRNA library sequences

| SEQ ID NO | id_gRNA Target | Sequence |
|---|---|---|
| SEQ ID NO: 3390 | mm19715_Nt5e | TGAATAAGATCATCGCCCTG |
| SEQ ID NO: 3391 | mm19716_Nt5e | TATGCCTTTGGCAAATACCT |
| SEQ ID NO: 3392 | mm19717_Nt5e | CCTGAAGCGGCACGTCTGAG |
| SEQ ID NO: 3393 | mm19758_Pebp1 | AAGGGTAATGACATTAGCAG |
| SEQ ID NO: 3394 | mm19759_Pebp1 | CGTACACCAGCCAGACATAG |
| SEQ ID NO: 3395 | mm19760_Pebp1 | GGAGTGGCACCACTTCCTGG |
| SEQ ID NO: 3396 | mm19761_Pebp1 | CCTGCGGGTCGACTACGCCG |
| SEQ ID NO: 3397 | mm19858_Ccl19 | TCTGGGGGTGCTAATGATG |
| SEQ ID NO: 3398 | mm19859_Ccl19 | TACAGGTTCACCACACTAAG |
| SEQ ID NO: 3399 | mm19860_Ccl19 | ATTAGCACCCCCAGAGTTG |
| SEQ ID NO: 3400 | mm19861_Ccl19 | CAAGCAACTCACACAACAGC |
| SEQ ID NO: 3401 | mm19866_Sgcb | CACACCCATTTGGCCCAATG |
| SEQ ID NO: 3402 | mm19867_Sgcb | AGGACCGGCTCCATAAGACT |
| SEQ ID NO: 3403 | mm19868_Sgcb | CCGTGCTCTTATAAAGCGGG |
| SEQ ID NO: 3404 | mm19869_Sgcb | TGACGGCCAGGATAAACAGG |
| SEQ ID NO: 3405 | mm19870_Sgcd | ATCCCCACTTTGTATATGTG |
| SEQ ID NO: 3406 | mm19871_Sgcd | GAGATTGAGAGTCTTAGGTG |
| SEQ ID NO: 3407 | mm19872_Sgcd | CATGACCTTGAGAATCCAGA |
| SEQ ID NO: 3408 | mm19873_Sgcd | CTTACCTTAGTTCCTTGAAG |
| SEQ ID NO: 3409 | mm19890_Sigirr | TTGGTACCAAGACACTTACG |
| SEQ ID NO: 3410 | mm19891_Sigirr | CCTCAGTTGGAGCGGCGTCG |
| SEQ ID NO: 3411 | mm19892_Sigirr | AAGCCACTTCAGCCTCCATG |
| SEQ ID NO: 3412 | mm19893_Sigirr | CGGAAGCTCTGGCTACACCA |
| SEQ ID NO: 3413 | mm19894_Slco2a1 | CCCACGGATGATCGGCATAG |
| SEQ ID NO: 3414 | mm19895_Slco2a1 | ACTCGGGGATGGTTTGCAG |
| SEQ ID NO: 3415 | mm19896_Slco2a1 | CTTCGTGGACTACGGCAGAG |
| SEQ ID NO: 3416 | mm19897_Slco2a1 | CTCTGCAAAGTCGTCCACAT |
| SEQ ID NO: 3417 | mm19926_Synj2bp | GGTGGATTATTTAGTCACGG |
| SEQ ID NO: 3418 | mm19927_Synj2bp | CTACGTCAGCCGTATCAAAG |
| SEQ ID NO: 3419 | mm19928_Synj2bp | CAGTATGTCTCCAACGACAG |
| SEQ ID NO: 3420 | mm19929_Synj2bp | CGAAGCCATTTCTCACCGAG |
| SEQ ID NO: 3421 | mm19954_Tlr2 | TCACTACGTCTGACTCCGAG |
| SEQ ID NO: 3422 | mm19955_Tlr2 | GGAGGTTCGCACACGCTCGG |
| SEQ ID NO: 3423 | mm19956_Tlr2 | GGAAAGGGGCCCGAACCAGG |
| SEQ ID NO: 3424 | mm19957_Tlr2 | CAGGGAACAACGAAGCATCT |
| SEQ ID NO: 3425 | mm20046_Angptl2 | TGTGACCAGAGACATGACCC |
| SEQ ID NO: 3426 | mm20047_Angptl2 | GTGGGTGGTTGGTAGACCCG |
| SEQ ID NO: 3427 | mm20048_Angptl2 | GCTGGCACACAACCAATCAG |

TABLE 1-continued mmSurf sgRNA library sequences

| SEQ ID NO | id_gRNA Target | Sequence |
|---|---|---|
| SEQ ID NO: 3428 | mm20049_Angptl2 | TTACCTCAACAGGTACAAGC |
| SEQ ID NO: 3429 | mm20054_Axl | GGATATCCGGATGTGATACG |
| SEQ ID NO: 3430 | mm20055_Axl | CCCAGCAGTACATACCACCA |
| SEQ ID NO: 3431 | mm20056_Axl | CAGACAACCTACGGAGCTAG |
| SEQ ID NO: 3432 | mm20057_Axl | TTGACCACCCCAACGTCATG |
| SEQ ID NO: 3433 | mm20058_Btd | CTTGCTGTTCATAGACGTCG |
| SEQ ID NO: 3434 | mm20059_Btd | GTACCAAAAGGACTTGAGAG |
| SEQ ID NO: 3435 | mm20060_Btd | ATACCAGTTTAACACAAATG |
| SEQ ID NO: 3436 | mm20061_Btd | CCGCGAGGCTGAGTACTACG |
| SEQ ID NO: 3437 | mm20066_Ceacam1 | ATAGTAATATGAATTTCACG |
| SEQ ID NO: 3438 | mm20067_Ceacam1 | AAGCAACAACTCCAATCCCG |
| SEQ ID NO: 3439 | mm20068_Ceacam1 | TTGTTGTCTTCAGCAACCTG |
| SEQ ID NO: 3440 | mm20069_Ceacam1 | AGCTCTTGGGAGGATGCATG |
| SEQ ID NO: 3441 | mm20074_Ceacam2 | TCGGCCTTTAGCTGGCACAA |
| SEQ ID NO: 3442 | mm20075_Ceacam2 | AGATCAAAACTATCGTCGTA |
| SEQ ID NO: 3443 | mm20076_Ceacam2 | ACAGGTAGGTTATATTATCA |
| SEQ ID NO: 3444 | mm20077_Ceacam2 | ACAGTCACTTGTGCAGTGGT |
| SEQ ID NO: 3445 | mm20094_Clcn6 | GAAAGGGCGAAGATACGAGG |
| SEQ ID NO: 3446 | mm20095_Clcn6 | CTACAAATGAGATCACCTAT |
| SEQ ID NO: 3447 | mm20096_Clcn6 | GCGTGACTTTGTGTCAGCGG |
| SEQ ID NO: 3448 | mm20097_Clcn6 | AGAATAAGGCCAGGGTGACG |
| SEQ ID NO: 3449 | mm20202_Map3k5 | ATGCGTAATGAAACTTCACG |
| SEQ ID NO: 3450 | mm20203_Map3k5 | ATAATCGATAAAGGACCACG |
| SEQ ID NO: 3451 | mm20204_Map3k5 | CTGAACGAAACGGTCCACGA |
| SEQ ID NO: 3452 | mm20205_Map3k5 | GGGCGGCCGGCGTACCACCG |
| SEQ ID NO: 3453 | mm20286_Plod2 | GTGTGATTACTACTTTAGTG |
| SEQ ID NO: 3454 | mm20287_Plod2 | ATGGAATGAACAGTATCGGA |
| SEQ ID NO: 3455 | mm20288_Plod2 | AAACGCTACCTGAATTCTGG |
| SEQ ID NO: 3456 | mm20289_Plod2 | TGCTCGCTCTGAAGATTACG |
| SEQ ID NO: 3457 | mm20290_Plod3 | AGAGAGAGATCCTGTCCGGG |
| SEQ ID NO: 3458 | mm20291_Plod3 | TCAGGCATATGTGATCCGCG |
| SEQ ID NO: 3459 | mm20292_Plod3 | CTGGCGGACAATCTGATGGA |
| SEQ ID NO: 3460 | mm20293_Plod3 | AGCTCCAGCTCAACTACCTG |
| SEQ ID NO: 3461 | mm20298_Psg16 | CTACGGACCGTAAATAGACG |
| SEQ ID NO: 3462 | mm20299_Psg16 | AGGGCTTTCCTGGTACAAAG |
| SEQ ID NO: 3463 | mm20300_Psg16 | TACAAACTCTGAGTAGACAT |
| SEQ ID NO: 3464 | mm20301_Psg16 | TCATCATCGATCCAATGCCA |
| SEQ ID NO: 3465 | mm20354_Rpl27a | GAGGCGCACACTTACCGATG |

TABLE 1-continued mmSurf sgRNA library sequences

| SEQ ID NO | id_gRNA Target | Sequence |
|---|---|---|
| SEQ ID NO: 3466 | mm20355_Rpl27a | CGAGCAGACACGGGTCAATG |
| SEQ ID NO: 3467 | mm20356_Rpl27a | CAAAGTAACCTGGGTGACTG |
| SEQ ID NO: 3468 | mm20357_Rpl27a | CCTGGATAAACTGTGGACAT |
| SEQ ID NO: 3469 | mm20358_Sema4g | ACAGTATGAGACACTACGTG |
| SEQ ID NO: 3470 | mm20359_Sema4g | GCCGCTGTAGAAATCGCACG |
| SEQ ID NO: 3471 | mm20360_Sema4g | AGAAAGAGCAGGTCATAGGT |
| SEQ ID NO: 3472 | mm20361_Sema4g | GGAGAAATGTCCTTATGACC |
| SEQ ID NO: 3473 | mm20426_Ror1 | AGCACGGGTGTAGACTACCG |
| SEQ ID NO: 3474 | mm20427_Ror1 | TCATCACGACACAAGTCACG |
| SEQ ID NO: 3475 | mm20428_Ror1 | ACTTCAAGTGAAATCGACAA |
| SEQ ID NO: 3476 | mm20429_Ror1 | ACAGCCGACATCGGAATGCG |
| SEQ ID NO: 3477 | mm20430_Ror2 | AGAGAATACATACTACACGG |
| SEQ ID NO: 3478 | mm20431_Ror2 | TGGTGGCGCAGATCGCTGCG |
| SEQ ID NO: 3479 | mm20432_Ror2 | GCTCTGGCGCCGATTACAGG |
| SEQ ID NO: 3480 | mm20433_Ror2 | CTGGTCTGACAGTTGCGTGG |
| SEQ ID NO: 3481 | mm20446_Slc7a11 | TCATTACACATACATTCTGG |
| SEQ ID NO: 3482 | mm20447_Slc7a11 | GAAGAGACACAAGTCTAATG |
| SEQ ID NO: 3483 | mm20448_Slc7a11 | GGGCTACGTACTGACAAACG |
| SEQ ID NO: 3484 | mm20449_Slc7a11 | ACAGGCAGACCAGAAAACCA |
| SEQ ID NO: 3485 | mm20478_B3galt1 | TCACCCTCAAAACCTTAATG |
| SEQ ID NO: 3486 | mm20479_B3galt1 | TTCACTGGTTACGTCATCAA |
| SEQ ID NO: 3487 | mm20480_B3galt1 | GGCATCAAATTCCTTGTGTG |
| SEQ ID NO: 3488 | mm20481_B3galt1 | GGGGATGAAAACAACTTCAA |
| SEQ ID NO: 3489 | mm20482_B3galt2 | ACCTGGCATCCAAATCATAC |
| SEQ ID NO: 3490 | mm20483_B3galt2 | AGAGAAAGCACACCCGTAAG |
| SEQ ID NO: 3491 | mm20484_B3galt2 | CCTGTGACATACACTTTCCG |
| SEQ ID NO: 3492 | mm20485_B3galt2 | TAACACCGAGCTATCACCAC |
| SEQ ID NO: 3493 | mm20486_B3galnt1 | CAAGCCATTAGAGTTACTTG |
| SEQ ID NO: 3494 | mm20487_B3galnt1 | GCTCGATCACATTGTAGTGG |
| SEQ ID NO: 3495 | mm20488_B3galnt1 | TCATGATATACTTGGCATTG |
| SEQ ID NO: 3496 | mm20489_B3galnt1 | GAGAACAGTTCGAGTGTTCG |
| SEQ ID NO: 3497 | mm20610_Racgap1 | GACACCGGTTAAGATTGGAG |
| SEQ ID NO: 3498 | mm20611_Racgap1 | TGGCAGTATTCAGCTGAGCG |
| SEQ ID NO: 3499 | mm20612_Racgap1 | GAAGTATCAAAGAACCAACC |
| SEQ ID NO: 3500 | mm20613_Racgap1 | TGGACGTGGAGATCAAGCGG |
| SEQ ID NO: 3501 | mm20674_Islr | TTCTGGAATAGACACCGCTG |
| SEQ ID NO: 3502 | mm20675_Islr | TGTGCCTATCGTGACCTAGA |
| SEQ ID NO: 3503 | mm20676_Islr | TCACACCCCGGGCGGCACGG |

TABLE 1-continued mmSurf sgRNA library sequences

| SEQ ID NO | id_gRNA Target | Sequence |
|---|---|---|
| SEQ ID NO: 3504 | mm20677_Islr | CTGGTAGCTTAGTTGCACTG |
| SEQ ID NO: 3505 | mm20698_Klrk1 | AAGGGTGAATCGAATTGCCA |
| SEQ ID NO: 3506 | mm20699_Klrk1 | ATATCCAGTTGTTAGGGCAT |
| SEQ ID NO: 3507 | mm20700_Klrk1 | GCACTAACTACCAGTCAACC |
| SEQ ID NO: 3508 | mm20701_Klrk1 | CGACCTCAAGCCAGCAAAGT |
| SEQ ID NO: 3509 | mm20710_Tspan32 | AGAGCCCATCTAGCAACTGG |
| SEQ ID NO: 3510 | mm20711_Tspan32 | GCAAAGCACAGGAAACCCTG |
| SEQ ID NO: 3511 | mm20712_Tspan32 | GGGGTTGTAGAATCTCCAGA |
| SEQ ID NO: 3512 | mm20713_Tspan32 | ACTGGAGCCATCATGTGTCA |
| SEQ ID NO: 3513 | mm20754_Fkbp9 | AAACCTATGACACGTACGTG |
| SEQ ID NO: 3514 | mm20755_Fkbp9 | TTGGGATGTGCGTAAACGAG |
| SEQ ID NO: 3515 | mm20756_Fkbp9 | CCGATACTTGGATAGTCCGA |
| SEQ ID NO: 3516 | mm20757_Fkbp9 | TCGTGCGCTACCACTACGTG |
| SEQ ID NO: 3517 | mm20822_Podxl | AAGCAAGTGTAGATGCCACT |
| SEQ ID NO: 3518 | mm20823_Podxl | GGGCACGTGTACTCACGCAA |
| SEQ ID NO: 3519 | mm20824_Podxl | AACCCCACGAGCAATCAAAG |
| SEQ ID NO: 3520 | mm20825_Podxl | GTGCTCGGTGAAGAATCCAC |
| SEQ ID NO: 3521 | mm20850_Slamf1 | ATCTGATGTTCATTCGTCAG |
| SEQ ID NO: 3522 | mm20851_Slamf1 | TAAAGTGCTAAACAAAACCC |
| SEQ ID NO: 3523 | mm20852_Slamf1 | GAGCTATCCAGATCACCTGG |
| SEQ ID NO: 3524 | mm20853_Slamf1 | AGGATGGTACTTGGTGAGCG |
| SEQ ID NO: 3525 | mm20882_Pla2g7 | GGAAATGGATCGTACCCCGT |
| SEQ ID NO: 3526 | mm20883_Pla2g7 | TTGGGATCCAAACAGTGTCG |
| SEQ ID NO: 3527 | mm20884_Pla2g7 | TAGTGGCCACTGTCGAACAC |
| SEQ ID NO: 3528 | mm20885_Pla2g7 | GCGATTCTTGACATTGAACA |
| SEQ ID NO: 3529 | mm20926_Tnfrsf12a | CCAAGCCGAATCCCAACACG |
| SEQ ID NO: 3530 | mm20927_Tnfrsf12a | CGCAGTCCATGCACTTGTCG |
| SEQ ID NO: 3531 | mm20928_Tnfrsf12a | GCTGCCGCTAGAGCATGGGG |
| SEQ ID NO: 3532 | mm20929_Tnfrsf12a | CTTGGTGTTGATGCGCGCCG |
| SEQ ID NO: 3533 | mm20982_Rpl3 | TTAGGTGCTTACCTGAGTGT |
| SEQ ID NO: 3534 | mm20983_Rpl3 | TGTGGAAACTCCCCCAATGG |
| SEQ ID NO: 3535 | mm20984_Rpl3 | CAGAGAAGGCAACACGGGCA |
| SEQ ID NO: 3536 | mm20985_Rpl3 | AAGCGCAGCAGCCGGCATCG |
| SEQ ID NO: 3537 | mm21014_Tjp3 | AAGATGGTCCAGTCTCGCGT |
| SEQ ID NO: 3538 | mm21015_Tjp3 | TGGCTCCTTTCAGATCAACG |
| SEQ ID NO: 3539 | mm21016_Tjp3 | ACTGACCGTTCCCGCCTCCG |
| SEQ ID NO: 3540 | mm21017_Tjp3 | CGTGGGCATCTTCGTATCCG |
| SEQ ID NO: 3541 | mm21062_Ptdss2 | ATCGTCGTAGACTTCAGACT |

TABLE 1-continued mmSurf sgRNA library sequences

| SEQ ID NO | id_gRNA Target | Sequence |
|---|---|---|
| SEQ ID NO: 3542 | mm21063_Ptdss2 | ATTGCCAGAGAGGGACTACG |
| SEQ ID NO: 3543 | mm21064_Ptdss2 | AACGGGCTGGGCATCTACTG |
| SEQ ID NO: 3544 | mm21065_Ptdss2 | TCATGCACATCCACCAGTCA |
| SEQ ID NO: 3545 | mm21070_Pign | CCAGCTCCCAAGTAACGAA |
| SEQ ID NO: 3546 | mm21071_Pign | GTGTTGTTAAGATAACCCAC |
| SEQ ID NO: 3547 | mm21072_Pign | TGCCACAAAACTGGATACGT |
| SEQ ID NO: 3548 | mm21073_Pign | AAGTCAATAGTGATTCAACC |
| SEQ ID NO: 3549 | mm21106_Abca7 | GTGTCGGCGCAAGAAAAGCG |
| SEQ ID NO: 3550 | mm21107_Abca7 | GAGAAACCATGCGTGCGATG |
| SEQ ID NO: 3551 | mm21108_Abca7 | CAGACACATTTCGGCCAGTG |
| SEQ ID NO: 3552 | mm21109_Abca7 | AATCCTAGGACAAATGATGG |
| SEQ ID NO: 3553 | mm21130_Abca3 | GAGGAGCCACGAAAAAGTAG |
| SEQ ID NO: 3554 | mm21131_Abca3 | AGCTGGCTACCACATGACGC |
| SEQ ID NO: 3555 | mm21132_Abca3 | ACACACGAAGAAATTACATG |
| SEQ ID NO: 3556 | mm21133_Abca3 | AAGGAGGCGGCTTTAATGAG |
| SEQ ID NO: 3557 | mm21150_Abcc5 | GGAGCTGATGAACTTAAATG |
| SEQ ID NO: 3558 | mm21151_Abcc5 | AAATCCGAGAGGAGGAACGT |
| SEQ ID NO: 3559 | mm21152_Abcc5 | CATTAAAGAAAAGTCCCTAG |
| SEQ ID NO: 3560 | mm21153_Abcc5 | AAAGACAAGAGGGCTACCAG |
| SEQ ID NO: 3561 | mm21170_Nagpa | AGCCACCGTTCTGAGCGATG |
| SEQ ID NO: 3562 | mm21171_Nagpa | GCGATGGAACCATAGTCACC |
| SEQ ID NO: 3563 | mm21172_Nagpa | AGCACCGAGAAAGTGCGTAG |
| SEQ ID NO: 3564 | mm21173_Nagpa | GTTCTTACCAGTGATCTGAA |
| SEQ ID NO: 3565 | mm21410_Slco1a4 | CCAACGCAAGACCCAACAGG |
| SEQ ID NO: 3566 | mm21411_Slco1a4 | GATAAGCCCAACTACAGACG |
| SEQ ID NO: 3567 | mm21412_Slco1a4 | AACCACCAATTAAATATCCG |
| SEQ ID NO: 3568 | mm21413_Slco1a4 | AAAATCAAGGAGGAAAACCG |
| SEQ ID NO: 3569 | mm21554_Cspg5 | CCTACCCGGTACGGCCCCAG |
| SEQ ID NO: 3570 | mm21555_Cspg5 | GTCGCGTGCCAATGACACGC |
| SEQ ID NO: 3571 | mm21556_Cspg5 | GTCCATGATAAGCCTAGTGT |
| SEQ ID NO: 3572 | mm21557_Cspg5 | GAAAATCACCCTGATACCGA |
| SEQ ID NO: 3573 | mm21562_Clic4 | TGTTCTCGTCGATTTCGTCG |
| SEQ ID NO: 3574 | mm21563_Clic4 | TCAAGACCAGAGGCTAATGA |
| SEQ ID NO: 3575 | mm21564_Clic4 | CTTCAACAGCGAAGTCAAGA |
| SEQ ID NO: 3576 | mm21565_Clic4 | CTTGACGAAGAGCTCGATGA |
| SEQ ID NO: 3577 | mm21626_Mfi2 | GCCGAGCCGACATCACTGAG |
| SEQ ID NO: 3578 | mm21627_Mfi2 | GAGAGATACTACGACTACAG |
| SEQ ID NO: 3579 | mm21628_Mfi2 | CTTGCCGCGAAGCTCGTCCA |

TABLE 1-continued mmSurf sgRNA library sequences

| SEQ ID NO | id_gRNA Target | Sequence |
|---|---|---|
| SEQ ID NO: 3580 | mm21629_Mfi2 | ACAGGCATTAACCGGACTGT |
| SEQ ID NO: 3581 | mm21650_Slc22a4 | CAGAGCAAAGTAACCCACTG |
| SEQ ID NO: 3582 | mm21651_Slc22a4 | GAGAACGCCTACGAAGAACA |
| SEQ ID NO: 3583 | mm21652_Slc22a4 | CGCAAAGATGAACAGCATCG |
| SEQ ID NO: 3584 | mm21653_Slc22a4 | AACCAGGCAACGGTGCTCGG |
| SEQ ID NO: 3585 | mm21694_Angptl3 | TGCTCTGCCGTTTATAACAG |
| SEQ ID NO: 3586 | mm21695_Angptl3 | TACACTACAAGTTAAAAACG |
| SEQ ID NO: 3587 | mm21696_Angptl3 | CATGGACATTAATTCAACAC |
| SEQ ID NO: 3588 | mm21697_Angptl3 | GAAGACAGCCCTTCAACACA |
| SEQ ID NO: 3589 | mm21698_Slamf6 | GAACGCCATTCATTAGCTGG |
| SEQ ID NO: 3590 | mm21699_Slamf6 | GATTACTTAGGTTGATAACG |
| SEQ ID NO: 3591 | mm21700_Slamf6 | TGGGACCTGCCAGATACACC |
| SEQ ID NO: 3592 | mm21701_Slamf6 | CACTGCGCAGATAACCACAA |
| SEQ ID NO: 3593 | mm21726_Tor2a | GCTTGTCCATCTCATCGAAG |
| SEQ ID NO: 3594 | mm21727_Tor2a | GGGGAGAAGTGATGGACGTG |
| SEQ ID NO: 3595 | mm21728_Tor2a | CAGGTCACATTCCAGACCTA |
| SEQ ID NO: 3596 | mm21729_Tor2a | CCGTGCAGGGAAAGGACCAA |
| SEQ ID NO: 3597 | mm21730_Tor1b | GGAACGGCCCCTCAACACGT |
| SEQ ID NO: 3598 | mm21731_Tor1b | CAGCTCCAGAAGTGGATCCG |
| SEQ ID NO: 3599 | mm21732_Tor1b | GTAGCCGGTGAGCGCCGACA |
| SEQ ID NO: 3600 | mm21733_Tor1b | CAATGCCTTGAGAATCACTT |
| SEQ ID NO: 3601 | mm21734_Tor3a | TTGAACCCTACCTGGAACCG |
| SEQ ID NO: 3602 | mm21735_Tor3a | CTTACCCAGAGGCGGCACGG |
| SEQ ID NO: 3603 | mm21736_Tor3a | TACTTAGAGATGCCCCAAGT |
| SEQ ID NO: 3604 | mm21737_Tor3a | ATGGACAACCTGTATCGGGA |
| SEQ ID NO: 3605 | mm21738_Slc46a2 | GATGGGCACCTATCGAACCC |
| SEQ ID NO: 3606 | mm21739_Slc46a2 | CATGACCCCGGACCAATAAG |
| SEQ ID NO: 3607 | mm21740_Slc46a2 | AGCCCAGGACTAAATCGATG |
| SEQ ID NO: 3608 | mm21741_Slc46a2 | GGAGTAGTCCTGCGTCGTAG |
| SEQ ID NO: 3609 | mm21890_Ero1l | CTGAAGGAGAAGGCCCACGA |
| SEQ ID NO: 3610 | mm21891_Ero1l | CTTGCTCACATTCTTCAATG |
| SEQ ID NO: 3611 | mm21892_Ero1l | CTTAACCCTGAGCGCTACAC |
| SEQ ID NO: 3612 | mm21893_Ero1l | AAAGGCCTTTGAATTGTCTG |
| SEQ ID NO: 3613 | mm21902_Mfap5 | GACAGACTGGCTACCCCTAG |
| SEQ ID NO: 3614 | mm21903_Mfap5 | GTCACCTGTATCGTCTGTAG |
| SEQ ID NO: 3615 | mm21904_Mfap5 | ACACCTTCCACAGATGACCT |
| SEQ ID NO: 3616 | mm21905_Mfap5 | CAAGACTGTACTCTGTCCAT |
| SEQ ID NO: 3617 | mm21910_Elane | CCGGCCACCAACAATCTCTG |

TABLE 1-continued mmSurf sgRNA library sequences

| SEQ ID NO | id_gRNA Target | Sequence |
|---|---|---|
| SEQ ID NO: 3618 | mm21911_Elane | CTCACAGGCCGTTCACACAG |
| SEQ ID NO: 3619 | mm21912_Elane | GAACGACATTGTGATTATCC |
| SEQ ID NO: 3620 | mm21913_Elane | ATGACCTCCACGCCTCTGCA |
| SEQ ID NO: 3621 | mm21918_Postn | GTACTTCGCGCCGAGTAACG |
| SEQ ID NO: 3622 | mm21919_Postn | CTGGCTATATGAGAATGGAA |
| SEQ ID NO: 3623 | mm21920_Postn | GGCCTTAGCGACCTCTACAA |
| SEQ ID NO: 3624 | mm21921_Postn | TTAACCAAGGACCTGAAACA |
| SEQ ID NO: 3625 | mm21922_Hist1h1c | GGCCGCCAAGAAGCCCGCCG |
| SEQ ID NO: 3626 | mm21923_Hist1h1c | GGGCATCCTGGTGCAAACCA |
| SEQ ID NO: 3627 | mm21924_Hist1h1c | GCAGGCGCCTTCTCCGCAGG |
| SEQ ID NO: 3628 | mm21925_Hist1h1c | TTCTGGCGAGGCCAAACCCC |
| SEQ ID NO: 3629 | mm21926_Hist1h1e | CTTGACGGGTGTCTTCTCGG |
| SEQ ID NO: 3630 | mm21927_Hist1h1e | GTGATGAGTTCGGACACCGG |
| SEQ ID NO: 3631 | mm21928_Hist1h1e | AGAAGCCCAAGAAGGCTGCG |
| SEQ ID NO: 3632 | mm21929_Hist1h1e | GGCTAAGCCCAAAGCAAAAA |
| SEQ ID NO: 3633 | mm21938_Icosl | GGACAATAGCCTAATAGACA |
| SEQ ID NO: 3634 | mm21939_Icosl | AGAGACTGAAGTCGGTGCAA |
| SEQ ID NO: 3635 | mm21940_Icosl | TGGCTGTATTCATAAATACC |
| SEQ ID NO: 3636 | mm21941_Icosl | TCCCTGGACTCCATGAAGCA |
| SEQ ID NO: 3637 | mm21978_Tfr2 | GAGGTCGCTCCAGTACAACG |
| SEQ ID NO: 3638 | mm21979_Tfr2 | AGTGCGTGTCAGTCCACACG |
| SEQ ID NO: 3639 | mm21980_Tfr2 | TGGTGTACGCCCACTACGGG |
| SEQ ID NO: 3640 | mm21981_Tfr2 | ACCCCCAGTGAAGATTAGCA |
| SEQ ID NO: 3641 | mm21982_Crim1 | TGGCCATCATCATAAGAACG |
| SEQ ID NO: 3642 | mm21983_Crim1 | GAGAGAACCGCACTTCACAG |
| SEQ ID NO: 3643 | mm21984_Crim1 | ACAGCTACGAAACGCAAGTG |
| SEQ ID NO: 3644 | mm21985_Crim1 | AGGTGGATCAATCGTGATGT |
| SEQ ID NO: 3645 | mm22030_Dkk3 | CGGAGTCCAAGTGACCGTCG |
| SEQ ID NO: 3646 | mm22031_Dkk3 | CTATCACAATGAGACCAGCA |
| SEQ ID NO: 3647 | mm22032_Dkk3 | GCTCAATGAGATGTTTCGAG |
| SEQ ID NO: 3648 | mm22033_Dkk3 | TAGATAACCAACAACCAGAG |
| SEQ ID NO: 3649 | mm22042_Ppap2c | CATGCAATACATGCCAAAGG |
| SEQ ID NO: 3650 | mm22043_Ppap2c | AGTTGGATCGCGAATAAAGA |
| SEQ ID NO: 3651 | mm22044_Ppap2c | CAGCCCTGCTAATGTCACGG |
| SEQ ID NO: 3652 | mm22045_Ppap2c | CATAGCCAGAACAGTTGACC |
| SEQ ID NO: 3653 | mm22046_Hs6st1 | GGCGCACGTTCTGCACTAGG |
| SEQ ID NO: 3654 | mm22047_Hs6st1 | ATGGCGACATGTACAGCGTG |
| SEQ ID NO: 3655 | mm22048_Hs6st1 | CTCATCCTTTACCAGTACGC |

TABLE 1-continued mmSurf sgRNA library sequences

| SEQ ID NO | id_gRNA Target | Sequence |
|---|---|---|
| SEQ ID NO: 3656 | mm22049_Hs6st1 | CCTATAACCTGGCTAACAAC |
| SEQ ID NO: 3657 | mm22050_Hs6st2 | GCGGTACGGATCCGGCACCG |
| SEQ ID NO: 3658 | mm22051_Hs6st2 | GGGTATAGTAAGGATAGATG |
| SEQ ID NO: 3659 | mm22052_Hs6st2 | CCGCCGGCATTCCAGAGTAG |
| SEQ ID NO: 3660 | mm22053_Hs6st2 | GCAGCCATGTGAGTGCCGCG |
| SEQ ID NO: 3661 | mm22154_Il17rb | GGAACTCGTCAAGACAAGTG |
| SEQ ID NO: 3662 | mm22155_Il17rb | TTCAACGGGACACGACATTG |
| SEQ ID NO: 3663 | mm22156_Il17rb | GCACAACTGTCCCTTCGCGT |
| SEQ ID NO: 3664 | mm22157_Il17rb | CTCCACAGGGAAGCCTACAT |
| SEQ ID NO: 3665 | mm22222_Il27ra | CAGTCACTGTAATTCGATAG |
| SEQ ID NO: 3666 | mm22223_Il27ra | TGCTCACTCCCACGTCACAG |
| SEQ ID NO: 3667 | mm22224_Il27ra | TCCCCGGGAACAGTTCACCA |
| SEQ ID NO: 3668 | mm22225_Il27ra | CCAGACGCCATTCTTAGGTG |
| SEQ ID NO: 3669 | mm22298_Ramp1 | AGCAGCCAGAGGCCGCACCG |
| SEQ ID NO: 3670 | mm22299_Ramp1 | GGATGAGAGTCCCATAGTCA |
| SEQ ID NO: 3671 | mm22300_Ramp1 | GAAGACGCTATGGTGTGACT |
| SEQ ID NO: 3672 | mm22301_Ramp1 | TTTCTGGCCCAATCCGGAAG |
| SEQ ID NO: 3673 | mm22302_Hnrnpu | AACGGCAGTCTCGACCTAGG |
| SEQ ID NO: 3674 | mm22303_Hnrnpu | AGTTATGGCAGAGAACATGT |
| SEQ ID NO: 3675 | mm22304_Hnrnpu | AGGAGCTGGAAAAACTACCT |
| SEQ ID NO: 3676 | mm22305_Hnrnpu | CGTCACCGCGAAGAGCGAGG |
| SEQ ID NO: 3677 | mm22370_Umodl1 | TGAACTGTCTGTAACAACGA |
| SEQ ID NO: 3678 | mm22371_Umodl1 | GTGCCACACAACATAGCCCG |
| SEQ ID NO: 3679 | mm22372_Umodl1 | GGTCCCGGGAGTTTGCATCG |
| SEQ ID NO: 3680 | mm22373_Umodl1 | CCCGAGGAGAGACCAATGTG |
| SEQ ID NO: 3681 | mm22414_Pvr | AGGTCAGGGTCAAGTTAGTG |
| SEQ ID NO: 3682 | mm22415_Pvr | AACTTAAGTGTAGAAGACGA |
| SEQ ID NO: 3683 | mm22416_Pvr | GAAGACAGCCACAAGAGCGT |
| SEQ ID NO: 3684 | mm22417_Pvr | GCTAAATGCATCTCTGCCAA |
| SEQ ID NO: 3685 | mm22418_Hgsnat | CCTGCAGGTTAACTCCACCT |
| SEQ ID NO: 3686 | mm22419_Hgsnat | ATGACTTCTATCCTGCAACG |
| SEQ ID NO: 3687 | mm22420_Hgsnat | GATGTGTGGACACATTTAGG |
| SEQ ID NO: 3688 | mm22421_Hgsnat | GTTGGGAGTGACATACTTCG |
| SEQ ID NO: 3689 | mm22498_Rcn3 | GCAGCGGCACATCCGTGACT |
| SEQ ID NO: 3690 | mm22499_Rcn3 | ATTTGACAAACTCAGCCCAG |
| SEQ ID NO: 3691 | mm22500_Rcn3 | ACCGGGCTCATAATGGCCAT |
| SEQ ID NO: 3692 | mm22501_Rcn3 | TTCCGGGTAGCCGACCAAGA |
| SEQ ID NO: 3693 | mm22542_Slc46a1 | AGAGCTAACATCTGCCACAG |

TABLE 1-continued mmSurf sgRNA library sequences

| SEQ ID NO | id_gRNA Target | Sequence |
|---|---|---|
| SEQ ID NO: 3694 | mm22543_Slc46a1 | GGGCAATGGATCGATGATGG |
| SEQ ID NO: 3695 | mm22544_Slc46a1 | TGGACCAGAAGAGTCCCACC |
| SEQ ID NO: 3696 | mm22545_Slc46a1 | GAACTGTGGGAACCAAAGCG |
| SEQ ID NO: 3697 | mm22578_Acaa2 | GCCCACGATGACACTATCGA |
| SEQ ID NO: 3698 | mm22579_Acaa2 | GCTGAGGTCGTCTTGTGTGG |
| SEQ ID NO: 3699 | mm22580_Acaa2 | CGAGGCTGGCTACTTCAATG |
| SEQ ID NO: 3700 | mm22581_Acaa2 | CGTCCGTGTTCAAGAAAGAC |
| SEQ ID NO: 3701 | mm22606_Tspan14 | GGGGTCGATTCCATGCAACC |
| SEQ ID NO: 3702 | mm22607_Tspan14 | CAGGTCGATGTCATCCCGAT |
| SEQ ID NO: 3703 | mm22608_Tspan14 | TAATTTCAGAATCAGTGCTG |
| SEQ ID NO: 3704 | mm22609_Tspan14 | TTGGAATAAAAGGCCAACA |
| SEQ ID NO: 3705 | mm22618_Adgre4 | ATGAGACTTGATACCTCATG |
| SEQ ID NO: 3706 | mm22619_Adgre4 | TAGTGGAGCCATTCGCTCAG |
| SEQ ID NO: 3707 | mm22620_Adgre4 | TAGACTTACCATAACAATCA |
| SEQ ID NO: 3708 | mm22621_Adgre4 | AGCTGGCAACAACACAATGA |
| SEQ ID NO: 3709 | mm22770_Lair1 | CAAGTCTTATGATCTCCCAA |
| SEQ ID NO: 3710 | mm22771_Lair1 | TAAACACGACTTGTATAACA |
| SEQ ID NO: 3711 | mm22772_Lair1 | GTCCGAACGTAGTAAGACGC |
| SEQ ID NO: 3712 | mm22773_Lair1 | ACAGCTATAATGTCCAGTAA |
| SEQ ID NO: 3713 | mm22826_Atp2a3 | CACGGAGCCAGGATCCACCG |
| SEQ ID NO: 3714 | mm22827_Atp2a3 | CCAGCGCAGAATCATTGCAG |
| SEQ ID NO: 3715 | mm22828_Atp2a3 | ACCTTGGGGTCAGCACGAGT |
| SEQ ID NO: 3716 | mm22829_Atp2a3 | CTGACCGCAAGGGTGTACAG |
| SEQ ID NO: 3717 | mm22850_Folh1 | GCAAATGCACCATACCAAAG |
| SEQ ID NO: 3718 | mm22851_Folh1 | TCTGGATAGGACTTCACCGC |
| SEQ ID NO: 3719 | mm22852_Folh1 | ATTAAAAGTGCCTTACAACG |
| SEQ ID NO: 3720 | mm22853_Folh1 | AGGACAGCAAGACATCGTAA |
| SEQ ID NO: 3721 | mm22854_Cntnap1 | GCTCCACTCTCACGTAAGGT |
| SEQ ID NO: 3722 | mm22855_Cntnap1 | TTCCTACAGATATTCATCGG |
| SEQ ID NO: 3723 | mm22856_Cntnap1 | AGAAGTATGAAGTCCCTGTG |
| SEQ ID NO: 3724 | mm22857_Cntnap1 | GAGGAACAGCATTTCTACTG |
| SEQ ID NO: 3725 | mm22866_Nptx2 | CTCTATCAGCACAATCTCGT |
| SEQ ID NO: 3726 | mm22867_Nptx2 | GCTGCCGAGCGACTTCCGAG |
| SEQ ID NO: 3727 | mm22868_Nptx2 | GTAGTTTGTACGGAGAGGAA |
| SEQ ID NO: 3728 | mm22869_Nptx2 | GCAACGCGGTGCACACGAAG |
| SEQ ID NO: 3729 | mm22962_Corin | GGATATGTTGATAGCAACTG |
| SEQ ID NO: 3730 | mm22963_Corin | CCTGGAACTTGGACCCGGAG |
| SEQ ID NO: 3731 | mm22964_Corin | CACTGCTGTTAGTCTCAGTG |

TABLE 1-continued mmSurf sgRNA library sequences

| SEQ ID NO | id_gRNA Target | Sequence |
|---|---|---|
| SEQ ID NO: 3732 | mm22965_Corin | ACAGTTTATTATGAGAACAC |
| SEQ ID NO: 3733 | mm22986_Cd164 | CAAGTCAGTGCGGTTCACCT |
| SEQ ID NO: 3734 | mm22987_Cd164 | TTGCGTCGTCGGGACCACTT |
| SEQ ID NO: 3735 | mm22988_Cd164 | GGTCGGCACCTCGGTCACGT |
| SEQ ID NO: 3736 | mm22989_Cd164 | TTGGCAATGTAACCAAAAGC |
| SEQ ID NO: 3737 | mm23038_Reck | CAATAGTAAAGGATGTTCCG |
| SEQ ID NO: 3738 | mm23039_Reck | AGTGCAATTTGGCCCCGTCG |
| SEQ ID NO: 3739 | mm23040_Reck | CTGACTTCATCGTCCGCCAG |
| SEQ ID NO: 3740 | mm23041_Reck | TTACTGAGGTACGTGTCCAG |
| SEQ ID NO: 3741 | mm23054_Vamp5 | CATGCTCAACAATTTCGACA |
| SEQ ID NO: 3742 | mm23055_Vamp5 | GGAGCGTCACGGCAAGCTGG |
| SEQ ID NO: 3743 | mm23056_Vamp5 | TTTAGCCCAGCAGAAGCGCT |
| SEQ ID NO: 3744 | mm23057_Vamp5 | ATCGGTCACACACCATGTCC |
| SEQ ID NO: 3745 | mm23062_Gria3 | TGTGACGAAAGATGTATGCA |
| SEQ ID NO: 3746 | mm23063_Gria3 | GTACAATGTCAGTAAAACCC |
| SEQ ID NO: 3747 | mm23064_Gria3 | TACCTCTATGACACAGAACG |
| SEQ ID NO: 3748 | mm23065_Gria3 | AGGAATCCAAGTGGTCTACG |
| SEQ ID NO: 3749 | mm23070_B3gnt2 | TGGGGCCGAGAAACCAACGT |
| SEQ ID NO: 3750 | mm23071_B3gnt2 | ACAGGGTGGCCAATCAGACA |
| SEQ ID NO: 3751 | mm23072_B3gnt2 | CAAACTTAAGCATGTCCGAA |
| SEQ ID NO: 3752 | mm23073_B3gnt2 | CTTTATCGCCAATAGTAAGA |
| SEQ ID NO: 3753 | mm23122_Rab11a | GAGTGATTTACGTCATCTCA |
| SEQ ID NO: 3754 | mm23123_Rab11a | AGATACTATCGTGGAGCAGT |
| SEQ ID NO: 3755 | mm23124_Rab11a | TGTTGCAAACTCTACTCCAA |
| SEQ ID NO: 3756 | mm23125_Rab11a | CCACGGCCTCACCTTTAAAG |
| SEQ ID NO: 3757 | mm23126_Cntn6 | TATCACTATAGGTTGGATGG |
| SEQ ID NO: 3758 | mm23127_Cntn6 | TGGTGGGTCATGAGACACT |
| SEQ ID NO: 3759 | mm23128_Cntn6 | GTGCGCAGCACTAAAGGCGT |
| SEQ ID NO: 3760 | mm23129_Cntn6 | AATCCCAAGTTCCAACAAG |
| SEQ ID NO: 3761 | mm23142_Slc5a3 | CCCCTGACCGGATGTAAATG |
| SEQ ID NO: 3762 | mm23143_Slc5a3 | CTGACCAAGTCATCGTACAG |
| SEQ ID NO: 3763 | mm23144_Slc5a3 | GAACACTGCATGCAAGTGTG |
| SEQ ID NO: 3764 | mm23145_Slc5a3 | CTGTGTAGATCACTGCAACA |
| SEQ ID NO: 3765 | mm23146_Celsr2 | GTACACCGTTCGGCTCAACG |
| SEQ ID NO: 3766 | mm23147_Celsr2 | CTGACGTACAGCTTCGAGCG |
| SEQ ID NO: 3767 | mm23148_Celsr2 | CGGGCATTGTGCGCACACTG |
| SEQ ID NO: 3768 | mm23149_Celsr2 | CGGCACAAACGGAGACACGG |
| SEQ ID NO: 3769 | mm23218_Lpar2 | TTTCTATAATAACAGCGGCA |

TABLE 1-continued mmSurf sgRNA library sequences

| SEQ ID NO | id_gRNA Target | Sequence |
|---|---|---|
| SEQ ID NO: 3770 | mm23219_Lpar2 | GTGGGCCAGTATGGAACATG |
| SEQ ID NO: 3771 | mm23220_Lpar2 | AGTGTGACCACACGGCCCCG |
| SEQ ID NO: 3772 | mm23221_Lpar2 | GTGTGGCCACTGACGCCGTG |
| SEQ ID NO: 3773 | mm23330_Icos | TGGTCTTGGTGAGTTCGCAG |
| SEQ ID NO: 3774 | mm23331_Icos | TATGCAAATATCCTCCACTA |
| SEQ ID NO: 3775 | mm23332_Icos | GCAGAAGTAATAGCTTCCCT |
| SEQ ID NO: 3776 | mm23333_Icos | AAATGAAAACATCCTATGAT |
| SEQ ID NO: 3777 | mm23414_Cd320 | TGGTCTCAGAACAGGCCTAG |
| SEQ ID NO: 3778 | mm23415_Cd320 | GCAACCACTGATGTTGTCAC |
| SEQ ID NO: 3779 | mm23416_Cd320 | CCATCACAGCGCCACGTGTG |
| SEQ ID NO: 3780 | mm23417_Cd320 | ACCTTCCAGTGTCTTACCAG |
| SEQ ID NO: 3781 | mm23430_Slc23a2 | CTGGCATCCCCGAATCCAAG |
| SEQ ID NO: 3782 | mm23431_Slc23a2 | GTGTTTCAGTGGCACGATCG |
| SEQ ID NO: 3783 | mm23432_Slc23a2 | ACAGGCGTAGTAGTCACCGA |
| SEQ ID NO: 3784 | mm23433_Slc23a2 | GCGTGCATAGTAGCCATAGT |
| SEQ ID NO: 3785 | mm23474_Gp9 | GGGGCAAGCCTGAGTATCTG |
| SEQ ID NO: 3786 | mm23475_Gp9 | GCATTAGGGCCTCGGGCATG |
| SEQ ID NO: 3787 | mm23476_Gp9 | TGGATGTGACACACAACCCC |
| SEQ ID NO: 3788 | mm23477_Gp9 | AGCCTGCGTTCAGTGCCACC |
| SEQ ID NO: 3789 | mm23482_Chst2 | GTGTCGCAAGTACCGCACGC |
| SEQ ID NO: 3790 | mm23483_Chst2 | AAATACCTTCATCCCGAGCG |
| SEQ ID NO: 3791 | mm23484_Chst2 | GGAAAACCGAAAGATCGCAG |
| SEQ ID NO: 3792 | mm23485_Chst2 | TCCATGCGAGAGTGAGCGCG |
| SEQ ID NO: 3793 | mm23502_Cacng6 | ACTTCAAATTCTTCACCACG |
| SEQ ID NO: 3794 | mm23503_Cacng6 | GGCTTGACTCCGGAGCGAGA |
| SEQ ID NO: 3795 | mm23504_Cacng6 | AGGTGTGCATCAAGCGACTG |
| SEQ ID NO: 3796 | mm23505_Cacng6 | GCTGTTCTTGGGCACGACGC |
| SEQ ID NO: 3797 | mm23522_Mtmr7 | GCTGCCAATAATTATCAGGG |
| SEQ ID NO: 3798 | mm23523_Mtmr7 | TCAGAGAGATGTACACGTCG |
| SEQ ID NO: 3799 | mm23524_Mtmr7 | GCCACGGCACACATCATCGT |
| SEQ ID NO: 3800 | mm23525_Mtmr7 | AAGTGACTTCATTTATGTCG |
| SEQ ID NO: 3801 | mm23546_Gabbr1 | ACGGCGTGCAGTATACATCG |
| SEQ ID NO: 3802 | mm23547_Gabbr1 | AAGAGAAACTTACCGAACGT |
| SEQ ID NO: 3803 | mm23548_Gabbr1 | GGATGTGTCCGAAAGAACGT |
| SEQ ID NO: 3804 | mm23549_Gabbr1 | GTTCAGCATGACAATCTCCG |
| SEQ ID NO: 3805 | mm23582_Ramp2 | GAATCAATCTCATCCCACTG |
| SEQ ID NO: 3806 | mm23583_Ramp2 | TTGGTGTGACCCGCGCCCAG |
| SEQ ID NO: 3807 | mm23584_Ramp2 | ACCAAGCCGAGATCCACCCG |

TABLE 1-continued mmSurf sgRNA library sequences

| SEQ ID NO | id_gRNA Target | Sequence |
|---|---|---|
| SEQ ID NO: 3808 | mm23585_Ramp2 | CTCCGGAAGAGATTGGTTCA |
| SEQ ID NO: 3809 | mm23586_Atp6ap1 | GAGGATTTCACAGCATACGG |
| SEQ ID NO: 3810 | mm23587_Atp6ap1 | GATATGACCCTCATGTGTGT |
| SEQ ID NO: 3811 | mm23588_Atp6ap1 | TAGCTAGATCCACATGCAAG |
| SEQ ID NO: 3812 | mm23589_Atp6ap1 | GTGTCATTGTAACTCACAGG |
| SEQ ID NO: 3813 | mm23622_Asah2 | TCGGGCCTCAATATTACACA |
| SEQ ID NO: 3814 | mm23623_Asah2 | GTATGATTTCCCAACGACTG |
| SEQ ID NO: 3815 | mm23624_Asah2 | TAGTGACAATATGGGCTATG |
| SEQ ID NO: 3816 | mm23625_Asah2 | GCTCACACAAATCTTAAACC |
| SEQ ID NO: 3817 | mm23682_Nup210 | GAAGTCCAACACACGGACGT |
| SEQ ID NO: 3818 | mm23683_Nup210 | GTGCTGCTGGTAATTCCGGG |
| SEQ ID NO: 3819 | mm23684_Nup210 | CTCAAGATAGAGCTCACGGG |
| SEQ ID NO: 3820 | mm23685_Nup210 | TGCTAAGAATGTTCGCCCTG |
| SEQ ID NO: 3821 | mm23686_Calcrl | TGTAACAATCATCCACCTCA |
| SEQ ID NO: 3822 | mm23687_Calcrl | ATCCGGATAGTAATAGAACA |
| SEQ ID NO: 3823 | mm23688_Calcrl | TTACCTGCACACACTCATCG |
| SEQ ID NO: 3824 | mm23689_Calcrl | CACTAGAAACAAGATCATGA |
| SEQ ID NO: 3825 | mm23734_Extl3 | GCCCAAGCCTCGCGTCACAG |
| SEQ ID NO: 3826 | mm23735_Extl3 | TCAGACATAGCATGGACAAG |
| SEQ ID NO: 3827 | mm23736_Extl3 | CCACACAGTGCCCACTCAGT |
| SEQ ID NO: 3828 | mm23737_Extl3 | ATTGCGGAGGTATTTAGGTG |
| SEQ ID NO: 3829 | mm23762_Pdgfc | AGAGCCAGATCGATGGCAGG |
| SEQ ID NO: 3830 | mm23763_Pdgfc | CTGGCATGATAATACTGTAG |
| SEQ ID NO: 3831 | mm23764_Pdgfc | ATACCCAAGAAATATGGTGC |
| SEQ ID NO: 3832 | mm23765_Pdgfc | CCCTGGCCGGCCAAAGAACG |
| SEQ ID NO: 3833 | mm23838_Plxnc1 | AATATCACCATGATCCTGCG |
| SEQ ID NO: 3834 | mm23839_Plxnc1 | CAGATTTACAGGGTACCGAG |
| SEQ ID NO: 3835 | mm23840_Plxnc1 | TATCCCTACAACTACACGAG |
| SEQ ID NO: 3836 | mm23841_Plxnc1 | GGTGTGGTGTACCGCGCGAG |
| SEQ ID NO: 3837 | mm23862_Cadm1 | ATATCGATCATCAAGTTACG |
| SEQ ID NO: 3838 | mm23863_Cadm1 | AGCCAGCGACGACCATCAGG |
| SEQ ID NO: 3839 | mm23864_Cadm1 | GCCGCGGCACTGATCCCCAC |
| SEQ ID NO: 3840 | mm23865_Cadm1 | ACTGACGAATGTCTCAATCT |
| SEQ ID NO: 3841 | mm23938_Slc1a4 | GTCTGCAACCGATTACACAG |
| SEQ ID NO: 3842 | mm23939_Slc1a4 | TAGAGCCACTCCTAACACCA |
| SEQ ID NO: 3843 | mm23940_Slc1a4 | GATGCCACCCAGACGCCCGA |
| SEQ ID NO: 3844 | mm23941_Slc1a4 | ACCCACCAACACTCCCGACA |
| SEQ ID NO: 3845 | mm23990_Panx1 | CCACTTCAAGTACCCAATCG |

TABLE 1-continued mmSurf sgRNA library sequences

| SEQ ID NO | id_gRNA Target | Sequence |
|---|---|---|
| SEQ ID NO: 3846 | mm23991_Panx1 | ACTCGTCCGAGAGTGAAGAG |
| SEQ ID NO: 3847 | mm23992_Panx1 | GCTTGCACTGGAAGCGATCG |
| SEQ ID NO: 3848 | mm23993_Panx1 | GATGGTCACATGTATTGCCG |
| SEQ ID NO: 3849 | mm24030_Slc2a8 | CCTGCGCCTCGGAGACAATG |
| SEQ ID NO: 3850 | mm24031_Slc2a8 | ACAGCAAAGCCAGTCACGAA |
| SEQ ID NO: 3851 | mm24032_Slc2a8 | GATTATGCCCACAGTGACCG |
| SEQ ID NO: 3852 | mm24033_Slc2a8 | TTGAGTGAGGAGAAAACGTG |
| SEQ ID NO: 3853 | mm24038_Tmem131 | ACAGATCACAACCGACTACG |
| SEQ ID NO: 3854 | mm24039_Tmem131 | GTATGGGCCTGCAATTACCC |
| SEQ ID NO: 3855 | mm24040_Tmem131 | CTGGATGTGAAACAGCGTGG |
| SEQ ID NO: 3856 | mm24041_Tmem131 | GTCGTAGAGATGTACTCGAG |
| SEQ ID NO: 3857 | mm24066_Rala | TCGACATCTTAGATACAGCG |
| SEQ ID NO: 3858 | mm24067_Rala | TCTGCAGTTCATGTACGACG |
| SEQ ID NO: 3859 | mm24068_Rala | CTTACACAAAGTCATCATGG |
| SEQ ID NO: 3860 | mm24069_Rala | CAACTACTTCCGAAGTGGGG |
| SEQ ID NO: 3861 | mm24078_Msln | TCCTAGGCACCTCACCGACG |
| SEQ ID NO: 3862 | mm24079_Msln | TGGATAGCCCCCCATCGAAG |
| SEQ ID NO: 3863 | mm24080_Msln | CATACACCCAAGGTTCCGAC |
| SEQ ID NO: 3864 | mm24081_Msln | CCAATGTGGATGTACTCCCA |
| SEQ ID NO: 3865 | mm24122_Astn2 | GGAGCCCTCGGAGATCGTTG |
| SEQ ID NO: 3866 | mm24123_Astn2 | GATGTCGCTTTCCCGCAGAG |
| SEQ ID NO: 3867 | mm24124_Astn2 | GAGGTGGTATCATAGGGCAA |
| SEQ ID NO: 3868 | mm24125_Astn2 | TCAGGTATGATGAGGCCATG |
| SEQ ID NO: 3869 | mm24142_Ramp3 | GCTTCATCACTGGAATCCAC |
| SEQ ID NO: 3870 | mm24143_Ramp3 | GAGATGGAGACCAACATCAT |
| SEQ ID NO: 3871 | mm24144_Ramp3 | CTTCTGCATCATGTCAGCGA |
| SEQ ID NO: 3872 | mm24145_Ramp3 | CTGGAAGTGGTGCAACCTGT |
| SEQ ID NO: 3873 | mm24182_Bace2 | ACACCTACTTTGACTCAGAG |
| SEQ ID NO: 3874 | mm24183_Bace2 | GTTTCAGTATAACGCAGACA |
| SEQ ID NO: 3875 | mm24184_Bace2 | AGGGCCAGACCATCGGCCCG |
| SEQ ID NO: 3876 | mm24185_Bace2 | TACCAACGGAGGTAGTCTTG |
| SEQ ID NO: 3877 | mm24190_Olfm1 | ACCTGGCCCGTACCTGACCA |
| SEQ ID NO: 3878 | mm24191_Olfm1 | ACTTGTACTCACGGACGAAG |
| SEQ ID NO: 3879 | mm24192_Olfm1 | CTGCAATACCAATTTGGCAT |
| SEQ ID NO: 3880 | mm24193_Olfm1 | GTATTGAGGCCCACCAGCGA |
| SEQ ID NO: 3881 | mm24330_Thsd1 | GATGCCGGTGACGGACCTAG |
| SEQ ID NO: 3882 | mm24331_Thsd1 | TCAGGGGCTTTGAGATACG |
| SEQ ID NO: 3883 | mm24332_Thsd1 | ACAACGTGGTGACCGTCACA |

TABLE 1-continued mmSurf sgRNA library sequences

| SEQ ID NO | id_gRNA Target | Sequence |
|---|---|---|
| SEQ ID NO: 3884 | mm24333_Thsd1 | AGAAGCCCCCAAACGCCCGG |
| SEQ ID NO: 3885 | mm24350_Cpxm1 | CTGACCTCAACACACAACTG |
| SEQ ID NO: 3886 | mm24351_Cpxm1 | ATAGCCATCAGGATTCATGG |
| SEQ ID NO: 3887 | mm24352_Cpxm1 | TCCTAATGACCTGTTCCCTG |
| SEQ ID NO: 3888 | mm24353_Cpxm1 | GGAAATGTCAGACCATCCTG |
| SEQ ID NO: 3889 | mm24778_Tspan3 | TCCTACAGCTATGATCACCA |
| SEQ ID NO: 3890 | mm24779_Tspan3 | AATTCATAACTATTCAGACT |
| SEQ ID NO: 3891 | mm24780_Tspan3 | TCTGCACATAGTCAATAGCA |
| SEQ ID NO: 3892 | mm24781_Tspan3 | TTACCGTGGCAAGTCCACAG |
| SEQ ID NO: 3893 | mm24838_Mbtps1 | GAACGAAAGACTTTCCGCTG |
| SEQ ID NO: 3894 | mm24839_Mbtps1 | ATGGCAAGGTAACCTGACCA |
| SEQ ID NO: 3895 | mm24840_Mbtps1 | TGTTTATAGGAATTACCAGG |
| SEQ ID NO: 3896 | mm24841_Mbtps1 | TGACTGAGTGTCCCTACATG |
| SEQ ID NO: 3897 | mm24854_Clptm1 | TGGCCAGACTCTCATTAATG |
| SEQ ID NO: 3898 | mm24855_Clptm1 | AGTGCGAGATTACTTCTACA |
| SEQ ID NO: 3899 | mm24856_Clptm1 | GGTTTCGGCTGGCGACACGT |
| SEQ ID NO: 3900 | mm24857_Clptm1 | GATGTAAAGGAGAACCACAA |
| SEQ ID NO: 3901 | mm24882_Ctsf | ACAATTACGGCCGTGCTGCG |
| SEQ ID NO: 3902 | mm24883_Ctsf | AAAGACAGTCAATCGCCACT |
| SEQ ID NO: 3903 | mm24884_Ctsf | ACCAGGGGATCATTGCAAGG |
| SEQ ID NO: 3904 | mm24885_Ctsf | CCTGAATCCCTCTTACAGA |
| SEQ ID NO: 3905 | mm24950_Tspan6 | TCTGAAAACAAATCCAACAA |
| SEQ ID NO: 3906 | mm24951_Tspan6 | AATGAGCACAAAAGGCACAT |
| SEQ ID NO: 3907 | mm24952_Tspan6 | CCCAAATGCCAACGGCAAGA |
| SEQ ID NO: 3908 | mm24953_Tspan6 | TTCACTTCTATAGTCTCCTG |
| SEQ ID NO: 3909 | mm24990_Slc22a21 | GGGACATATATCCAACTACG |
| SEQ ID NO: 3910 | mm24991_Slc22a21 | ACAACCCAGTAAAGCCATTG |
| SEQ ID NO: 3911 | mm24992_Slc22a21 | TTCGGACCAGATCATAAATG |
| SEQ ID NO: 3912 | mm24993_Slc22a21 | GAAGCTGAATCCGGTGTGCA |
| SEQ ID NO: 3913 | mm25018_Sept6 | CTTAAGCGAATGTCCTGTCG |
| SEQ ID NO: 3914 | mm25019_Sept6 | CCGCTATGCAGTTGAAAACG |
| SEQ ID NO: 3915 | mm25020_Sept6 | AACAACAGCAAACGGCAGGT |
| SEQ ID NO: 3916 | mm25021_Sept6 | TTCAAACTTGGTGTTAAACA |
| SEQ ID NO: 3917 | mm25090_Raet1d | AGATGAAGTGAAGTGCTTCG |
| SEQ ID NO: 3918 | mm25091_Raet1d | GAACTCACCATCTAGCCCGT |
| SEQ ID NO: 3919 | mm25092_Raet1d | TCTACACAGAGATTATGAGC |
| SEQ ID NO: 3920 | mm25093_Raet1d | CAGCAAATGCCACTGAAGTG |
| SEQ ID NO: 3921 | mm25154_Slc15a1 | TTGTCCAATCGTGTAGACGA |

TABLE 1-continued mmSurf sgRNA library sequences

| SEQ ID NO | id_gRNA Target | Sequence |
|---|---|---|
| SEQ ID NO: 3922 | mm25155_Slc15a1 | GAAGTAAGGCATATCCCAAG |
| SEQ ID NO: 3923 | mm25156_Slc15a1 | CCACCAAACGCAGACACACA |
| SEQ ID NO: 3924 | mm25157_Slc15a1 | CTGGGACGACAATCTCTCCA |
| SEQ ID NO: 3925 | mm25174_Crtap | CACGCGCTCGACCAGTACAG |
| SEQ ID NO: 3926 | mm25175_Crtap | CTTGGAAACCAAGTCGTACG |
| SEQ ID NO: 3927 | mm25176_Crtap | CGAAGAGGCGTAGTTCGGCG |
| SEQ ID NO: 3928 | mm25177_Crtap | GAGAACGTCCATTTCCGACA |
| SEQ ID NO: 3929 | mm25286_Igdcc4 | CTGTACGCTTCGGCCCCTGG |
| SEQ ID NO: 3930 | mm25287_Igdcc4 | CACGCGTGATTTCGCCACTG |
| SEQ ID NO: 3931 | mm25288_Igdcc4 | ACAAGATAGAGTACGGTTTG |
| SEQ ID NO: 3932 | mm25289_Igdcc4 | ACTCTGTCCAGACACTACCG |
| SEQ ID NO: 3933 | mm25306_Tex101 | GCTCTTACTGGCCAAAACGA |
| SEQ ID NO: 3934 | mm25307_Tex101 | TTCTTCTAATCGCCTCACGT |
| SEQ ID NO: 3935 | mm25308_Tex101 | TGAGTTGTGCCATTGGCACA |
| SEQ ID NO: 3936 | mm25309_Tex101 | CCGCCACTGCCCGACATGTG |
| SEQ ID NO: 3937 | mm25310_Sez61 | GGTCCGACGTGAACTCAATG |
| SEQ ID NO: 3938 | mm25311_Sez61 | AGAGTGTCAACCTCTCCGAG |
| SEQ ID NO: 3939 | mm25312_Sez61 | AGATGAGCCTCGTATACCTG |
| SEQ ID NO: 3940 | mm25313_Sez61 | AGCAACTCAACTCGGCCCGG |
| SEQ ID NO: 3941 | mm25322_Tacstd2 | GGGCTCCTCATAGTGTACCG |
| SEQ ID NO: 3942 | mm25323_Tacstd2 | CGTCACACTCCGGGTCGTAG |
| SEQ ID NO: 3943 | mm25324_Tacstd2 | GTTTACGCACCAGCACACCG |
| SEQ ID NO: 3944 | mm25325_Tacstd2 | CTGACCTAGACTCCGAGCTG |
| SEQ ID NO: 3945 | mm25330_Clec1b | CTTCAGGCGTAACCTAACAT |
| SEQ ID NO: 3946 | mm25331_Clec1b | GCCACGAAGTGGAGATACCA |
| SEQ ID NO: 3947 | mm25332_Clec1b | ACAGCAAAAGTATCTACTGG |
| SEQ ID NO: 3948 | mm25333_Clec1b | CATCACACGCCACCAAGAAG |
| SEQ ID NO: 3949 | mm25354_Tmem9b | GTGGAGCCCATGCCTGTACG |
| SEQ ID NO: 3950 | mm25355_Tmem9b | TTCTTATTATAAATGTGCCC |
| SEQ ID NO: 3951 | mm25356_Tmem9b | GAGAAGCTCTGTCACAATCA |
| SEQ ID NO: 3952 | mm25357_Tmem9b | CACGACATGAAGGCAATCAC |
| SEQ ID NO: 3953 | mm25362_Scube2 | TGTGACAACACACTCAACGG |
| SEQ ID NO: 3954 | mm25363_Scube2 | ATCTGCAAGGAGGCCCCAAG |
| SEQ ID NO: 3955 | mm25364_Scube2 | TCAGCATGCAACCTATACCG |
| SEQ ID NO: 3956 | mm25365_Scube2 | ACAGACGAGAAGTCTTGCCA |
| SEQ ID NO: 3957 | mm25394_Cacna2d2 | GTAATAGCGAGTGACTCCCG |
| SEQ ID NO: 3958 | mm25395_Cacna2d2 | AGTGATTCGGAACTACACCT |
| SEQ ID NO: 3959 | mm25396_Cacna2d2 | AGCAGTTAGTGGAACGTGTG |

TABLE 1-continued mmSurf sgRNA library sequences

| SEQ ID NO | id_gRNA Target | Sequence |
|---|---|---|
| SEQ ID NO: 3960 | mm25397_Cacna2d2 | GTGTTCAAGGAAGCTGTGCA |
| SEQ ID NO: 3961 | mm25490_Htr3b | TATCAAGAGGCTCACAACGT |
| SEQ ID NO: 3962 | mm25491_Htr3b | GCAGAATGCTATTAAAGGTG |
| SEQ ID NO: 3963 | mm25492_Htr3b | TTACCACATCCAATACAGCA |
| SEQ ID NO: 3964 | mm25493_Htr3b | CTTACAACAGTACCACAAGG |
| SEQ ID NO: 3965 | mm25494_Pdxp | CTCGTCGTAGCCTACGAGCA |
| SEQ ID NO: 3966 | mm25495_Pdxp | CGGGTGCCAAGGGTCGCGAT |
| SEQ ID NO: 3967 | mm25496_Pdxp | TGTTCGTGAGCAACAACAGC |
| SEQ ID NO: 3968 | mm25497_Pdxp | TCGACTGCGACGGAGTGCTG |
| SEQ ID NO: 3969 | mm25502_Slc12a5 | CCAAGGGGTGATTGTCGAG |
| SEQ ID NO: 3970 | mm25503_Slc12a5 | AGCCATGGCGAGACAGCGTG |
| SEQ ID NO: 3971 | mm25504_Slc12a5 | TGGATTACAGAGCCTCACAG |
| SEQ ID NO: 3972 | mm25505_Slc12a5 | GCAGGATCTCGATCGTGCCA |
| SEQ ID NO: 3973 | mm25562_Xpo4 | AAGTAGTGGCAATCCCACTG |
| SEQ ID NO: 3974 | mm25563_Xpo4 | GTGTGCTAGATAATCAACCT |
| SEQ ID NO: 3975 | mm25564_Xpo4 | GCTGAACAGTGTCATTCGCG |
| SEQ ID NO: 3976 | mm25565_Xpo4 | GGAAGCGGTTGTCCGAGAGT |
| SEQ ID NO: 3977 | mm25630_Bcam | CGAGAGTCTACCTCGTATGG |
| SEQ ID NO: 3978 | mm25631_Bcam | ACCATGTGATCCGAGGCACG |
| SEQ ID NO: 3979 | mm25632_Bcam | GGAGGATTACGATGCCGACG |
| SEQ ID NO: 3980 | mm25633_Bcam | GTCCATCGCACAGTAGGAGT |
| SEQ ID NO: 3981 | mm25718_B4galt3 | GAAACTCCGCCAAAGTACTG |
| SEQ ID NO: 3982 | mm25719_B4galt3 | GGGCTAAAGGATACTGACAC |
| SEQ ID NO: 3983 | mm25720_B4galt3 | TGGAAATGGAACGTTTAACA |
| SEQ ID NO: 3984 | mm25721_B4galt3 | GAATAGTCGAATGTTGGGCC |
| SEQ ID NO: 3985 | mm25730_Mogs | TCTAGGTCATTCTTCCCACG |
| SEQ ID NO: 3986 | mm25731_Mogs | TCGGCAGCATATCCACGATG |
| SEQ ID NO: 3987 | mm25732_Mogs | TGCCGAAATAGACGTGTGGG |
| SEQ ID NO: 3988 | mm25733_Mogs | GAGGTCCTACTACCAGAGAT |
| SEQ ID NO: 3989 | mm25742_Tmem27 | GCTTTGCAACATAACCCAGA |
| SEQ ID NO: 3990 | mm25743_Tmem27 | TCCTGCAGCTGAAGTACAGT |
| SEQ ID NO: 3991 | mm25744_Tmem27 | CCGAATACAATAATCCAGAC |
| SEQ ID NO: 3992 | mm25745_Tmem27 | TTCAAGGCTACGTACCTGGA |
| SEQ ID NO: 3993 | mm25818_Slc15a2 | AGGAGGTATCAAACCCTGTG |
| SEQ ID NO: 3994 | mm25819_Slc15a2 | ACATTCCAAAGCGACAACAT |
| SEQ ID NO: 3995 | mm25820_Slc15a2 | TATCGGCTGATCTCCAAGTG |
| SEQ ID NO: 3996 | mm25821_Slc15a2 | CTGATGGACTCCACCAAGAG |
| SEQ ID NO: 3997 | mm25902_Cd200r1 | ACATGGATAATAAAGCTCAG |

TABLE 1-continued mmSurf sgRNA library sequences

| SEQ ID NO | id_gRNA Target | Sequence |
|---|---|---|
| SEQ ID NO: 3998 | mm25903_Cd200r1 | AGTTCATCTCCTCTGACACA |
| SEQ ID NO: 3999 | mm25904_Cd200r1 | GGTTACTTCAGGGGGCACTG |
| SEQ ID NO: 4000 | mm25905_Cd200r1 | TGTCAGGAGCACATGCCACT |
| SEQ ID NO: 4001 | mm25922_Rpl35a | AACAAAACCAGAGTGATCTG |
| SEQ ID NO: 4002 | mm25923_Rpl35a | TTGTCTTAGGCTGTGGTGCA |
| SEQ ID NO: 4003 | mm25924_Rpl35a | GATGAAACGGAGTTCTACTT |
| SEQ ID NO: 4004 | mm25925_Rpl35a | ACCAGCAATACAGTGACTCC |
| SEQ ID NO: 4005 | mm25926_Cdon | GAACAGATAAAGATTCATCG |
| SEQ ID NO: 4006 | mm25927_Cdon | ATCACAGGTAAAATGTACGG |
| SEQ ID NO: 4007 | mm25928_Cdon | CTATTTCGTGAAGTACCGAA |
| SEQ ID NO: 4008 | mm25929_Cdon | GGCTGGTTATCAATCCATGG |
| SEQ ID NO: 4009 | mm25962_Angptl4 | CCTGTGGTAACGCTTGTCAG |
| SEQ ID NO: 4010 | mm25963_Angptl4 | TCGTCCCAGGATGCAAAGCG |
| SEQ ID NO: 4011 | mm25964_Angptl4 | TCCATTGTCTAGGTGCGTGG |
| SEQ ID NO: 4012 | mm25965_Angptl4 | GCTTCGGAGATCCCCAAGGT |
| SEQ ID NO: 4013 | mm25998_Crlf2 | GGAAGTCATAGCAGCGTACG |
| SEQ ID NO: 4014 | mm25999_Crlf2 | CCCACACCACTCACGCCAGG |
| SEQ ID NO: 4015 | mm26000_Crlf2 | GCGCCGGACAGGAAATATCG |
| SEQ ID NO: 4016 | mm26001_Crlf2 | AGCGGTGACAAGGCTTTCCG |
| SEQ ID NO: 4017 | mm26006_Tnfrsf13b | GTACTACGACCATCTCCTGG |
| SEQ ID NO: 4018 | mm26007_Tnfrsf13b | GAAGTCAGGTCAGACAACTC |
| SEQ ID NO: 4019 | mm26008_Tnfrsf13b | GTGGCTCTCCTCTACGCCTG |
| SEQ ID NO: 4020 | mm26009_Tnfrsf13b | ATCAGTACTGGGACTCCTCA |
| SEQ ID NO: 4021 | mm26030_Klrc3 | TTTGTGCTGAAGATAGACTG |
| SEQ ID NO: 4022 | mm26031_Klrc3 | ACTGAAACGGAGCTGCGCCT |
| SEQ ID NO: 4023 | mm26032_Klrc3 | CAATTGTTATTACATTGGCA |
| SEQ ID NO: 4024 | mm26033_Klrc3 | AATCAATAAGGTAAACCAGA |
| SEQ ID NO: 4025 | mm26090_Pdcd1lg2 | CCCCGCAGATGACCAGGCAA |
| SEQ ID NO: 4026 | mm26091_Pdcd1lg2 | GATAGACACTAGGATCCTGG |
| SEQ ID NO: 4027 | mm26092_Pdcd1lg2 | CCAGTTCAGTGCATTCTCTG |
| SEQ ID NO: 4028 | mm26093_Pdcd1lg2 | CTAGGGGATAACCTCTAGCC |
| SEQ ID NO: 4029 | mm26098_Slc43a3 | TGACCGCTTCAAGACTACTG |
| SEQ ID NO: 4030 | mm26099_Slc43a3 | GATTCATCTTGCACGTGGTG |
| SEQ ID NO: 4031 | mm26100_Slc43a3 | TGCTCCAGAGCAATGTAACA |
| SEQ ID NO: 4032 | mm26101_Slc43a3 | TACCCATAGCTGTAGTTGGG |
| SEQ ID NO: 4033 | mm26162_Pyrl1 | TCCACTCGTTTCTCGTAGGG |
| SEQ ID NO: 4034 | mm26163_Pyrl1 | CAGGAAATTCGGAACCCCAA |
| SEQ ID NO: 4035 | mm26164_Pyrl1 | TCTGGGCCTCTACACCCTTG |

TABLE 1-continued mmSurf sgRNA library sequences

| SEQ ID NO | id_gRNA Target | Sequence |
|---|---|---|
| SEQ ID NO: 4036 | mm26165_Pyrl1 | CCGGGTGCCCTCAATCCAGT |
| SEQ ID NO: 4037 | mm26166_Nkain4 | ATACCGGCCACGCTACATCG |
| SEQ ID NO: 4038 | mm26167_Nkain4 | TGGGCCAGGCTGTCTTCACG |
| SEQ ID NO: 4039 | mm26168_Nkain4 | ACGATGCCCAGAGAGATTGA |
| SEQ ID NO: 4040 | mm26169_Nkain4 | TGGGTGCCCACTGGTAACCC |
| SEQ ID NO: 4041 | mm26206_Chst11 | AGCCAACGAAGCCCACGTGT |
| SEQ ID NO: 4042 | mm26207_Chst11 | GCAGACACCAGCCTCTCGAA |
| SEQ ID NO: 4043 | mm26208_Chst11 | AGCAGATGTCCACACCGAAG |
| SEQ ID NO: 4044 | mm26209_Chst11 | ACCTCCTTCCACAAGCGCTA |
| SEQ ID NO: 4045 | mm26262_Slco1c1 | GAAGACATAAACCCACATGG |
| SEQ ID NO: 4046 | mm26263_Slco1c1 | CCATATAACAATCACCCCAA |
| SEQ ID NO: 4047 | mm26264_Slco1c1 | AGCTAACAAACGTTATGACC |
| SEQ ID NO: 4048 | mm26265_Slco1c1 | GGGATGTGAAAATTCTAGTG |
| SEQ ID NO: 4049 | mm26318_Sumf1 | GCAGCCGCACGAGCCCGCAA |
| SEQ ID NO: 4050 | mm26319_Sumf1 | CTCGACTGGCTATTTGACAG |
| SEQ ID NO: 4051 | mm26320_Sumf1 | AGTGAAAACGCATATCCACC |
| SEQ ID NO: 4052 | mm26321_Sumf1 | AGCTAATTGGAGACACCCAG |
| SEQ ID NO: 4053 | mm26338_Pvrl3 | TTTCCCACAAGATTTGCTCG |
| SEQ ID NO: 4054 | mm26339_Pvrl3 | AAAGCCGTTACATTCCCACT |
| SEQ ID NO: 4055 | mm26340_Pvrl3 | CTTAGCTGGATCAATTATTG |
| SEQ ID NO: 4056 | mm26341_Pvrl3 | GCCAGTCGCACAGATTGACT |
| SEQ ID NO: 4057 | mm26386_Moxd1 | ACTACGATAATCCCGCACGG |
| SEQ ID NO: 4058 | mm26387_Moxd1 | GGTACGCACGAACGGCTACG |
| SEQ ID NO: 4059 | mm26388_Moxd1 | TCTTCCACACAATTCCCCCA |
| SEQ ID NO: 4060 | mm26389_Moxd1 | GAAACTGTGATTCTCGCCTG |
| SEQ ID NO: 4061 | mm26422_Usp14 | TATCAGATGGAATTGCCATG |
| SEQ ID NO: 4062 | mm26423_Usp14 | TCAGCACAGTATATTACTGC |
| SEQ ID NO: 4063 | mm26424_Usp14 | GAATACTGATGAACCTCCAA |
| SEQ ID NO: 4064 | mm26425_Usp14 | TTGAAATAGGATGATGACTG |
| SEQ ID NO: 4065 | mm26446_Chst12 | ATTGTATATTGGGACAACGT |
| SEQ ID NO: 4066 | mm26447_Chst12 | GATCATCACTCGCTTCCAGT |
| SEQ ID NO: 4067 | mm26448_Chst12 | AGAACGTGAGAGGCTACGAC |
| SEQ ID NO: 4068 | mm26449_Chst12 | GACGGGAGAACTTTCCGTAG |
| SEQ ID NO: 4069 | mm26514_Mettl9 | CTGTACGTGAACATGACTAG |
| SEQ ID NO: 4070 | mm26515_Mettl9 | ACAGCATTGAGAAATCTGGC |
| SEQ ID NO: 4071 | mm26516_Mettl9 | GAGTGCTTGGTATAAATGAA |
| SEQ ID NO: 4072 | mm26517_Mettl9 | ATCTGGTGAGAACACAAACA |
| SEQ ID NO: 4073 | mm26538_Tpm3 | CTGGATCCTGCGGTTCAAGG |

TABLE 1-continued mmSurf sgRNA library sequences

| SEQ ID NO | id_gRNA Target | Sequence |
|---|---|---|
| SEQ ID NO: 4074 | mm26539_Tpm3 | AGGAGACTTGGAACGCACGG |
| SEQ ID NO: 4075 | mm26540_Tpm3 | ACATTGCAGAAGAGGCCGAT |
| SEQ ID NO: 4076 | mm26541_Tpm3 | TGGGCTCTGGCTCCAGCTAG |
| SEQ ID NO: 4077 | mm26574_Ncstn | CCAGCAGAACCATGTAAGGG |
| SEQ ID NO: 4078 | mm26575_Ncstn | GTGCTATCAAGATCACAACC |
| SEQ ID NO: 4079 | mm26576_Ncstn | AGGGACAGAACTCACCCGTG |
| SEQ ID NO: 4080 | mm26577_Ncstn | GGTGACTCACCGATTGTGGA |
| SEQ ID NO: 4081 | mm26586_Gpa33 | TCTTACCGTGGAAACTACAC |
| SEQ ID NO: 4082 | mm26587_Gpa33 | CACCTATGTTTCAGACCGAG |
| SEQ ID NO: 4083 | mm26588_Gpa33 | CAGTGACACGGAGCACTCGT |
| SEQ ID NO: 4084 | mm26589_Gpa33 | GTAGTAACCCGCTGTCTCCG |
| SEQ ID NO: 4085 | mm26606_Chst7 | GAAACCCGGATCGATCCCCC |
| SEQ ID NO: 4086 | mm26607_Chst7 | TGACCTTGTTGGTCCGCCAG |
| SEQ ID NO: 4087 | mm26608_Chst7 | CGTACAAGTAGAAAACGTCC |
| SEQ ID NO: 4088 | mm26609_Chst7 | CGAGTGCCGCAAGTACCCGG |
| SEQ ID NO: 4089 | mm26662_Il21r | GCACGTGTACCATATATGTG |
| SEQ ID NO: 4090 | mm26663_Il21r | AGGACGCTATGATATCTCCT |
| SEQ ID NO: 4091 | mm26664_Il21r | GCCACCTCACCACAGCATAG |
| SEQ ID NO: 4092 | mm26665_Il21r | GGGCTGGAAGAAACTCTCAG |
| SEQ ID NO: 4093 | mm26698_Cd274 | TGCTGCATAATCAGCTACGG |
| SEQ ID NO: 4094 | mm26699_Cd274 | TCCAAAGGACTTGTACGTGG |
| SEQ ID NO: 4095 | mm26700_Cd274 | CTCAGCACAGCAACTTCAGG |
| SEQ ID NO: 4096 | mm26701_Cd274 | GCTTGCGTTAGTGGTGTACT |
| SEQ ID NO: 4097 | mm26754_Trpv4 | TCAGCACATCATCCGACGTG |
| SEQ ID NO: 4098 | mm26755_Trpv4 | GGTGTACAACAGCAAGATCG |
| SEQ ID NO: 4099 | mm26756_Trpv4 | CTCACAAGAAAGCTGACATG |
| SEQ ID NO: 4100 | mm26757_Trpv4 | CTACCCTTACCGGACCACAG |
| SEQ ID NO: 4101 | mm26778_Slc29a1 | GCTGATGCAGAAACGAGTTG |
| SEQ ID NO: 4102 | mm26779_Slc29a1 | GCATGATTGATCAGTGTCCG |
| SEQ ID NO: 4103 | mm26780_Slc29a1 | TACACAGCCCCCATCATGAG |
| SEQ ID NO: 4104 | mm26781_Slc29a1 | GGCCAAAATGACAACTGCAC |
| SEQ ID NO: 4105 | mm26814_Sv2a | GCGGTAATAGCCGTCCGCAG |
| SEQ ID NO: 4106 | mm26815_Sv2a | TGTGGACACTCACCCGACCC |
| SEQ ID NO: 4107 | mm26816_Sv2a | TGAGAAAGACATGTGCCTGT |
| SEQ ID NO: 4108 | mm26817_Sv2a | AGCCCCGATGGCAAACACAG |
| SEQ ID NO: 4109 | mm26830_Clstn2 | GAGCTGCAGACTAATTACAT |
| SEQ ID NO: 4110 | mm26831_Clstn2 | ATAGCCATGCAACTTACTGT |
| SEQ ID NO: 4111 | mm26832_Clstn2 | TGGATCGAGACATCGTATCA |

TABLE 1-continued mmSurf sgRNA library sequences

| SEQ ID NO | id_gRNA Target | Sequence |
|---|---|---|
| SEQ ID NO: 4112 | mm26833_Clstn2 | AGGGTGCCAAGATCCCTGAT |
| SEQ ID NO: 4113 | mm26854_Ctsz | TTGCTACCATCCCATTCGCG |
| SEQ ID NO: 4114 | mm26855_Ctsz | GGGCATACTCCCACACCGGA |
| SEQ ID NO: 4115 | mm26856_Ctsz | TGAGACCTGCAACAACTACC |
| SEQ ID NO: 4116 | mm26857_Ctsz | CAGACCGAATCAACATCAAG |
| SEQ ID NO: 4117 | mm26870_Sv2b | TTCTTATCACGAGAGAAACG |
| SEQ ID NO: 4118 | mm26871_Sv2b | ATACAAACATGAGAGCTAAG |
| SEQ ID NO: 4119 | mm26872_Sv2b | ATAGGGCTGATAGTCTACCT |
| SEQ ID NO: 4120 | mm26873_Sv2b | TTGCAGTTACTACGGCCTGA |
| SEQ ID NO: 4121 | mm26922_Gprc5b | TCGCACAGGGACACGTACTG |
| SEQ ID NO: 4122 | mm26923_Gprc5b | TGTGTGGCAAGTTCAAACGG |
| SEQ ID NO: 4123 | mm26924_Gprc5b | TCCATCCGACGCTTCCTCTG |
| SEQ ID NO: 4124 | mm26925_Gprc5b | AGCGCCATCACAAAATCCAT |
| SEQ ID NO: 4125 | mm26934_Fndc4 | TGCAGCGACAGAATGGCCCG |
| SEQ ID NO: 4126 | mm26935_Fndc4 | GTCACATTCACAGGAGAGGG |
| SEQ ID NO: 4127 | mm26936_Fndc4 | CTTCTTAGGTGATATTACAG |
| SEQ ID NO: 4128 | mm26937_Fndc4 | GTGTCCTGGGACGTTCCAGA |
| SEQ ID NO: 4129 | mm26990_Dip2a | AGGCGTGTAGGTCTCAACGG |
| SEQ ID NO: 4130 | mm26991_Dip2a | TGTGATCCGAGTTGACACTG |
| SEQ ID NO: 4131 | mm26992_Dip2a | ACATCAACACGTTACATGGG |
| SEQ ID NO: 4132 | mm26993_Dip2a | CATATCTCGGGACTTTACCA |
| SEQ ID NO: 4133 | mm27070_Scube1 | TGAGAATGACTACTACAACG |
| SEQ ID NO: 4134 | mm27071_Scube1 | GAGTGCTTGATGAATAACGG |
| SEQ ID NO: 4135 | mm27072_Scube1 | ACCAGAAGGACTGCACACGT |
| SEQ ID NO: 4136 | mm27073_Scube1 | CTCTACGGGACAACCCACTG |
| SEQ ID NO: 4137 | mm27078_Svep1 | ATTTCCTGTCGGGAATCACG |
| SEQ ID NO: 4138 | mm27079_Svep1 | AGAAAGCATAGTGCCCCTCG |
| SEQ ID NO: 4139 | mm27080_Svep1 | AACATCCAGGAAGTGATCGT |
| SEQ ID NO: 4140 | mm27081_Svep1 | CAAGGGATTCTATATCAAGG |
| SEQ ID NO: 4141 | mm27134_Rtn4r | ACACTGCACCTAGACCGATG |
| SEQ ID NO: 4142 | mm27135_Rtn4r | GCCGAAATCTCACTATCCTG |
| SEQ ID NO: 4143 | mm27136_Rtn4r | TGTGTGCTACAATGAGCCCA |
| SEQ ID NO: 4144 | mm27137_Rtn4r | CAGAGGTCCTAATGCCCCTG |
| SEQ ID NO: 4145 | mm27222_Clstn1 | TCCAAGTGTGACTCTCTACG |
| SEQ ID NO: 4146 | mm27223_Clstn1 | CCCAGACGTGCCGTTCACTG |
| SEQ ID NO: 4147 | mm27224_Clstn1 | AGTCACCGAGAACGATAACA |
| SEQ ID NO: 4148 | mm27225_Clstn1 | CAACGAGGCGGCTTGCATCG |
| SEQ ID NO: 4149 | mm27246_Cubn | GTGTATCTGGAACATTCGCG |

TABLE 1-continued mmSurf sgRNA library sequences

| SEQ ID NO | id_gRNA Target | Sequence |
|---|---|---|
| SEQ ID NO: 4150 | mm27247_Cubn | AGTTATCAACTTCACCCACG |
| SEQ ID NO: 4151 | mm27248_Cubn | ACAGCTCCGAATGCTACTGG |
| SEQ ID NO: 4152 | mm27249_Cubn | CCACCTGTGTGAACACTATG |
| SEQ ID NO: 4153 | mm27250_Lima1 | GGCAAGCAAGAGCGACAATG |
| SEQ ID NO: 4154 | mm27251_Lima1 | ATGGAGGTTTCTGAGAGGCG |
| SEQ ID NO: 4155 | mm27252_Lima1 | CTGGACCCAAAGCCGAAATG |
| SEQ ID NO: 4156 | mm27253_Lima1 | TACAACTGAGAATAGTCTAG |
| SEQ ID NO: 4157 | mm27274_Sostdc1 | TCCACCAAATACATTTCGGA |
| SEQ ID NO: 4158 | mm27275_Sostdc1 | ATGTGAATAAAGGATTTCTG |
| SEQ ID NO: 4159 | mm27276_Sostdc1 | ACAGCACCCTGAATCAAGCC |
| SEQ ID NO: 4160 | mm27277_Sostdc1 | CTTCCCAACTGGATCGGAGG |
| SEQ ID NO: 4161 | mm27470_Tspan13 | AGCTCCAATTAGCCCCACCA |
| SEQ ID NO: 4162 | mm27471_Tspan13 | GGCTACTCACGGTATACAGC |
| SEQ ID NO: 4163 | mm27472_Tspan13 | CAATGACCACACCCACCACT |
| SEQ ID NO: 4164 | mm27473_Tspan13 | ACTGGACAATAAATACAAGT |
| SEQ ID NO: 4165 | mm27558_Ifitm3 | CTGACAGAAGCCGATCCGTG |
| SEQ ID NO: 4166 | mm27559_Ifitm3 | TTGATTCTTTCGTAGTTTGG |
| SEQ ID NO: 4167 | mm27560_Ifitm3 | AATCAAGGAAGAATATGAGG |
| SEQ ID NO: 4168 | mm27561_Ifitm3 | TCTAGGGATCGGAAGATGGT |
| SEQ ID NO: 4169 | mm27566_Eef1e1 | CCAGTTCTACAGACAAACAA |
| SEQ ID NO: 4170 | mm27567_Eef1e1 | GGCCTGCTTGACTAGATGGG |
| SEQ ID NO: 4171 | mm27568_Eef1e1 | TGAGCACTGTACTTATTCCC |
| SEQ ID NO: 4172 | mm27569_Eef1e1 | TGCAGGACATAACATCACCC |
| SEQ ID NO: 4173 | mm27758_Cd302 | GAGGACCTAGTTGATACCTG |
| SEQ ID NO: 4174 | mm27759_Cd302 | AAATATGACATTCGACAAGT |
| SEQ ID NO: 4175 | mm27760_Cd302 | ACAGTGCACTGACCACGGTA |
| SEQ ID NO: 4176 | mm27761_Cd302 | ACTTTGCAAAAGCGATGGAA |
| SEQ ID NO: 4177 | mm27846_Tmem9 | GGCAGTAGGCTTCCACATCG |
| SEQ ID NO: 4178 | mm27847_Tmem9 | GCTCTGCGAGTGTAGGTACG |
| SEQ ID NO: 4179 | mm27848_Tmem9 | CAACCAGAATGTGTCTCAGA |
| SEQ ID NO: 4180 | mm27849_Tmem9 | CCGCTGATGTTTCTGTAAGG |
| SEQ ID NO: 4181 | mm27886_Ssr2 | ACAATGCCGAAGTCTTCTGG |
| SEQ ID NO: 4182 | mm27887_Ssr2 | AGCCAGCTTTGAGAGGACGC |
| SEQ ID NO: 4183 | mm27888_Ssr2 | CAGTATAACATCTACAACGT |
| SEQ ID NO: 4184 | mm27889_Ssr2 | CTGGGCCAGGTAAGTAATCG |
| SEQ ID NO: 4185 | mm28082_Aqp11 | CCCCCGAAATGGGTGCCGTG |
| SEQ ID NO: 4186 | mm28083_Aqp11 | GGCACAGCTAGCAACCCGTG |
| SEQ ID NO: 4187 | mm28084_Aqp11 | GATGATCGCTTTGGACATGT |

TABLE 1-continued mmSurf sgRNA library sequences

| SEQ ID NO | id_gRNA Target | Sequence |
|---|---|---|
| SEQ ID NO: 4188 | mm28085_Aqp11 | CTGTTGCCGGGCGATCACGC |
| SEQ ID NO: 4189 | mm28462_Rps23 | CATGCCACTTCTGGTCCCGT |
| SEQ ID NO: 4190 | mm28463_Rps23 | GCATGAGAGGCACCCCCAAA |
| SEQ ID NO: 4191 | mm28464_Rps23 | TTGATATTGCAGAGGGGTTG |
| SEQ ID NO: 4192 | mm28465_Rps23 | AAGTCACCTCAATGAAGTTC |
| SEQ ID NO: 4193 | mm28494_Rpl35 | CGGGTCGCCAAAGTGACAGG |
| SEQ ID NO: 4194 | mm28495_Rpl35 | ATTAAGGCTCGGGACCTGCG |
| SEQ ID NO: 4195 | mm28496_Rpl35 | GAAACAACTGGACGATCTGA |
| SEQ ID NO: 4196 | mm28497_Rpl35 | CTCAAGGCCCACTTACATCT |
| SEQ ID NO: 4197 | mm28634_Sppl2a | TTGATTCATAGGATGCCATG |
| SEQ ID NO: 4198 | mm28635_Sppl2a | TGTAATTGCTGTGTTCACTG |
| SEQ ID NO: 4199 | mm28636_Sppl2a | TGGCATAAGGAACAAGGCAG |
| SEQ ID NO: 4200 | mm28637_Sppl2a | GTGGGCTGTATTTCGAAATG |
| SEQ ID NO: 4201 | mm28914_Sorcs3 | TCACACCAAGGGTTCGCGAG |
| SEQ ID NO: 4202 | mm28915_Sorcs3 | CCAGTCCAGACACCGACCTG |
| SEQ ID NO: 4203 | mm28916_Sorcs3 | CTTCAGTCCGTATCTCCCCG |
| SEQ ID NO: 4204 | mm28917_Sorcs3 | ACGTGGGATCTACTTTACCC |
| SEQ ID NO: 4205 | mm28946_Dcbld1 | TGACATCTAAGAATTATCCA |
| SEQ ID NO: 4206 | mm28947_Dcbld1 | TTAATAACCTGTTTGGAACG |
| SEQ ID NO: 4207 | mm28948_Dcbld1 | AGGAATGAATATTACAACTG |
| SEQ ID NO: 4208 | mm28949_Dcbld1 | GCAAAGCTGCCATCCACGCA |
| SEQ ID NO: 4209 | mm28970_Aspn | GAACAACGGGATAGAACCAG |
| SEQ ID NO: 4210 | mm28971_Aspn | GCTCCAGCAAAGTTGGTGGT |
| SEQ ID NO: 4211 | mm28972_Aspn | ATACAAAAGGACACGTTCAA |
| SEQ ID NO: 4212 | mm28973_Aspn | GAACAACTCGAGAGTAACAT |
| SEQ ID NO: 4213 | mm29178_Cntnap2 | ATTTATACGAAGTAGCACAC |
| SEQ ID NO: 4214 | mm29179_Cntnap2 | ATGGAAAGCATCAACTACAA |
| SEQ ID NO: 4215 | mm29180_Cntnap2 | GGCACTAATCTGGTCCATGG |
| SEQ ID NO: 4216 | mm29181_Cntnap2 | CAGATGTGTGGCCATAGATG |
| SEQ ID NO: 4217 | mm29190_Tspan1 | TGGTGTACACCACATTGGTG |
| SEQ ID NO: 4218 | mm29191_Tspan1 | CAGGAAAGATGTCCCATCGA |
| SEQ ID NO: 4219 | mm29192_Tspan1 | GCCATGCAGTTTGTCAACGT |
| SEQ ID NO: 4220 | mm29193_Tspan1 | GAACAAGTGTGTGCTCATGA |
| SEQ ID NO: 4221 | mm29330_Clec14a | AAGAACAGCTAACCCTCGAG |
| SEQ ID NO: 4222 | mm29331_Clec14a | CCTGACTGTCTAGATCACTT |
| SEQ ID NO: 4223 | mm29332_Clec14a | TTGGAAACTCAAATTAGAGG |
| SEQ ID NO: 4224 | mm29333_Clec14a | AGAGGACAGCCCACTACCGT |
| SEQ ID NO: 4225 | mm29386_Pcyox1 | CCTACCGATCCTGTTCGGCG |

TABLE 1-continued mmSurf sgRNA library sequences

| SEQ ID NO | id_gRNA Target | Sequence |
|---|---|---|
| SEQ ID NO: 4226 | mm29387_Pcyox1 | GGTGCAAGGTCATGACTACG |
| SEQ ID NO: 4227 | mm29388_Pcyox1 | CATCTCGTTGAGAAACGTCT |
| SEQ ID NO: 4228 | mm29389_Pcyox1 | GTAATAAAATTGTTTGCTCG |
| SEQ ID NO: 4229 | mm29410_Lman2 | GCAAATGTAGAAATGTCGTG |
| SEQ ID NO: 4230 | mm29411_Lman2 | ATCTCGGTGATGGTGAACAA |
| SEQ ID NO: 4231 | mm29412_Lman2 | CCCGGGAATAGCGTACAGCT |
| SEQ ID NO: 4232 | mm29413_Lman2 | ACTTCAAAGTCCATGGCACA |
| SEQ ID NO: 4233 | mm29562_Tmem206 | GAGGTGGAATAACCTCATAG |
| SEQ ID NO: 4234 | mm29563_Tmem206 | TCCGGGAGTTCATGCAAAGG |
| SEQ ID NO: 4235 | mm29564_Tmem206 | CATGTCCGTGTCTTACAAGG |
| SEQ ID NO: 4236 | mm29565_Tmem206 | TCGCCTGAACCAGAGCAATG |
| SEQ ID NO: 4237 | mm29606_Edem3 | GTGGATAAGAGCTGTCCGAG |
| SEQ ID NO: 4238 | mm29607_Edem3 | GTCCGCCCAAAAGACCCCTA |
| SEQ ID NO: 4239 | mm29608_Edem3 | ACTGGAGACTGGGTACGCAA |
| SEQ ID NO: 4240 | mm29609_Edem3 | AAGGCATGAGCTCATCAGCT |
| SEQ ID NO: 4241 | mm29722_Rbm7 | ATGCTGGGATATGACACAC |
| SEQ ID NO: 4242 | mm29723_Rbm7 | AATCCCAACTGATCCGCATG |
| SEQ ID NO: 4243 | mm29724_Rbm7 | CTTCTCCAGAAGATTATCAG |
| SEQ ID NO: 4244 | mm29725_Rbm7 | GTACCTGTTAGGAGATGTGG |
| SEQ ID NO: 4245 | mm29990_Fgf22 | CACTCACCGACCCATAGAGG |
| SEQ ID NO: 4246 | mm29991_Fgf22 | GAGATCCGTTCTGTCCGTGT |
| SEQ ID NO: 4247 | mm29992_Fgf22 | TCCCCTGCACCCGACCACCA |
| SEQ ID NO: 4248 | mm29993_Fgf22 | GTGATCAAAGCTGTGTACTC |
| SEQ ID NO: 4249 | mm30018_Mastl | AACATACAGAATTAGAACTG |
| SEQ ID NO: 4250 | mm30019_Mastl | TGACTCCACACTGGATACGA |
| SEQ ID NO: 4251 | mm30020_Mastl | GCATTCGGGAAAGTGTACCT |
| SEQ ID NO: 4252 | mm30021_Mastl | GAGAACATGACCATTGACAA |
| SEQ ID NO: 4253 | mm30030_Tspan31 | TGCGCTGTGCGCTCTCAACG |
| SEQ ID NO: 4254 | mm30031_Tspan31 | CCAGTCCTGCCACCGCGATG |
| SEQ ID NO: 4255 | mm30032_Tspan31 | GGCTATTAACAGAAACACAC |
| SEQ ID NO: 4256 | mm30033_Tspan31 | GAATGCTAGACACCACACCG |
| SEQ ID NO: 4257 | mm30058_Nop56 | CAGCCTGTCAGCCTTAATTG |
| SEQ ID NO: 4258 | mm30059_Nop56 | TAAATTTAATGTGAACCGAG |
| SEQ ID NO: 4259 | mm30060_Nop56 | GAGGAATGTGTGCTTAACCT |
| SEQ ID NO: 4260 | mm30061_Nop56 | GGGTACAACTGCCAGACTGG |
| SEQ ID NO: 4261 | mm30146_Lpar6 | TTCAGTCGACCCACTCTCAG |
| SEQ ID NO: 4262 | mm30147_Lpar6 | TACAACGTACATGATTAACC |
| SEQ ID NO: 4263 | mm30148_Lpar6 | CAAGTTACGTTCAAAATGAG |

TABLE 1-continued mmSurf sgRNA library sequences

| SEQ ID NO | id_gRNA Target | Sequence |
|---|---|---|
| SEQ ID NO: 4264 | mm30149_Lpar6 | AGATCGTTTGCATTGCTGTG |
| SEQ ID NO: 4265 | mm30182_Rplp2 | AAGAAAATACTAGACAGCGT |
| SEQ ID NO: 4266 | mm30183_Rplp2 | TTCAGCTCACTGATGACCTG |
| SEQ ID NO: 4267 | mm30184_Rplp2 | TAGGAGAGGAGTTGCCCCCG |
| SEQ ID NO: 4268 | mm30185_Rplp2 | GCTGAATGGAAAGAACATTG |
| SEQ ID NO: 4269 | mm30218_Eif2s2 | GAAATACTAGAAAAAGACGA |
| SEQ ID NO: 4270 | mm30219_Eif2s2 | CCTACTCGGACGACCTGTGG |
| SEQ ID NO: 4271 | mm30220_Eif2s2 | AAGAGACTACACATATGAGG |
| SEQ ID NO: 4272 | mm30221_Eif2s2 | GATGACCTTGACATTATGCT |
| SEQ ID NO: 4273 | mm30454_Cltc | AAGCAACACAAGCCAGATGG |
| SEQ ID NO: 4274 | mm30455_Cltc | GATGTTCACCCACTATGACC |
| SEQ ID NO: 4275 | mm30456_Cltc | GCTGTGCGGAACAACTTAGC |
| SEQ ID NO: 4276 | mm30457_Cltc | ATAACCACAGGAAGTCGACT |
| SEQ ID NO: 4277 | mm30586_Jam2 | TGAAATCTATCATCTCAGCA |
| SEQ ID NO: 4278 | mm30587_Jam2 | TCTTTAAACCAGATGTACTC |
| SEQ ID NO: 4279 | mm30588_Jam2 | GTCACAGTAATAGAGTTCCA |
| SEQ ID NO: 4280 | mm30589_Jam2 | CTTCCAGTCATAACAGAAGT |
| SEQ ID NO: 4281 | mm30646_Erp29 | GGCAGCGGCCTACACACGAA |
| SEQ ID NO: 4282 | mm30647_Erp29 | GAACCCTGTGCTGTACAATG |
| SEQ ID NO: 4283 | mm30648_Erp29 | GCTGAGTGAGAAGTACAAGC |
| SEQ ID NO: 4284 | mm30649_Erp29 | TCCCAAAAGCAAGTTCGTCT |
| SEQ ID NO: 4285 | mm30682_Armcx2 | TCATTATCTCAATATCGACG |
| SEQ ID NO: 4286 | mm30683_Armcx2 | AGAGATTGGACTGCCATGGG |
| SEQ ID NO: 4287 | mm30684_Armcx2 | TGTGGCAGCCCAATCTACTG |
| SEQ ID NO: 4288 | mm30685_Armcx2 | GGAAACAAGAACCGGAGTGG |
| SEQ ID NO: 4289 | mm30770_Plxdc2 | CCGGTTCCAGTTCGCCCACG |
| SEQ ID NO: 4290 | mm30771_Plxdc2 | ACTCTCAAGCATACAACCAC |
| SEQ ID NO: 4291 | mm30772_Plxdc2 | GCAGTTGAAACCAATCTGCG |
| SEQ ID NO: 4292 | mm30773_Plxdc2 | ACAACCCGACTTTCACTGGA |
| SEQ ID NO: 4293 | mm30794_Ergic2 | GCCAAATGTGCATGCCCTCG |
| SEQ ID NO: 4294 | mm30795_Ergic2 | TCTATGTCAATAAAGTAGCA |
| SEQ ID NO: 4295 | mm30796_Ergic2 | ACTGGATTTAGCAGAGACCA |
| SEQ ID NO: 4296 | mm30797_Ergic2 | TTCTGTCACAGAGAACTGAT |
| SEQ ID NO: 4297 | mm30862_Ero1lb | TGTGCAAACTACCTTCTGGA |
| SEQ ID NO: 4298 | mm30863_Ero1lb | CAGACTTGAGAGGAAGCTCA |
| SEQ ID NO: 4299 | mm30864_Ero1lb | CAAAGAAGCGTTCATTGACT |
| SEQ ID NO: 4300 | mm30865_Ero1lb | ACTCACCTTATTTGAACGCC |
| SEQ ID NO: 4301 | mm30942_Tmed9 | AGCGCGCTGTATTTCCACAT |

TABLE 1-continued mmSurf sgRNA library sequences

| SEQ ID NO | id_gRNA Target | Sequence |
|---|---|---|
| SEQ ID NO: 4302 | mm30943_Tmed9 | GCTGTATGACAAACAGCGGG |
| SEQ ID NO: 4303 | mm30944_Tmed9 | TGGGCTTGGCATGTTCGTAG |
| SEQ ID NO: 4304 | mm30945_Tmed9 | CGCCCCGCACCGATGACCA |
| SEQ ID NO: 4305 | mm30994_Zswim3 | TCCTGTAAGATCGCTCGGTG |
| SEQ ID NO: 4306 | mm30995_Zswim3 | TGGTACATACATGTGAGGAA |
| SEQ ID NO: 4307 | mm30996_Zswim3 | CTATGTAATCCACAAAGTGA |
| SEQ ID NO: 4308 | mm30997_Zswim3 | CAAGGAGCGAGAGAGTCGAG |
| SEQ ID NO: 4309 | mm31010_Slc39a8 | TCAGCTGCTGTAAGATCGCG |
| SEQ ID NO: 4310 | mm31011_Slc39a8 | AGGGGGTTAAAATCAATCCC |
| SEQ ID NO: 4311 | mm31012_Slc39a8 | CGTTAGGCTCAGTGACAGCG |
| SEQ ID NO: 4312 | mm31013_Slc39a8 | CGGCGCCAACCGGAGCCTGT |
| SEQ ID NO: 4313 | mm31098_Tctn3 | ACCCTATAGAATAGTACTGG |
| SEQ ID NO: 4314 | mm31099_Tctn3 | GCAGCTCACCTTACACTACC |
| SEQ ID NO: 4315 | mm31100_Tctn3 | GTCTACGAGATAGAGACCAA |
| SEQ ID NO: 4316 | mm31101_Tctn3 | CTAAGAGTGGCTTCCCAGTG |
| SEQ ID NO: 4317 | mm31278_Sdhb | TGCGCCATGAACATCAACGG |
| SEQ ID NO: 4318 | mm31279_Sdhb | ACAGTATCTGCAGTCCATCG |
| SEQ ID NO: 4319 | mm31280_Sdhb | ACCTCGAATGCAGACGTACG |
| SEQ ID NO: 4320 | mm31281_Sdhb | TAGAAGTTACTCAAATCCTG |
| SEQ ID NO: 4321 | mm31330_Kirrel3 | ACCTCGTTTCATCCACACGA |
| SEQ ID NO: 4322 | mm31331_Kirrel3 | GGAGCTGTATAGGACCACGG |
| SEQ ID NO: 4323 | mm31332_Kirrel3 | GACATCAGGGCGCTACACAG |
| SEQ ID NO: 4324 | mm31333_Kirrel3 | ACCGCTTGTCAACTTGTCCG |
| SEQ ID NO: 4325 | mm31478_Slc38a2 | CCACCAAAGCAGCTTCCACG |
| SEQ ID NO: 4326 | mm31479_Slc38a2 | CTCAAGACTGCCAACGAAGG |
| SEQ ID NO: 4327 | mm31480_Slc38a2 | GCAGTGACAATGGAAGAATG |
| SEQ ID NO: 4328 | mm31481_Slc38a2 | GAGTTGAAGATGAAATAGCG |
| SEQ ID NO: 4329 | mm31518_Rtp4 | CCACGACACACGCAATTGTG |
| SEQ ID NO: 4330 | mm31519_Rtp4 | CCTGCGATTTCAAAGTGTCC |
| SEQ ID NO: 4331 | mm31520_Rtp4 | TGCAGAGATACTATGGACAC |
| SEQ ID NO: 4332 | mm31521_Rtp4 | ATCCAAATGCAGGCTCCACT |
| SEQ ID NO: 4333 | mm31622_Rer1 | GAAAAATCTGTACACCACCG |
| SEQ ID NO: 4334 | mm31623_Rer1 | CAGTGTCACAACCCACCGGA |
| SEQ ID NO: 4335 | mm31624_Rer1 | AGGTCACAATGTACCAACCC |
| SEQ ID NO: 4336 | mm31625_Rer1 | ACGCAATGAAAAGGTTTAGG |
| SEQ ID NO: 4337 | mm31814_Rpl4 | GCAAAATGAGAAACCGACGG |
| SEQ ID NO: 4338 | mm31815_Rpl4 | AGAAAACAGATGTGTCGTGG |
| SEQ ID NO: 4339 | mm31816_Rpl4 | GCTGTATGGCACTTGGCGGA |

TABLE 1-continued mmSurf sgRNA library sequences

| SEQ ID NO | id_gRNA Target | Sequence |
|---|---|---|
| SEQ ID NO: 4340 | mm31817_Rp14 | GTTAGGTCATCGTATTGAGG |
| SEQ ID NO: 4341 | mm31834_Ccdc80 | TGGCCATCAGGACCCAAATG |
| SEQ ID NO: 4342 | mm31835_Ccdc80 | GGGTGAGCTAATCTCAACAC |
| SEQ ID NO: 4343 | mm31836_Ccdc80 | TACGGAGGATCACCAATGAA |
| SEQ ID NO: 4344 | mm31837_Ccdc80 | GCTATACCCTCTACCTCGGA |
| SEQ ID NO: 4345 | mm31882_Ppap2b | CATTGCAGTAAAACCCTCGA |
| SEQ ID NO: 4346 | mm31883_Ppap2b | GCAGCTCTCTATAAGCAAGT |
| SEQ ID NO: 4347 | mm31884_Ppap2b | GTCCCTGAGAGTAAGAACGG |
| SEQ ID NO: 4348 | mm31885_Ppap2b | CAGTCAGATCAATTGCTCCG |
| SEQ ID NO: 4349 | mm31938_Myl12b | GCTAAACGGCACTGACCCCG |
| SEQ ID NO: 4350 | mm31939_Myl12b | GCGTCCAGGTAGGCATCAGT |
| SEQ ID NO: 4351 | mm31940_Myl12b | GTTTAGCTTCTCCCCAAACA |
| SEQ ID NO: 4352 | mm31941_Myl12b | CCAGATCCAGGAGTTCAAAG |
| SEQ ID NO: 4353 | mm31978_Tubb6 | AGCTAAGAAGTACGTACCCA |
| SEQ ID NO: 4354 | mm31979_Tubb6 | GACCAGGCCGGAGGCTACGT |
| SEQ ID NO: 4355 | mm31980_Tubb6 | GCCAGGGAAACGCAGTGATG |
| SEQ ID NO: 4356 | mm31981_Tubb6 | CTGGGCCAAGGGTCACTACA |
| SEQ ID NO: 4357 | mm32058_Tmx3 | GACTTGGCATATAATTACCG |
| SEQ ID NO: 4358 | mm32059_Tmx3 | TGTTCGACCATGTACGGAAG |
| SEQ ID NO: 4359 | mm32060_Tmx3 | AAGATGGCGATCTGTCCTCA |
| SEQ ID NO: 4360 | mm32061_Tmx3 | GTGTGGCCATTGTAAAAAGT |
| SEQ ID NO: 4361 | mm32110_Trap1 | TTGTAGTGCAAAGTGAAGCG |
| SEQ ID NO: 4362 | mm32111_Trap1 | CAGAGAGCCCAGGTTACCAG |
| SEQ ID NO: 4363 | mm32112_Trap1 | AGGACAGTTATACAGCACAC |
| SEQ ID NO: 4364 | mm32113_Trap1 | TTGGCACAATTGCCAGATCG |
| SEQ ID NO: 4365 | mm32418_Spire1 | AGGAAACACCTACGAACGTG |
| SEQ ID NO: 4366 | mm32419_Spire1 | CTACGTACTGGATTTAAAGG |
| SEQ ID NO: 4367 | mm32420_Spire1 | GTGCCTCCGACTCAGTTGGG |
| SEQ ID NO: 4368 | mm32421_Spire1 | GATGAGGGATTTGCGAAATG |
| SEQ ID NO: 4369 | mm32666_Stt3b | AGGGTACATATCTCGGTCAG |
| SEQ ID NO: 4370 | mm32667_Stt3b | CGACAGCATGCAGACGACCG |
| SEQ ID NO: 4371 | mm32668_Stt3b | GTCATCTATCTGACATACAC |
| SEQ ID NO: 4372 | mm32669_Stt3b | TACAGCAAGAGAGTCTACAT |
| SEQ ID NO: 4373 | mm32830_Lmbrd1 | TTACAAACAGCAACGCAACG |
| SEQ ID NO: 4374 | mm32831_Lmbrd1 | AAGGCACGTCTATCCCTCGC |
| SEQ ID NO: 4375 | mm32832_Lmbrd1 | CATCATCTGTTTCAGGCGTA |
| SEQ ID NO: 4376 | mm32833_Lmbrd1 | AACGGTATTCTCAATCTGTA |
| SEQ ID NO: 4377 | mm32850_Rpl34 | TTCTACAGGTTCGTGCTGTG |

TABLE 1-continued mmSurf sgRNA library sequences

| SEQ ID NO | id_gRNA Target | Sequence |
|---|---|---|
| SEQ ID NO: 4378 | mm32851_Rpl34 | AAAGCACCTAAATCTGCATG |
| SEQ ID NO: 4379 | mm32852_Rpl34 | AGCGTTTGACATACCGCCGT |
| SEQ ID NO: 4380 | mm32853_Rpl34 | CTTCCTAGGTCTCGAACCCC |
| SEQ ID NO: 4381 | mm32866_Gpihbp1 | GCAGGTATCAGTACACCACA |
| SEQ ID NO: 4382 | mm32867_Gpihbp1 | CACTGTGCAATATTCCACCC |
| SEQ ID NO: 4383 | mm32868_Gpihbp1 | CTGTCAAGTGCTTCACAGCG |
| SEQ ID NO: 4384 | mm32869_Gpihbp1 | CCTGCTTCCAGGGATCATGT |
| SEQ ID NO: 4385 | mm32886_Ly6g6c | GTGACATCGAGTATCAGCTG |
| SEQ ID NO: 4386 | mm32887_Ly6g6c | TCGTTGAAGACCTCCCGACA |
| SEQ ID NO: 4387 | mm32888_Ly6g6c | CCTGCCTCTAGGGAAGATGT |
| SEQ ID NO: 4388 | mm32889_Ly6g6c | CGTTTGTTGTCAGGCATTTG |
| SEQ ID NO: 4389 | mm32914_Mpzl1 | GGATGCGGTCCTTACCGACA |
| SEQ ID NO: 4390 | mm32915_Mpzl1 | TGGACACATTAGGCTCCACG |
| SEQ ID NO: 4391 | mm32916_Mpzl1 | CACAACTGGATGGTTGACCA |
| SEQ ID NO: 4392 | mm32917_Mpzl1 | GTGACTCGGTCTTTAAATGG |
| SEQ ID NO: 4393 | mm33002_Evc2 | CCTTTCCCTCAATGACCAAG |
| SEQ ID NO: 4394 | mm33003_Evc2 | GATATTTCAAGAGAAGCCCG |
| SEQ ID NO: 4395 | mm33004_Evc2 | ACCAGAGATTAATAACCAGG |
| SEQ ID NO: 4396 | mm33005_Evc2 | CCTTACTCTGGACCAAGCCG |
| SEQ ID NO: 4397 | mm33174_Tm2d3 | AACTACAATACTTACGACAC |
| SEQ ID NO: 4398 | mm33175_Tm2d3 | GGACAGGAAAAGCAGCACGC |
| SEQ ID NO: 4399 | mm33176_Tm2d3 | GCGCTGCCGAGGGCAAGCCA |
| SEQ ID NO: 4400 | mm33177_Tm2d3 | GACACTTCGTCATGTAAGGA |
| SEQ ID NO: 4401 | mm33186_Abhd14a | ACAGGTGCAGAATACTGTGT |
| SEQ ID NO: 4402 | mm33187_Abhd14a | AAAGATTCGAGAGTTGCCTC |
| SEQ ID NO: 4403 | mm33188_Abhd14a | AGCATTTAATTCCCACACAT |
| SEQ ID NO: 4404 | mm33189_Abhd14a | CAGACTTCGCGACTCTGGAG |
| SEQ ID NO: 4405 | mm33246_Slc44a2 | ATCAACAACCTTGTACACGG |
| SEQ ID NO: 4406 | mm33247_Slc44a2 | GAACATTACAGATCTAGTGG |
| SEQ ID NO: 4407 | mm33248_Slc44a2 | GGTGAAACGCATTACCTGAG |
| SEQ ID NO: 4408 | mm33249_Slc44a2 | TCAAGTGCAGGTACACTCGG |
| SEQ ID NO: 4409 | mm33426_Srpx2 | ATGGTGGTTATGAACGCCAG |
| SEQ ID NO: 4410 | mm33427_Srpx2 | TTCAATGTGTAACACCATCG |
| SEQ ID NO: 4411 | mm33428_Srpx2 | TAGAACAGCTATAGTCACAA |
| SEQ ID NO: 4412 | mm33429_Srpx2 | CAGAATCTTTCACTAAGGGT |
| SEQ ID NO: 4413 | mm33522_Lrrn4cl | GGCAACGGTCATAGTCGCAA |
| SEQ ID NO: 4414 | mm33523_Lrrn4cl | CAAAGGACATAAGCAACCCC |
| SEQ ID NO: 4415 | mm33524_Lrrn4cl | CCAGGGTCAAGATCTGAGGT |

TABLE 1-continued mmSurf sgRNA library sequences

| SEQ ID NO | id_gRNA Target | Sequence |
|---|---|---|
| SEQ ID NO: 4416 | mm33525_Lrrn4cl | TCTGCTTTGGGAAAGCAACG |
| SEQ ID NO: 4417 | mm33590_Disp1 | GAGGGACCACGATAGGACAG |
| SEQ ID NO: 4418 | mm33591_Disp1 | ACTCGAAGTTAAAGACGACT |
| SEQ ID NO: 4419 | mm33592_Disp1 | GACGTAATTCACCAATATGG |
| SEQ ID NO: 4420 | mm33593_Disp1 | GGCGTAGTCAGCCGTCTTTG |
| SEQ ID NO: 4421 | mm34030_Cd209b | CCAAAACCCCAAATACCGAG |
| SEQ ID NO: 4422 | mm34031_Cd209b | TGGGACTGGACATTCCTCCT |
| SEQ ID NO: 4423 | mm34032_Cd209b | GCTTAGAATCATCCTTTACC |
| SEQ ID NO: 4424 | mm34033_Cd209b | AGGGAAGAATGAGTCCATGC |
| SEQ ID NO: 4425 | mm34050_Tmem110 | GAGGGCGCACTGTCCTACCC |
| SEQ ID NO: 4426 | mm34051_Tmem110 | GGCATGCTGCTCATTTATGT |
| SEQ ID NO: 4427 | mm34052_Tmem110 | CATGATCTTTGAAAAGTCCG |
| SEQ ID NO: 4428 | mm34053_Tmem110 | GAGAACCAAAGCATGAAAGA |
| SEQ ID NO: 4429 | mm34122_Carkd | TAGGCCAGGTCCCACGACAA |
| SEQ ID NO: 4430 | mm34123_Carkd | CTGACGTCGAAGAAGCACAA |
| SEQ ID NO: 4431 | mm34124_Carkd | CATTCTCACCCCCAACCACG |
| SEQ ID NO: 4432 | mm34125_Carkd | CCATACAGCACATGCGACAA |
| SEQ ID NO: 4433 | mm34526_Esam | ACCTACTGCTCAGTACCAGT |
| SEQ ID NO: 4434 | mm34527_Esam | TCTGCACATTGACAGAACAG |
| SEQ ID NO: 4435 | mm34528_Esam | GGAGTCATGACAAATAAACC |
| SEQ ID NO: 4436 | mm34529_Esam | GTCGTGGTCCCACCCCCGGG |
| SEQ ID NO: 4437 | mm34554_Dnase1l1 | GAAGCACCATGATATCACAT |
| SEQ ID NO: 4438 | mm34555_Dnase1l1 | TGAGCAGGGGAGCCATAACA |
| SEQ ID NO: 4439 | mm34556_Dnase1l1 | TCCTAAACAGCTCATTGCTG |
| SEQ ID NO: 4440 | mm34557_Dnase1l1 | AGAGTGAAATGGGCCACAAA |
| SEQ ID NO: 4441 | mm34558_Antxr1 | ACATGCACGAAGGATTCGAG |
| SEQ ID NO: 4442 | mm34559_Antxr1 | TGAACCATCCACCATCTGCG |
| SEQ ID NO: 4443 | mm34560_Antxr1 | TGAAGGACATCCTTAGCTGT |
| SEQ ID NO: 4444 | mm34561_Antxr1 | CTGCTCATCCCATAGTCAGA |
| SEQ ID NO: 4445 | mm34598_Bst2 | CGCCGTCACAGCGAACAGCG |
| SEQ ID NO: 4446 | mm34599_Bst2 | CCGTGCCCATGGATGAGATG |
| SEQ ID NO: 4447 | mm34600_Bst2 | AAACTCCTGCAACCTGACCG |
| SEQ ID NO: 4448 | mm34601_Bst2 | CTGGCGCTGCAACAGGTGCG |
| SEQ ID NO: 4449 | mm34634_Hilpda | ACATGATGCCCAGCACATAG |
| SEQ ID NO: 4450 | mm34635_Hilpda | GTTAGAGTGATGGAGTCTCT |
| SEQ ID NO: 4451 | mm34636_Hilpda | GGGAGCTCCTGGATCACGAG |
| SEQ ID NO: 4452 | mm34637_Hilpda | CTCCATCACTCTAACAAAGA |
| SEQ ID NO: 4453 | mm34658_Tnfsf13 | TCAACCAAAGAGCAACCGAA |

TABLE 1-continued mmSurf sgRNA library sequences

| SEQ ID NO | id_gRNA Target | Sequence |
| --- | --- | --- |
| SEQ ID NO: 4454 | mm34659_Tnfsf13 | GGCAACCAGTACTTAGGCGT |
| SEQ ID NO: 4455 | mm34660_Tnfsf13 | ATGGGGCGAAATCTCGGAGA |
| SEQ ID NO: 4456 | mm34661_Tnfsf13 | GCTGCAAAGCCTAAGGCGGG |
| SEQ ID NO: 4457 | mm34662_Hfe2 | GGCTCACCGGACACGCCGCG |
| SEQ ID NO: 4458 | mm34663_Hfe2 | GTTGGCTCCCGACGAAACCG |
| SEQ ID NO: 4459 | mm34664_Hfe2 | CTATGCCATGCACCGCAGAG |
| SEQ ID NO: 4460 | mm34665_Hfe2 | ACAAACTCGAGCCCCCAGGT |
| SEQ ID NO: 4461 | mm34758_Cd164l2 | CGTTTGGCCTACTACCCAAG |
| SEQ ID NO: 4462 | mm34759_Cd164l2 | ATTACCAGCTAGAACCAGCT |
| SEQ ID NO: 4463 | mm34760_Cd164l2 | TCTCCCACCAGGACACTGTG |
| SEQ ID NO: 4464 | mm34761_Cd164l2 | GGGACACTGTGAACACTGTG |
| SEQ ID NO: 4465 | mm34802_Txndc15 | ACCACCATGGGATCTCCGCG |
| SEQ ID NO: 4466 | mm34803_Txndc15 | CCAAGTGTTGGAAACGCCCG |
| SEQ ID NO: 4467 | mm34804_Txndc15 | TTGGGTTTAGGAAATCCATG |
| SEQ ID NO: 4468 | mm34805_Txndc15 | TGTGTATCTGCATGAAGAGG |
| SEQ ID NO: 4469 | mm34810_Pxdn | CAGAAGTATAGGACGCACGA |
| SEQ ID NO: 4470 | mm34811_Pxdn | TGATGGTCAAGAATCCTTCG |
| SEQ ID NO: 4471 | mm34812_Pxdn | CCACTGTGTATGGATCCCGT |
| SEQ ID NO: 4472 | mm34813_Pxdn | GAATCAGAGAGATCCAACCC |
| SEQ ID NO: 4473 | mm35242_Tmem30a | GACAGACCAATTGCGCCATG |
| SEQ ID NO: 4474 | mm35243_Tmem30a | CAACAACATCCGTGAGATCG |
| SEQ ID NO: 4475 | mm35244_Tmem30a | TACTTACAAGCAAAGCACTA |
| SEQ ID NO: 4476 | mm35245_Tmem30a | CAAGCACAAGATGTCACATT |
| SEQ ID NO: 4477 | mm35266_Ace2 | TGTAGAACGTACCTTCGCAG |
| SEQ ID NO: 4478 | mm35267_Ace2 | ACTTGTACAGATATTACACA |
| SEQ ID NO: 4479 | mm35268_Ace2 | AATGGATTTCAGATGCTTGG |
| SEQ ID NO: 4480 | mm35269_Ace2 | GATGTGTCCCATCTCGTGAT |
| SEQ ID NO: 4481 | mm35418_Slc44a4 | TGGGCACGAGGAATTCAACG |
| SEQ ID NO: 4482 | mm35419_Slc44a4 | GATGTCGAAGTATAGAACGT |
| SEQ ID NO: 4483 | mm35420_Slc44a4 | TCTCCATCCCCAGATAGTGG |
| SEQ ID NO: 4484 | mm35421_Slc44a4 | AGTTGGTAGTGAAGCCCAGT |
| SEQ ID NO: 4485 | mm35618_Copb1 | TCTTGTCCTAGGATTTACCG |
| SEQ ID NO: 4486 | mm35619_Copb1 | TAGTAAGAGTTACACACCAC |
| SEQ ID NO: 4487 | mm35620_Copb1 | GATCATTATGATTCTGAATG |
| SEQ ID NO: 4488 | mm35621_Copb1 | CTCCGTAACCAATTTCTGAA |
| SEQ ID NO: 4489 | mm35738_Megf10 | GCGATGTCCATAAAAACCGG |
| SEQ ID NO: 4490 | mm35739_Megf10 | CCGGACAGCCTACCGCCACG |
| SEQ ID NO: 4491 | mm35740_Megf10 | TTTATCCCGTAGCGTCCCAG |

TABLE 1-continued mmSurf sgRNA library sequences

| SEQ ID NO | id_gRNA Target | Sequence |
|---|---|---|
| SEQ ID NO: 4492 | mm35741_Megf10 | TCTTTCCAAAGCGACCCTCA |
| SEQ ID NO: 4493 | mm35754_Tspan15 | CTGAACGACAACATCCGGAG |
| SEQ ID NO: 4494 | mm35755_Tspan15 | ATCACTCACCCAGAACACGG |
| SEQ ID NO: 4495 | mm35756_Tspan15 | GTCAGTGGGATCTACGCAG |
| SEQ ID NO: 4496 | mm35757_Tspan15 | CTGGTCATGGAGCTTATTGG |
| SEQ ID NO: 4497 | mm35842_Atp6ap2 | TTAGCATATTAAGATCGCCA |
| SEQ ID NO: 4498 | mm35843_Atp6ap2 | TGAACTTGGGAAGCGTTATG |
| SEQ ID NO: 4499 | mm35844_Atp6ap2 | CCGGTGGAATAGGTTACCCA |
| SEQ ID NO: 4500 | mm35845_Atp6ap2 | TGGACAGTGCAGCTACGTCT |
| SEQ ID NO: 4501 | mm35866_Stambp | GATTACGGGCACCACGATG |
| SEQ ID NO: 4502 | mm35867_Stambp | TTACAGTCTGGAGTCTGCGT |
| SEQ ID NO: 4503 | mm35868_Stambp | TGAGCAGTATAAAGAGCGAA |
| SEQ ID NO: 4504 | mm35869_Stambp | GAGCGTCGCTTTCCCTAAAG |
| SEQ ID NO: 4505 | mm35870_Lrfn2 | TGGAACCTGTGATGTCCGAA |
| SEQ ID NO: 4506 | mm35871_Lrfn2 | GCGACCCTTGAGACTTCCGG |
| SEQ ID NO: 4507 | mm35872_Lrfn2 | GTCCTCCGGTCAATGTCAGG |
| SEQ ID NO: 4508 | mm35873_Lrfn2 | CAACCGGCTACCTAGCCTTG |
| SEQ ID NO: 4509 | mm35894_Tmtc4 | ATGGACAGCAAACAGCAACG |
| SEQ ID NO: 4510 | mm35895_Tmtc4 | ATTAACTACTACCTGTCCGG |
| SEQ ID NO: 4511 | mm35896_Tmtc4 | CCAGTCAGACACGCCCCTTG |
| SEQ ID NO: 4512 | mm35897_Tmtc4 | CAAGGTACCTTAGCATTGAG |
| SEQ ID NO: 4513 | mm35934_Cpm | GTTGTCCCGAAGCTTAACCC |
| SEQ ID NO: 4514 | mm35935_Cpm | GGACGGCTTCGAATCCATCG |
| SEQ ID NO: 4515 | mm35936_Cpm | GTAGCCGTTGATAATCCCGT |
| SEQ ID NO: 4516 | mm35937_Cpm | AAATACGTGGCGAATATGCA |
| SEQ ID NO: 4517 | mm36062_Adgra2 | AACATCACCACCATTCAGTG |
| SEQ ID NO: 4518 | mm36063_Adgra2 | TGTGGCAAGCAACATCATGT |
| SEQ ID NO: 4519 | mm36064_Adgra2 | GTCATGTTCAGACGAAACGT |
| SEQ ID NO: 4520 | mm36065_Adgra2 | AATGAGCTGGAGCTTATAGA |
| SEQ ID NO: 4521 | mm36110_Tspan2 | CACACACTGTGACTCACGCA |
| SEQ ID NO: 4522 | mm36111_Tspan2 | TGTACAGAGCATGTATGAGG |
| SEQ ID NO: 4523 | mm36112_Tspan2 | TCGATTTGGAGGTACCATGA |
| SEQ ID NO: 4524 | mm36113_Tspan2 | TACCTTAAAGACAGGGCAAG |
| SEQ ID NO: 4525 | mm36226_P2ry12 | ATATCAGTATATCGTTCCTG |
| SEQ ID NO: 4526 | mm36227_P2ry12 | TGGCACACCAAGGTTCTCAG |
| SEQ ID NO: 4527 | mm36228_P2ry12 | CTTGTAGTCTCTGACGCACA |
| SEQ ID NO: 4528 | mm36229_P2ry12 | TCATTACCAAAGAACTCTAT |
| SEQ ID NO: 4529 | mm36346_Mmrn1 | AGTGTCCAGTATCACTGTCG |

TABLE 1-continued mmSurf sgRNA library sequences

| SEQ ID NO | id_gRNA Target | Sequence |
|---|---|---|
| SEQ ID NO: 4530 | mm36347_Mmrn1 | GAATGATTTGACATATGACA |
| SEQ ID NO: 4531 | mm36348_Mmrn1 | AGTCACACCGCTGTTGACCA |
| SEQ ID NO: 4532 | mm36349_Mmrn1 | TGCAAGAAAATCAGCCCACG |
| SEQ ID NO: 4533 | mm36522_Gpr39 | GTAAACGTACCCACTCACAA |
| SEQ ID NO: 4534 | mm36523_Gpr39 | TTACAGGACAGAGCATAGCT |
| SEQ ID NO: 4535 | mm36524_Gpr39 | CGTCACCATCAGGGTTACGC |
| SEQ ID NO: 4536 | mm36525_Gpr39 | AGACCTCCCAACGGTTGGAG |
| SEQ ID NO: 4537 | mm36546_Scara5 | TAGGTCCATGTCACAAACGG |
| SEQ ID NO: 4538 | mm36547_Scara5 | CTGGTAGAGTTCCAGCTGTG |
| SEQ ID NO: 4539 | mm36548_Scara5 | CAGCGCCTTCAAGTCATCTG |
| SEQ ID NO: 4540 | mm36549_Scara5 | GGGAACACTCCATCGCCTTG |
| SEQ ID NO: 4541 | mm36598_Clec12b | AAGTCAAATTACCAGAAGCG |
| SEQ ID NO: 4542 | mm36599_Clec12b | GCTGTCAATCTTCACCAGAG |
| SEQ ID NO: 4543 | mm36600_Clec12b | GGCAGCGCCTCGCCAAAGTG |
| SEQ ID NO: 4544 | mm36601_Clec12b | AGGACTCTGCAAGAGTGAGG |
| SEQ ID NO: 4545 | mm36682_Mfap31 | CATGGGCGTGTACTATATGG |
| SEQ ID NO: 4546 | mm36683_Mfap31 | GGTGACTGCTCATCATACAC |
| SEQ ID NO: 4547 | mm36684_Mfap31 | GAACTGCAGGACGATCATGG |
| SEQ ID NO: 4548 | mm36685_Mfap31 | GAAGCATCCGAGTCAGCGGT |
| SEQ ID NO: 4549 | mm36702_Treml1 | ACCTGGTGGAAGAACCAACA |
| SEQ ID NO: 4550 | mm36703_Treml1 | TCACGCCGTCTGAACTCGTG |
| SEQ ID NO: 4551 | mm36704_Treml1 | CCCACTAGTGACCTCAGCGG |
| SEQ ID NO: 4552 | mm36705_Treml1 | CTCAGCTGACAGTCATCCCG |
| SEQ ID NO: 4553 | mm36722_Ano9 | TCCCGGAAGTACCATGAACA |
| SEQ ID NO: 4554 | mm36723_Ano9 | AGCCACTCAGAAAGACGATG |
| SEQ ID NO: 4555 | mm36724_Ano9 | TGAAGAATATATGGGCTCGG |
| SEQ ID NO: 4556 | mm36725_Ano9 | CCAGGCGCGTGGATTTCCCA |
| SEQ ID NO: 4557 | mm36838_Ptk7 | GAGCGTACAACTGTGTACCA |
| SEQ ID NO: 4558 | mm36839_Ptk7 | TGTTGTTGTAGCAAGGAACG |
| SEQ ID NO: 4559 | mm36840_Ptk7 | CTTGCGCATCAATAGTGTGG |
| SEQ ID NO: 4560 | mm36841_Ptk7 | TGTCTGTCACCCATTCAGGG |
| SEQ ID NO: 4561 | mm36914_Clmp | TGTCTACAATAACTTGACCG |
| SEQ ID NO: 4562 | mm36915_Clmp | CCTACAGATTACAACAACCC |
| SEQ ID NO: 4563 | mm36916_Clmp | CCAGTGCACAGCAGGCAACG |
| SEQ ID NO: 4564 | mm36917_Clmp | TGTGCAGAGCATTGGCATGG |
| SEQ ID NO: 4565 | mm37026_Atp5h | TACAGCATACTGACCTGGCG |
| SEQ ID NO: 4566 | mm37027_Atp5h | CCTGAAGATTCCTGTGCCTG |
| SEQ ID NO: 4567 | mm37028_Atp5h | CACAGCCCTGGTGGACCAGG |

TABLE 1-continued mmSurf sgRNA library sequences

| SEQ ID NO | id_gRNA Target | Sequence |
|---|---|---|
| SEQ ID NO: 4568 | mm37029_Atp5h | GGCTTACTACAGGGCCAATG |
| SEQ ID NO: 4569 | mm37150_Susd2 | GGCCGGCGCTTCATATAACG |
| SEQ ID NO: 4570 | mm37151_Susd2 | CTGCCCGGAAGTCGTCACCC |
| SEQ ID NO: 4571 | mm37152_Susd2 | AGTGCCGTAGTATTGCCAAT |
| SEQ ID NO: 4572 | mm37153_Susd2 | AAGTGAAGAAGCCGGTATTG |
| SEQ ID NO: 4573 | mm37286_Anxa9 | TGTGGACTATGATACCATTG |
| SEQ ID NO: 4574 | mm37287_Anxa9 | GAAACTCAAGAACGTCCTGA |
| SEQ ID NO: 4575 | mm37288_Anxa9 | TGGCAATCTGGAGAAAATCG |
| SEQ ID NO: 4576 | mm37289_Anxa9 | TGAGACCAATGGTATCCTGC |
| SEQ ID NO: 4577 | mm37498_Apmap | GAAACTCTGAGGATCTATGG |
| SEQ ID NO: 4578 | mm37499_Apmap | GAGAAATAGAGACCATCGCT |
| SEQ ID NO: 4579 | mm37500_Apmap | GAATCCATAGTAAATATTGG |
| SEQ ID NO: 4580 | mm37501_Apmap | AGTTGTAACATACGTTTCTG |
| SEQ ID NO: 4581 | mm37546_Tmem106b | TTCAGCGTCGTAGCTGACAT |
| SEQ ID NO: 4582 | mm37547_Tmem106b | AAAACACAGCCAATCCAGAC |
| SEQ ID NO: 4583 | mm37548_Tmem106b | AGTGAAGTGCACAACGAAGA |
| SEQ ID NO: 4584 | mm37549_Tmem106b | TTCAAAAACCGTGATTGGAA |
| SEQ ID NO: 4585 | mm37594_Antxr2 | GTCACGTCGATCAGTCACGA |
| SEQ ID NO: 4586 | mm37595_Antxr2 | CAGTACGAAGTACAAATCGA |
| SEQ ID NO: 4587 | mm37596_Antxr2 | TTGACGGACGGTAAGCTGGA |
| SEQ ID NO: 4588 | mm37597_Antxr2 | CAAAATTGGCAAAGGACTGG |
| SEQ ID NO: 4589 | mm37622_Itfg1 | CAACCGCAGATACTGCTAGG |
| SEQ ID NO: 4590 | mm37623_Itfg1 | GAGTGCGTTGGTAACAAGTG |
| SEQ ID NO: 4591 | mm37624_Itfg1 | AAAACCTAAAAATCTGGTGG |
| SEQ ID NO: 4592 | mm37625_Itfg1 | CCTCAACTCCGACAAACAGA |
| SEQ ID NO: 4593 | mm37626_Tmem123 | GAGGCAGTAGGCGTCACATG |
| SEQ ID NO: 4594 | mm37627_Tmem123 | CAGGACCCGACCGACGCTCA |
| SEQ ID NO: 4595 | mm37628_Tmem123 | CAATAAACTACTGTGGGCTG |
| SEQ ID NO: 4596 | mm37629_Tmem123 | TACCAACCAGACCATGAGTG |
| SEQ ID NO: 4597 | mm37802_Synpr | AAGTACCGCGAAAACAACCG |
| SEQ ID NO: 4598 | mm37803_Synpr | GGTGACAAAGAATTCTGCTG |
| SEQ ID NO: 4599 | mm37804_Synpr | GCAGCCTTCCAACAAGTGCA |
| SEQ ID NO: 4600 | mm37805_Synpr | CTCACAGGTGGGCACTTCAA |
| SEQ ID NO: 4601 | mm37810_Zfyve19 | AGTGCCACACAATCCTGACC |
| SEQ ID NO: 4602 | mm37811_Zfyve19 | CTGGACTTCATCCTTCAGTG |
| SEQ ID NO: 4603 | mm37812_Zfyve19 | AGTTACCTGAGGCTCTTGGT |
| SEQ ID NO: 4604 | mm37813_Zfyve19 | CCACACACTCACCGGTCTCA |
| SEQ ID NO: 4605 | mm37814_Btbd17 | CTTGGCGTAATGCAACGGCG |

TABLE 1-continued mmSurf sgRNA library sequences

| SEQ ID NO | id_gRNA Target | Sequence |
| --- | --- | --- |
| SEQ ID NO: 4606 | mm37815_Btbd17 | GCAGCTCAGAGAGCCGATGT |
| SEQ ID NO: 4607 | mm37816_Btbd17 | CCCCGGTGCTAACAGCGTAG |
| SEQ ID NO: 4608 | mm37817_Btbd17 | CGAGTAGCATCCTTGCAGCG |
| SEQ ID NO: 4609 | mm37846_Slc39a4 | GGTCCTGAATACGGATAGTG |
| SEQ ID NO: 4610 | mm37847_Slc39a4 | CAGTTGGGGAAGATCTACAC |
| SEQ ID NO: 4611 | mm37848_Slc39a4 | CATGCAGCGTGATATTGGGA |
| SEQ ID NO: 4612 | mm37849_Slc39a4 | TGGAGAGGGTCACACCCATG |
| SEQ ID NO: 4613 | mm37870_Sulf2 | GACGGTGAGATATACCACGT |
| SEQ ID NO: 4614 | mm37871_Sulf2 | ACAAATGTAAAGGCCCCATG |
| SEQ ID NO: 4615 | mm37872_Sulf2 | ACATGGCTCAGACTACTCCA |
| SEQ ID NO: 4616 | mm37873_Sulf2 | GCACATTGGTGTAGTCACGA |
| SEQ ID NO: 4617 | mm37886_Tnfrsf13c | CAGACTCACTAGACCCACCA |
| SEQ ID NO: 4618 | mm37887_Tnfrsf13c | GACACGCAGTTTCTCACCAG |
| SEQ ID NO: 4619 | mm37888_Tnfrsf13c | CTCCGCGCTGAGACCCGACG |
| SEQ ID NO: 4620 | mm37889_Tnfrsf13c | GCACTCGGTCTGATTGCACT |
| SEQ ID NO: 4621 | mm37890_Kdelc1 | ACCCGGGCTAAAAGCACACG |
| SEQ ID NO: 4622 | mm37891_Kdelc1 | AGATAGAGGTTAAACACCAT |
| SEQ ID NO: 4623 | mm37892_Kdelc1 | TGTCGGTGCAAGCTAACACA |
| SEQ ID NO: 4624 | mm37893_Kdelc1 | GATGAGCAGTTCACGAGAGT |
| SEQ ID NO: 4625 | mm37914_Igsf5 | AACAGTCCTAAAGGACTCAG |
| SEQ ID NO: 4626 | mm37915_Igsf5 | GTGGACTCTTAACCAAATGG |
| SEQ ID NO: 4627 | mm37916_Igsf5 | AGTGCTGTTGTAACTGGCAT |
| SEQ ID NO: 4628 | mm37917_Igsf5 | TCTTGTAGACAGTATTGGAG |
| SEQ ID NO: 4629 | mm38114_Dhx36 | AGGGTCGCGAGATCGGCCTG |
| SEQ ID NO: 4630 | mm38115_Dhx36 | CAGCGTATATAAAGGAACTG |
| SEQ ID NO: 4631 | mm38116_Dhx36 | TGTCCAATGATACATATACC |
| SEQ ID NO: 4632 | mm38117_Dhx36 | GCCTACCGTCAACCAGACAC |
| SEQ ID NO: 4633 | mm38134_Mfsd8 | AGCAATGTATGATCGGACAA |
| SEQ ID NO: 4634 | mm38135_Mfsd8 | TGGACCGAGAATAAAGCCCA |
| SEQ ID NO: 4635 | mm38136_Mfsd8 | GGATATGTACGCCTGGACCC |
| SEQ ID NO: 4636 | mm38137_Mfsd8 | GAGCATCGTGTGGATGACTT |
| SEQ ID NO: 4637 | mm38346_Plxdc1 | ATTGTCAAAGTAAGCAACCG |
| SEQ ID NO: 4638 | mm38347_Plxdc1 | ACTCTGCATGGACTGCCAAG |
| SEQ ID NO: 4639 | mm38348_Plxdc1 | GGTTAGATTCGAGGACACGC |
| SEQ ID NO: 4640 | mm38349_Plxdc1 | TGTGGATCTTCACATGACTC |
| SEQ ID NO: 4641 | mm38410_Psca | GATAACTGTCACGAGTCCAA |
| SEQ ID NO: 4642 | mm38411_Psca | GCGATGTAAAGCAACTGTGC |
| SEQ ID NO: 4643 | mm38412_Psca | CTCGTGACAGTTATCAGTAA |

TABLE 1-continued mmSurf sgRNA library sequences

| SEQ ID NO | id_gRNA Target | Sequence |
|---|---|---|
| SEQ ID NO: 4644 | mm38413_Psca | ACCTACTTAGCCCTGCATCC |
| SEQ ID NO: 4645 | mm38446_Slc43a1 | GGATATCCCTGGTACCTCAG |
| SEQ ID NO: 4646 | mm38447_Slc43a1 | CTGACCCACAATGGTTACAT |
| SEQ ID NO: 4647 | mm38448_Slc43a1 | CTTAACGTTTACCTCACTCA |
| SEQ ID NO: 4648 | mm38449_Slc43a1 | CGGTCCATGAGAATTCCCAG |
| SEQ ID NO: 4649 | mm38526_Tmem87b | GCAGATACTCACATTCAATG |
| SEQ ID NO: 4650 | mm38527_Tmem87b | CAATGATTACCCTGATCTGG |
| SEQ ID NO: 4651 | mm38528_Tmem87b | GATGCAGAGATGTACCCATG |
| SEQ ID NO: 4652 | mm38529_Tmem87b | TGCATCACTGTTCCTAAGCG |
| SEQ ID NO: 4653 | mm38566_Rps6kb1 | ACTTCGGGTACTTGGTAAAG |
| SEQ ID NO: 4654 | mm38567_Rps6kb1 | TATTCATGGAAGACACAGCG |
| SEQ ID NO: 4655 | mm38568_Rps6kb1 | CTCTTAGCCTCCATTCACTG |
| SEQ ID NO: 4656 | mm38569_Rps6kb1 | AATGATAGTGAGGAATGCTA |
| SEQ ID NO: 4657 | mm38626_Naalad2 | AGAGAACATCGTAATGAACC |
| SEQ ID NO: 4658 | mm38627_Naalad2 | GAGGGATTGACCCTACCACT |
| SEQ ID NO: 4659 | mm38628_Naalad2 | TGTCAACTACGTCGTACTG |
| SEQ ID NO: 4660 | mm38629_Naalad2 | CAAAAATGCCATGCTAGCTG |
| SEQ ID NO: 4661 | mm38774_Calhm2 | TCCATACAGGTAGTTCCGGG |
| SEQ ID NO: 4662 | mm38775_Calhm2 | CAACCTATCGAGCTTCCGAG |
| SEQ ID NO: 4663 | mm38776_Calhm2 | CCCCCCAGCCCATGCTACGG |
| SEQ ID NO: 4664 | mm38777_Calhm2 | TAGTCGCCGAGTGCCAGTAC |
| SEQ ID NO: 4665 | mm38814_B3gat3 | GGACTCGCGGTGTCTCAGTG |
| SEQ ID NO: 4666 | mm38815_B3gat3 | TCTACACTGGCTGCTAGTGG |
| SEQ ID NO: 4667 | mm38816_B3gat3 | AATGACATAGATAGTAGGCA |
| SEQ ID NO: 4668 | mm38817_B3gat3 | ACGGAGATCAGCTTGCAACT |
| SEQ ID NO: 4669 | mm38902_Scn2b | CTGACACGTCGTACTTACTG |
| SEQ ID NO: 4670 | mm38903_Scn2b | AGTTAAGAGAGAACTGCTTG |
| SEQ ID NO: 4671 | mm38904_Scn2b | GGAGTGTAACAATTGCACAG |
| SEQ ID NO: 4672 | mm38905_Scn2b | TTGAGGACACTAAGAGTGGT |
| SEQ ID NO: 4673 | mm38982_Hepacam | CACTGACGACACCTTCACCG |
| SEQ ID NO: 4674 | mm38983_Hepacam | GCACCAAGCCTAGCTACACG |
| SEQ ID NO: 4675 | mm38984_Hepacam | GGTGCAGTCTATAGGCACAG |
| SEQ ID NO: 4676 | mm38985_Hepacam | CTCACTGAGCTCCAGCACAG |
| SEQ ID NO: 4677 | mm39026_Slc17a7 | TGGCGATGATGTAGCGACGA |
| SEQ ID NO: 4678 | mm39027_Slc17a7 | GGAGGAGCGCAAATACATTG |
| SEQ ID NO: 4679 | mm39028_Slc17a7 | GACACAGCCATAGTGAACGC |
| SEQ ID NO: 4680 | mm39029_Slc17a7 | TCCATCCTGAATACTGCACA |
| SEQ ID NO: 4681 | mm39122_Slc22a23 | GCCCGATTTCTGGTGCCGCG |

TABLE 1-continued mmSurf sgRNA library sequences

| SEQ ID NO | id_gRNA Target | Sequence |
|---|---|---|
| SEQ ID NO: 4682 | mm39123_Slc22a23 | TCGAGAAAGAGCTTTCACGG |
| SEQ ID NO: 4683 | mm39124_Slc22a23 | AAATTGCGACTGCCACGCGT |
| SEQ ID NO: 4684 | mm39125_Slc22a23 | AAAACGGTTCATAATTACCA |
| SEQ ID NO: 4685 | mm39230_Sppl2b | GCCAGTGATGGACTACAACA |
| SEQ ID NO: 4686 | mm39231_Sppl2b | TCCAATGATCACGTAGACTG |
| SEQ ID NO: 4687 | mm39232_Sppl2b | CTTCACCAACCAAATCGCAC |
| SEQ ID NO: 4688 | mm39233_Sppl2b | CATCACCCCCTTCCTGACCA |
| SEQ ID NO: 4689 | mm39358_Nptxr | AGACCGCATCGAGCGCATCG |
| SEQ ID NO: 4690 | mm39359_Nptxr | GGATGGTGTCCCGGTCTGCG |
| SEQ ID NO: 4691 | mm39360_Nptxr | CAGAGGAAGCGACTGAGCAG |
| SEQ ID NO: 4692 | mm39361_Nptxr | TCGGCCATGGTGTCGCGGCG |
| SEQ ID NO: 4693 | mm39398_Dcbld2 | GCTGCAGATAGACCTTAACA |
| SEQ ID NO: 4694 | mm39399_Dcbld2 | TGGATTCCAGCCATACACAA |
| SEQ ID NO: 4695 | mm39400_Dcbld2 | AGGTTATTGCCGTTCCGAGG |
| SEQ ID NO: 4696 | mm39401_Dcbld2 | GTCACAGTGCTGTTCATGAG |
| SEQ ID NO: 4697 | mm39610_Defb30 | AGAGCACGAGGGTCAACTGT |
| SEQ ID NO: 4698 | mm39611_Defb30 | AGAGCAAGACAAAGAGCACG |
| SEQ ID NO: 4699 | mm39612_Defb30 | AACGGATTTACGACACATGC |
| SEQ ID NO: 4700 | mm39613_Defb30 | TTGCTCTCCTATGTTCCACC |
| SEQ ID NO: 4701 | mm39674_Gucy2g | AAGAACCAGGAACGTCACCG |
| SEQ ID NO: 4702 | mm39675_Gucy2g | AACATGTCGTATGTCGCCAG |
| SEQ ID NO: 4703 | mm39676_Gucy2g | GGGTGGCACAAGTGTCACGC |
| SEQ ID NO: 4704 | mm39677_Gucy2g | AGCAAGTCTCCCAAGAACTG |
| SEQ ID NO: 4705 | mm39722_Psd | GAAGCAGGTAGGCCATTCAG |
| SEQ ID NO: 4706 | mm39723_Psd | GCCAGAATCAGGTTCAAGAG |
| SEQ ID NO: 4707 | mm39724_Psd | ATTACACTGGAAATATCGCT |
| SEQ ID NO: 4708 | mm39725_Psd | CCTTCCTGAAGCCATCGAGT |
| SEQ ID NO: 4709 | mm39914_Psd2 | GAGGGCTCGAGATAGCCCCG |
| SEQ ID NO: 4710 | mm39915_Psd2 | GGCGAACCAGATGTACGTGA |
| SEQ ID NO: 4711 | mm39916_Psd2 | CCAGGCCATTGGTCAAAGAG |
| SEQ ID NO: 4712 | mm39917_Psd2 | AACTTGGACCAGCTGAACGA |
| SEQ ID NO: 4713 | mm39982_Nfam1 | CAGGCAAACACATCAGCCAC |
| SEQ ID NO: 4714 | mm39983_Nfam1 | GAGGAAACATATCAGAGCGA |
| SEQ ID NO: 4715 | mm39984_Nfam1 | TTCATACGGATATCCATGGC |
| SEQ ID NO: 4716 | mm39985_Nfam1 | CCCCAATGTTCAGTCAAAGA |
| SEQ ID NO: 4717 | mm40078_Slc35a5 | ATTGAACTATAATCAGAACG |
| SEQ ID NO: 4718 | mm40079_Slc35a5 | AAGAGACAATTGTACATCGA |
| SEQ ID NO: 4719 | mm40080_Slc35a5 | GATTCTGTTCTTGTCTATCG |

TABLE 1-continued mmSurf sgRNA library sequences

| SEQ ID NO | id_gRNA Target | Sequence |
|---|---|---|
| SEQ ID NO: 4720 | mm40081_Slc35a5 | CTCTGAGCACACGTTCACAG |
| SEQ ID NO: 4721 | mm40182_Tm9sf1 | TATTTGCCAATGTTTCGGTG |
| SEQ ID NO: 4722 | mm40183_Tm9sf1 | CCATGTAGCCCACAAAACCA |
| SEQ ID NO: 4723 | mm40184_Tm9sf1 | GGACAACCAATGGATTTCCA |
| SEQ ID NO: 4724 | mm40185_Tm9sf1 | GTTCAACGTGCACCGTCACG |
| SEQ ID NO: 4725 | mm40194_Robo4 | GACTATCTGAGCTAGCCCAG |
| SEQ ID NO: 4726 | mm40195_Robo4 | CAGAGGGCCGATGTAACAGG |
| SEQ ID NO: 4727 | mm40196_Robo4 | GAGCAGAGAAGAATGACTCG |
| SEQ ID NO: 4728 | mm40197_Robo4 | TTCACCCACTACGGTCCAGT |
| SEQ ID NO: 4729 | mm40822_Hyal5 | TACATGCCAATAGACAATGT |
| SEQ ID NO: 4730 | mm40823_Hyal5 | TGTGAAACAAGACTCAGTTG |
| SEQ ID NO: 4731 | mm40824_Hyal5 | CTTCGGCCAAATCACTTATG |
| SEQ ID NO: 4732 | mm40825_Hyal5 | TTTGACTTTAGACACTCGAA |
| SEQ ID NO: 4733 | mm41010_Cd200r3 | GTGATGTGCAGGGACCCTAG |
| SEQ ID NO: 4734 | mm41011_Cd200r3 | AAAGGAAATGAATCATCCGG |
| SEQ ID NO: 4735 | mm41012_Cd200r3 | GTCGGATAGAAACAACAGAT |
| SEQ ID NO: 4736 | mm41013_Cd200r3 | CTGTAGGGTAGTCTGCAGGA |
| SEQ ID NO: 4737 | mm41022_Scpep1 | AAACTCCATACTTACCCACG |
| SEQ ID NO: 4738 | mm41023_Scpep1 | GGATTATGTGACTGTCCGAA |
| SEQ ID NO: 4739 | mm41024_Scpep1 | CACAACAGATGCCTACGCAA |
| SEQ ID NO: 4740 | mm41025_Scpep1 | CAAGCCTCGAAATACTACCT |
| SEQ ID NO: 4741 | mm41170_Mxra8 | TCACTGACACGCGATCACGC |
| SEQ ID NO: 4742 | mm41171_Mxra8 | TGTGCGCCTCGAGGTTACAG |
| SEQ ID NO: 4743 | mm41172_Mxra8 | GACTGACCGCCATTTAGAGG |
| SEQ ID NO: 4744 | mm41173_Mxra8 | CTTGTGGATATGTATTCGGC |
| SEQ ID NO: 4745 | mm41174_Mdga1 | CTTCAACGTACGACCCCGGG |
| SEQ ID NO: 4746 | mm41175_Mdga1 | CAGACAGTGAGCGATGTCCG |
| SEQ ID NO: 4747 | mm41176_Mdga1 | GTGTCCGTGCGCAATGTGTG |
| SEQ ID NO: 4748 | mm41177_Mdga1 | GCTTTCTTTGATCATGTCGG |
| SEQ ID NO: 4749 | mm41450_Sv2c | ATCCCGAATTTGGTATGCAT |
| SEQ ID NO: 4750 | mm41451_Sv2c | GAAGTCACCTTACCGTAGTG |
| SEQ ID NO: 4751 | mm41452_Sv2c | TGGCGAAACCTACAGTGGGG |
| SEQ ID NO: 4752 | mm41453_Sv2c | GACACCAACATGAGAGCCCG |
| SEQ ID NO: 4753 | mm41566_Slamf7 | ACATGTCAGATTGATTACGC |
| SEQ ID NO: 4754 | mm41567_Slamf7 | CCTGAGTGAAGTTAGATCCG |
| SEQ ID NO: 4755 | mm41568_Slamf7 | GAATGTCACAGATCCATCAA |
| SEQ ID NO: 4756 | mm41569_Slamf7 | AGACCAGGCCTTAACATGCA |
| SEQ ID NO: 4757 | mm41594_Defb29 | AGAGAGACTCGAGTTACCTG |

TABLE 1-continued mmSurf sgRNA library sequences

| SEQ ID NO | id_gRNA Target | Sequence |
|---|---|---|
| SEQ ID NO: 4758 | mm41595_Defb29 | GTCATACTTCATGACTGTGG |
| SEQ ID NO: 4759 | mm41596_Defb29 | TAAAGCTCACACGCAATCCA |
| SEQ ID NO: 4760 | mm41597_Defb29 | ATTGCGTGTGAGCTTTACCA |
| SEQ ID NO: 4761 | mm41926_Gns | CCAAAGTGTTGTTAACGACG |
| SEQ ID NO: 4762 | mm41927_Gns | TGCTGGGAAGTATTTAAACG |
| SEQ ID NO: 4763 | mm41928_Gns | TCAGACAACGGCTACCACAC |
| SEQ ID NO: 4764 | mm41929_Gns | CAGAGGAACCTACCGTCCCG |
| SEQ ID NO: 4765 | mm42162_Dcstamp | AAGCGTTCCTACCTTCACGG |
| SEQ ID NO: 4766 | mm42163_Dcstamp | GCTCATATGAATGACACTAG |
| SEQ ID NO: 4767 | mm42164_Dcstamp | AAGGCCGTAAATCCACTGGA |
| SEQ ID NO: 4768 | mm42165_Dcstamp | CCCACATGTAGAGATAGGTC |
| SEQ ID NO: 4769 | mm42166_Rab11fip1 | CAAGGAGAAGTACGCCACGT |
| SEQ ID NO: 4770 | mm42167_Rab11fip1 | CGGGAACTCACCATCCGAGG |
| SEQ ID NO: 4771 | mm42168_Rab11fip1 | GAGCAACGCGCGGTGCAGGA |
| SEQ ID NO: 4772 | mm42169_Rab11fip1 | CGTTGATACAGACGGTAGAG |
| SEQ ID NO: 4773 | mm42366_Cant1 | GGAGTGGGATAAAGACCACG |
| SEQ ID NO: 4774 | mm42367_Cant1 | CAGCACCCACAAAGGACGTG |
| SEQ ID NO: 4775 | mm42368_Cant1 | CCATCAGAAAGGATCACCCA |
| SEQ ID NO: 4776 | mm42369_Cant1 | GGAGTGGACCACCACGACAG |
| SEQ ID NO: 4777 | mm42542_Slc38a3 | AGCTGTCGCATCAGTGCTAG |
| SEQ ID NO: 4778 | mm42543_Slc38a3 | CATGACATACATGACAGCAA |
| SEQ ID NO: 4779 | mm42544_Slc38a3 | GATGTATAGGTAGCTGGACA |
| SEQ ID NO: 4780 | mm42545_Slc38a3 | ACCTGCTCCTCAAGTCTTCG |
| SEQ ID NO: 4781 | mm42578_Mfap4 | CTTCTGCGACATGACAACTG |
| SEQ ID NO: 4782 | mm42579_Mfap4 | TGTGATGATATCTACGCCCA |
| SEQ ID NO: 4783 | mm42580_Mfap4 | GAAGTCAATGTACTTGGCAT |
| SEQ ID NO: 4784 | mm42581_Mfap4 | CCTCGAAGCCAGCCACGTAG |
| SEQ ID NO: 4785 | mm42590_Erp44 | TGTAATCTACAAACCACCCG |
| SEQ ID NO: 4786 | mm42591_Erp44 | AATGTTATTTCTCGGACAAG |
| SEQ ID NO: 4787 | mm42592_Erp44 | GTGCTGATCACAATCAACTC |
| SEQ ID NO: 4788 | mm42593_Erp44 | CATCTAGACTCTGAATCTCG |
| SEQ ID NO: 4789 | mm42740_Prss23 | TGAGTCCCTACACCGTTCCG |
| SEQ ID NO: 4790 | mm42741_Prss23 | AAGGGCAATGCCAATGACAT |
| SEQ ID NO: 4791 | mm42742_Prss23 | GTGACACTGAGGTCCACATG |
| SEQ ID NO: 4792 | mm42743_Prss23 | CTGCCCACTGCATACACGAT |
| SEQ ID NO: 4793 | mm42792_Glt8d1 | AACAATGTAAAACATCACAT |
| SEQ ID NO: 4794 | mm42793_Glt8d1 | TAAAGCAGGATCCTGACCAG |
| SEQ ID NO: 4795 | mm42794_Glt8d1 | TCCCCGGATGATGACTTTAG |

TABLE 1-continued mmSurf sgRNA library sequences

| SEQ ID NO | id_gRNA Target | Sequence |
|---|---|---|
| SEQ ID NO: 4796 | mm42795_Glt8d1 | GCACTGGCGACAAAGTCTAT |
| SEQ ID NO: 4797 | mm42796_Ly6k | TGTCGAAACAGTGCACCCGA |
| SEQ ID NO: 4798 | mm42797_Ly6k | GATGGTGGATTAGTGCTAGG |
| SEQ ID NO: 4799 | mm42798_Ly6k | TGTTCTGCGCCTCACACACA |
| SEQ ID NO: 4800 | mm42799_Ly6k | TTATAAAATAGGAAGGGCAT |
| SEQ ID NO: 4801 | mm42832_Plet1 | CACTGACTGAATCGTTCACG |
| SEQ ID NO: 4802 | mm42833_Plet1 | GATGTTATCAAGGACCACGC |
| SEQ ID NO: 4803 | mm42834_Plet1 | CTTGACATCCCAAAGCCAGT |
| SEQ ID NO: 4804 | mm42835_Plet1 | TCATCCGTGAAAATGGAACA |
| SEQ ID NO: 4805 | mm42900_Mfsd2a | TCAGGGACGGAAAGTTCACA |
| SEQ ID NO: 4806 | mm42901_Mfsd2a | GCAGCCGGTCAACTGGTACG |
| SEQ ID NO: 4807 | mm42902_Mfsd2a | GAGGGACTTACTGTATGCCG |
| SEQ ID NO: 4808 | mm42903_Mfsd2a | TCTCTACTTACCAGGGCATG |
| SEQ ID NO: 4809 | mm43032_Arpc2 | AGTTGTTAAAGAGAGTGTAT |
| SEQ ID NO: 4810 | mm43033_Arpc2 | TCTTAGATTCCACATACCTG |
| SEQ ID NO: 4811 | mm43034_Arpc2 | GAAGTATTTCTCAAACACAG |
| SEQ ID NO: 4812 | mm43035_Arpc2 | CATCGGAAAGGTGTTCATGC |
| SEQ ID NO: 4813 | mm43072_Alpi | AAACTAAGGTATTACCCATG |
| SEQ ID NO: 4814 | mm43073_Alpi | AAGGCCAACTACAAGACCAT |
| SEQ ID NO: 4815 | mm43074_Alpi | AGCCGGCACCTACGCACACA |
| SEQ ID NO: 4816 | mm43075_Alpi | ACAGTAACCAGTCTGGAACC |
| SEQ ID NO: 4817 | mm43148_Calcoco2 | GATGAAGATGGTTTAGTCCG |
| SEQ ID NO: 4818 | mm43149_Calcoco2 | AGCGCTCCACATCCTTGGGA |
| SEQ ID NO: 4819 | mm43150_Calcoco2 | CCAATCCAGTCCTTGCGTCG |
| SEQ ID NO: 4820 | mm43151_Calcoco2 | GAGAAGTTCTATGCTCCTAG |
| SEQ ID NO: 4821 | mm43308_Hnrnpm | ATTGGCATGGGATTAGGACC |
| SEQ ID NO: 4822 | mm43309_Hnrnpm | AGGTGATGGCTACGACTGGT |
| SEQ ID NO: 4823 | mm43310_Hnrnpm | GCCCATGCGCTCAATACTGG |
| SEQ ID NO: 4824 | mm43311_Hnrnpm | CTAAGTAATGCACTGAAGAG |
| SEQ ID NO: 4825 | mm43436_Hyal4 | TGATATTGAATATTCAGCCA |
| SEQ ID NO: 4826 | mm43437_Hyal4 | TTCGGGTGCGTGAATCACTG |
| SEQ ID NO: 4827 | mm43438_Hyal4 | GATATAAATAATAACCCCAA |
| SEQ ID NO: 4828 | mm43439_Hyal4 | TGCTGTTCCAGAGCCAAGAG |
| SEQ ID NO: 4829 | mm43656_Myh10 | TCTGCATCATCCACTACGCG |
| SEQ ID NO: 4830 | mm43657_Myh10 | AGATAAGTCCTGAATAGTAG |
| SEQ ID NO: 4831 | mm43658_Myh10 | GAATGTGATGGAGTTCACTC |
| SEQ ID NO: 4832 | mm43659_Myh10 | TGTAACTGGCTATATTGTTG |
| SEQ ID NO: 4833 | mm43748_Defb12 | GAAGAATCTCCCCTCAAACA |

TABLE 1-continued mmSurf sgRNA library sequences

| SEQ ID NO | id_gRNA Target | Sequence |
|---|---|---|
| SEQ ID NO: 4834 | mm43749_Defb12 | TTTACCTCCTGGAAATGACT |
| SEQ ID NO: 4835 | mm43750_Defb12 | GGAATACTCAAGTCCTGCCC |
| SEQ ID NO: 4836 | mm43751_Defb12 | ATTGTAGTTGAACTGCCATC |
| SEQ ID NO: 4837 | mm43756_Bsph2 | TGGCGGTACTGTACAGCACA |
| SEQ ID NO: 4838 | mm43757_Bsph2 | AACACCAATCATAGTCACTG |
| SEQ ID NO: 4839 | mm43758_Bsph2 | GATGAGCCATCTTGTGCACT |
| SEQ ID NO: 4840 | mm43759_Bsph2 | GGAGGGAGATACAACTGTAG |
| SEQ ID NO: 4841 | mm43812_Ulbp1 | GAAGTTTATAGAAATGTGCA |
| SEQ ID NO: 4842 | mm43813_Ulbp1 | TTCCGTGTTGACACAAGCAC |
| SEQ ID NO: 4843 | mm43814_Ulbp1 | CACGCATAGAATAATCATCA |
| SEQ ID NO: 4844 | mm43815_Ulbp1 | GTGCAGGAGACTAACACAAC |
| SEQ ID NO: 4845 | mm43984_Lpar4 | CTGATGGTACGCGATCGGAA |
| SEQ ID NO: 4846 | mm43985_Lpar4 | GCAGTTGCATTTCCCAACCT |
| SEQ ID NO: 4847 | mm43986_Lpar4 | GCGGAAGCAGAAGACAAACA |
| SEQ ID NO: 4848 | mm43987_Lpar4 | GAAGCCTTCAAAGCAAGTGG |
| SEQ ID NO: 4849 | mm44128_Ttyh3 | GGAAATGCAAGATGTTGTCG |
| SEQ ID NO: 4850 | mm44129_Ttyh3 | GAGCACTCAGTACTGAGTGG |
| SEQ ID NO: 4851 | mm44130_Ttyh3 | GAACCCCGGAGTATCGCTGG |
| SEQ ID NO: 4852 | mm44131_Ttyh3 | ACGCCATGCCAACCGCACAG |
| SEQ ID NO: 4853 | mm44244_Adgra3 | GCTGCGAGTGTATACCGCAG |
| SEQ ID NO: 4854 | mm44245_Adgra3 | GAGCGGGTGACCAACAACCG |
| SEQ ID NO: 4855 | mm44246_Adgra3 | TCTCCATAGGAGCCCCATTG |
| SEQ ID NO: 4856 | mm44247_Adgra3 | GCTGAATGCATTCCCGCGGG |
| SEQ ID NO: 4857 | mm44464_P2ry10 | TGATCTTGGGTACAAACAGA |
| SEQ ID NO: 4858 | mm44465_P2ry10 | TGGAAGCGTAGGTACGATGT |
| SEQ ID NO: 4859 | mm44466_P2ry10 | TTTCCAGGTACAACATGCAA |
| SEQ ID NO: 4860 | mm44467_P2ry10 | GTAAGGACAGGATATGAGCA |
| SEQ ID NO: 4861 | mm44532_Igsf3 | CGAGTACGGGACCTACGCCG |
| SEQ ID NO: 4862 | mm44533_Igsf3 | AGTACAGATCGTTAGCACGG |
| SEQ ID NO: 4863 | mm44534_Igsf3 | CCAGCAGCGAATATGCCCAG |
| SEQ ID NO: 4864 | mm44535_Igsf3 | AGTGCCAAGATGAACCTAGT |
| SEQ ID NO: 4865 | mm44576_Pigt | GATCCGAATCCCAACGCGTG |
| SEQ ID NO: 4866 | mm44577_Pigt | AAACAAGTCATAGACGGCAT |
| SEQ ID NO: 4867 | mm44578_Pigt | GGTAACTGGTGTGGAACAAG |
| SEQ ID NO: 4868 | mm44579_Pigt | TGAGAGTCCGGGAGAACATG |
| SEQ ID NO: 4869 | mm44620_Tnfrsf23 | GTCACCCAGGAACATTCACA |
| SEQ ID NO: 4870 | mm44621_Tnfrsf23 | ATTAGACTGGTATTCACCAT |
| SEQ ID NO: 4871 | mm44622_Tnfrsf23 | GATTGCAGACCAGAATATGG |

TABLE 1-continued mmSurf sgRNA library sequences

| SEQ ID NO | id_gRNA Target | Sequence |
|---|---|---|
| SEQ ID NO: 4872 | mm44623_Tnfrsf23 | TGTTGCAAGACCTGTCCCTC |
| SEQ ID NO: 4873 | mm44624_Tnfrsf22 | AGCAAAGTATACAAGCATCC |
| SEQ ID NO: 4874 | mm44625_Tnfrsf22 | TTTAGACCAGTATTCACCAG |
| SEQ ID NO: 4875 | mm44626_Tnfrsf22 | TGAGTATGGGGATTTCGCA |
| SEQ ID NO: 4876 | mm44627_Tnfrsf22 | GATTGCAGATCAGGAAATGG |
| SEQ ID NO: 4877 | mm44736_Pofut2 | ACTGCTCATACTCTATAACG |
| SEQ ID NO: 4878 | mm44737_Pofut2 | CGTCCTACAAGGTTACGCCG |
| SEQ ID NO: 4879 | mm44738_Pofut2 | TTTGGGCTACGAAGAAACA |
| SEQ ID NO: 4880 | mm44739_Pofut2 | CTCCGGGCCATCTTATCAG |
| SEQ ID NO: 4881 | mm44812_Lrfn1 | ACACACACAAATCATAGGCG |
| SEQ ID NO: 4882 | mm44813_Lrfn1 | CCGGGATGGACCAGAAATAG |
| SEQ ID NO: 4883 | mm44814_Lrfn1 | TGTTGCCGAGGATCAAGTGG |
| SEQ ID NO: 4884 | mm44815_Lrfn1 | CTACATAAATTGCCCCCCGA |
| SEQ ID NO: 4885 | mm44828_Klrb1b | ATCAGTACAAAAAATCTGCG |
| SEQ ID NO: 4886 | mm44829_Klrb1b | CAATCACGACCAGCACAAGA |
| SEQ ID NO: 4887 | mm44830_Klrb1b | AGAGCCAACCGATGCCAGCG |
| SEQ ID NO: 4888 | mm44831_Klrb1b | ATGCAGATTTAAACCTAGCC |
| SEQ ID NO: 4889 | mm44852_Hist1h1a | CCTGGTGAATAAAGGCACAC |
| SEQ ID NO: 4890 | mm44853_Hist1h1a | TCCGACACCGAAGGTCCCGC |
| SEQ ID NO: 4891 | mm44854_Hist1h1a | AGCCAGCGACTTCTTGAGCG |
| SEQ ID NO: 4892 | mm44855_Hist1h1a | GAAACCTAAGAAGACTGCTG |
| SEQ ID NO: 4893 | mm45080_Sil1 | CCTACAGACTGGAGTAAACG |
| SEQ ID NO: 4894 | mm45081_Sil1 | TGTTCCACCCAACTCAAGAG |
| SEQ ID NO: 4895 | mm45082_Sil1 | AGCAGCATACTCCTTCACCA |
| SEQ ID NO: 4896 | mm45083_Sil1 | CAAGGAAAAACAATACCTGA |
| SEQ ID NO: 4897 | mm45116_Sorcs2 | GGGAATAGCGAACCCCACGC |
| SEQ ID NO: 4898 | mm45117_Sorcs2 | GTACCGTGCCTGACACATAG |
| SEQ ID NO: 4899 | mm45118_Sorcs2 | GTAGGTTGTCCCAAAATCTG |
| SEQ ID NO: 4900 | mm45119_Sorcs2 | CAACCCATCCACGAACACTG |
| SEQ ID NO: 4901 | mm45140_Cacng7 | GCCGCAGAACCAGACCACCG |
| SEQ ID NO: 4902 | mm45141_Cacng7 | ACTTTCACTATCGCTACGGG |
| SEQ ID NO: 4903 | mm45142_Cacng7 | TCGGCCACATCCGACCTCAG |
| SEQ ID NO: 4904 | mm45143_Cacng7 | CATCTCCAGCATCAACGACG |
| SEQ ID NO: 4905 | mm45144_Cacng8 | GATGACGGACCACCCCATCG |
| SEQ ID NO: 4906 | mm45145_Cacng8 | GTGTACATATCGGCCAACGC |
| SEQ ID NO: 4907 | mm45146_Cacng8 | AGCCGCGAAGGCGCCGATGG |
| SEQ ID NO: 4908 | mm45147_Cacng8 | GGACTACGACCACGACAGCG |
| SEQ ID NO: 4909 | mm45152_Tmem108 | GAAGAGAAGTAGCCCCCGAG |

TABLE 1-continued mmSurf sgRNA library sequences

| SEQ ID NO | id_gRNA Target | Sequence |
|---|---|---|
| SEQ ID NO: 4910 | mm45153_Tmem108 | ACTCTCACACCCGTACCGGG |
| SEQ ID NO: 4911 | mm45154_Tmem108 | GGCTTTATCAGATCCAACCA |
| SEQ ID NO: 4912 | mm45155_Tmem108 | AGGGTCTGTAGAGATTCCCT |
| SEQ ID NO: 4913 | mm45172_Siglece | GACCAGCTTAGGTTCGCAGG |
| SEQ ID NO: 4914 | mm45173_Siglece | CATGTGGGACAAGATGACTC |
| SEQ ID NO: 4915 | mm45174_Siglece | TGTACCAGAATCCATGAACT |
| SEQ ID NO: 4916 | mm45175_Siglece | CCTCACATGACACGTTGAGA |
| SEQ ID NO: 4917 | mm45212_Ctns | AGGCATCATTACTGTCGACG |
| SEQ ID NO: 4918 | mm45213_Ctns | TGGAGGGCCATGACACACGC |
| SEQ ID NO: 4919 | mm45214_Ctns | TAACAGGTTATAGTGCCTCG |
| SEQ ID NO: 4920 | mm45215_Ctns | CCCAAGGGTGATGTCGACGT |
| SEQ ID NO: 4921 | mm45224_Trem2 | TATGACGCCTTGAAGCACTG |
| SEQ ID NO: 4922 | mm45225_Trem2 | CGAAACTCGATGACTCCTCG |
| SEQ ID NO: 4923 | mm45226_Trem2 | TACCAGTGTCAGAGTCTCCG |
| SEQ ID NO: 4924 | mm45227_Trem2 | ACTCTGAAGAACCTCCAAGC |
| SEQ ID NO: 4925 | mm45240_Chrdl1 | TGTTTGGTGGAGGATCGTAG |
| SEQ ID NO: 4926 | mm45241_Chrdl1 | CAGGGGATGCAGAATTATCG |
| SEQ ID NO: 4927 | mm45242_Chrdl1 | TCAAGACAAGAAGTATAGAG |
| SEQ ID NO: 4928 | mm45243_Chrdl1 | AGCAAGTCATGCGAATACAA |
| SEQ ID NO: 4929 | mm45328_Elovl4 | TTCATGGGATCATACAACGC |
| SEQ ID NO: 4930 | mm45329_Elovl4 | ACACCGTGGAGTTCTATCGC |
| SEQ ID NO: 4931 | mm45330_Elovl4 | TGCAGTGGTGGTACACGTGA |
| SEQ ID NO: 4932 | mm45331_Elovl4 | CGATACAAAATACCACCACA |
| SEQ ID NO: 4933 | mm45372_Slc12a9 | TAGATGCCGATCAACACGAG |
| SEQ ID NO: 4934 | mm45373_Slc12a9 | GCCATGCCGGTGTGGCACGG |
| SEQ ID NO: 4935 | mm45374_Slc12a9 | GCTCTTCTCACCGCACGAGG |
| SEQ ID NO: 4936 | mm45375_Slc12a9 | AAACACGACTATGCTAAACA |
| SEQ ID NO: 4937 | mm45424_Tmem2 | ACCATTGGCTTCGACACACT |
| SEQ ID NO: 4938 | mm45425_Tmem2 | TTGTCGCTTTGGATCTATAG |
| SEQ ID NO: 4939 | mm45426_Tmem2 | GGAAGCTGGAGACCGAATTG |
| SEQ ID NO: 4940 | mm45427_Tmem2 | GATTTGCAGATAACGGAAAG |
| SEQ ID NO: 4941 | mm45452_Jam3 | TTCAGCCATCTATCGCTGTG |
| SEQ ID NO: 4942 | mm45453_Jam3 | TTGCGGTACCAGCTGTAGTG |
| SEQ ID NO: 4943 | mm45454_Jam3 | TTTCAAATTCATGTACCACT |
| SEQ ID NO: 4944 | mm45455_Jam3 | GAATGGAAGAAAATCCAAGA |
| SEQ ID NO: 4945 | mm45456_Enpp5 | AATAGGTCGGGAAACTATCG |
| SEQ ID NO: 4946 | mm45457_Enpp5 | TGGGAAGAACCCGATGACAC |
| SEQ ID NO: 4947 | mm45458_Enpp5 | TCATCGTCACGAGCGACCAT |

TABLE 1-continued mmSurf sgRNA library sequences

| SEQ ID NO | id_gRNA Target | Sequence |
|---|---|---|
| SEQ ID NO: 4948 | mm45459_Enpp5 | CGTTAGATTAGGATGGGCAC |
| SEQ ID NO: 4949 | mm45480_Mcam | CCTGCCGAAAAGCACCATAG |
| SEQ ID NO: 4950 | mm45481_Mcam | ACTATTCAAGCCAATGTCGT |
| SEQ ID NO: 4951 | mm45482_Mcam | AGGAACATTCGCTCATCATG |
| SEQ ID NO: 4952 | mm45483_Mcam | CCACATGAAGGAATCTAAGG |
| SEQ ID NO: 4953 | mm45496_Plvap | CGGACGTGCTGAGTGCGTGG |
| SEQ ID NO: 4954 | mm45497_Plvap | GCTGTCGGCGCGGATCTCCG |
| SEQ ID NO: 4955 | mm45498_Plvap | CGGAGTACGCGTCCCTCCGT |
| SEQ ID NO: 4956 | mm45499_Plvap | CCTGTGGCAAAGCACGCGAA |
| SEQ ID NO: 4957 | mm45528_Cd96 | AGTGGGTAGATGTTTCGTTG |
| SEQ ID NO: 4958 | mm45529_Cd96 | CCAGTCCAAATCCAAGACGA |
| SEQ ID NO: 4959 | mm45530_Cd96 | CCACAGTAGAGGCCATATTG |
| SEQ ID NO: 4960 | mm45531_Cd96 | TACAGTCTACAACCTCATTG |
| SEQ ID NO: 4961 | mm45576_Cd163 | ACCTGTCCTTCGGAACACGT |
| SEQ ID NO: 4962 | mm45577_Cd163 | GTACAAGTTCTGTCTAGCGG |
| SEQ ID NO: 4963 | mm45578_Cd163 | CTCTGGGACTGCAAACACCG |
| SEQ ID NO: 4964 | mm45579_Cd163 | AAACTGGGGCAACAAATACG |
| SEQ ID NO: 4965 | mm45592_Clec2i | GGGCAAATGTCCAGTTACGT |
| SEQ ID NO: 4966 | mm45593_Clec2i | TGCACACCTCCAGTTCCAAG |
| SEQ ID NO: 4967 | mm45594_Clec2i | GCTTGCTCAAAAAACTGGAC |
| SEQ ID NO: 4968 | mm45595_Clec2i | AGCTCGGTTTGACAACGAGG |
| SEQ ID NO: 4969 | mm45608_Glce | AGGACATAAACACACCGTCA |
| SEQ ID NO: 4970 | mm45609_Glce | CTTGAGTAGTGGATTCAGAG |
| SEQ ID NO: 4971 | mm45610_Glce | GGGGGCTTCAATAGCAACGG |
| SEQ ID NO: 4972 | mm45611_Glce | TCTCTACCCAAGTGAATGGA |
| SEQ ID NO: 4973 | mm45616_Entpd7 | TCTGAATTATGGACTCGTGG |
| SEQ ID NO: 4974 | mm45617_Entpd7 | AGATAGCCAACTGTTGCCTG |
| SEQ ID NO: 4975 | mm45618_Entpd7 | CCTGTCCCGTGGTAACGAAG |
| SEQ ID NO: 4976 | mm45619_Entpd7 | GTGGTTAAGAAAATAAAGCC |
| SEQ ID NO: 4977 | mm45648_Clec2d | AAGCTTAGCACAAGACTCAG |
| SEQ ID NO: 4978 | mm45649_Clec2d | GGGCGAATGTCCAGTTACTT |
| SEQ ID NO: 4979 | mm45650_Clec2d | ACTAGCTCGGTTTGACAACC |
| SEQ ID NO: 4980 | mm45651_Clec2d | TTACCCACTTCTACCTCCTG |
| SEQ ID NO: 4981 | mm45652_Gpnmb | AGAGAGCACAACCAATTACG |
| SEQ ID NO: 4982 | mm45653_Gpnmb | TCCATGGATTTGTAACCAGT |
| SEQ ID NO: 4983 | mm45654_Gpnmb | GGCATACATTCCCATCTCGA |
| SEQ ID NO: 4984 | mm45655_Gpnmb | AGGAAATGGCAGAGTCGTTG |
| SEQ ID NO: 4985 | mm45856_Igsf9 | CAATGCAGAAGTACCCCCCG |

TABLE 1-continued mmSurf sgRNA library sequences

| SEQ ID NO | id_gRNA Target | Sequence |
|---|---|---|
| SEQ ID NO: 4986 | mm45857_Igsf9 | ACTGACGTAGCTATCAGCGA |
| SEQ ID NO: 4987 | mm45858_Igsf9 | ACGTAATCGGGGTCAATTCG |
| SEQ ID NO: 4988 | mm45859_Igsf9 | GGGCTGGTCTATAAAAGCCG |
| SEQ ID NO: 4989 | mm45960_Fzd10 | GGGTCACGAGAACCAGCGCG |
| SEQ ID NO: 4990 | mm45961_Fzd10 | GGAAGATGATAGGACGTTCG |
| SEQ ID NO: 4991 | mm45962_Fzd10 | GGTACTTTACTACTTCGGCA |
| SEQ ID NO: 4992 | mm45963_Fzd10 | GAGCACCCACTAAAGGACGG |
| SEQ ID NO: 4993 | mm45984_Tm2d1 | GGCGACCGTCACGAGCCACA |
| SEQ ID NO: 4994 | mm45985_Tm2d1 | GAGGATATTGTCCCACCCTG |
| SEQ ID NO: 4995 | mm45986_Tm2d1 | TGTACAAACTACACAGCTCA |
| SEQ ID NO: 4996 | mm45987_Tm2d1 | ATAACTTGTAAGGATTTGAG |
| SEQ ID NO: 4997 | mm46060_Csmd1 | GTACTTACCAATGCACAAAG |
| SEQ ID NO: 4998 | mm46061_Csmd1 | GTCACACACTCAATGGACGA |
| SEQ ID NO: 4999 | mm46062_Csmd1 | CGAACTGAAACCCAATTCTG |
| SEQ ID NO: 5000 | mm46063_Csmd1 | GTGGTACTCTCCTATGAGTG |
| SEQ ID NO: 5001 | mm46076_Mcoln1 | GACATAGGCATACCGGCCCA |
| SEQ ID NO: 5002 | mm46077_Mcoln1 | TTTGACAATAAAGCGCACAG |
| SEQ ID NO: 5003 | mm46078_Mcoln1 | ATACCTTTGACATTGATCCA |
| SEQ ID NO: 5004 | mm46079_Mcoln1 | TGGCCCGGAACTTGTCACAT |
| SEQ ID NO: 5005 | mm46128_Spock2 | AGACGCAGTAGACTGCTCCG |
| SEQ ID NO: 5006 | mm46129_Spock2 | TCTGCTTGGAGTTCTCACGA |
| SEQ ID NO: 5007 | mm46130_Spock2 | ACAGCGGCAAGATTAAGCAC |
| SEQ ID NO: 5008 | mm46131_Spock2 | AGAGCTGTAGGTATGGCCGT |
| SEQ ID NO: 5009 | mm46136_Lrp1b | AAGACGTTCTGAGATCCGAG |
| SEQ ID NO: 5010 | mm46137_Lrp1b | GTGGGAGTAGTAGACTACCA |
| SEQ ID NO: 5011 | mm46138_Lrp1b | ACACAGCGACGATTGTAGCA |
| SEQ ID NO: 5012 | mm46139_Lrp1b | TATGATCCACGAAAACAACA |
| SEQ ID NO: 5013 | mm46144_Cnnm2 | ACCGTCGTGGTAAATCCAGG |
| SEQ ID NO: 5014 | mm46145_Cnnm2 | CGGCGATTGAGAATGATGTG |
| SEQ ID NO: 5015 | mm46146_Cnnm2 | TGCTAACCGGATAAGAAGCG |
| SEQ ID NO: 5016 | mm46147_Cnnm2 | CTGCTTCATGATAACCGGCG |
| SEQ ID NO: 5017 | mm46148_Cnnm4 | AGAGCGTGATCCTAGGCATG |
| SEQ ID NO: 5018 | mm46149_Cnnm4 | CCATGATGCCAGACCCGATG |
| SEQ ID NO: 5019 | mm46150_Cnnm4 | GAAAACAAAATGTACCGGG |
| SEQ ID NO: 5020 | mm46151_Cnnm4 | GCATCCCCGACGTGTTCCCG |
| SEQ ID NO: 5021 | mm46176_Slc4a10 | AGAGAACATCTGGCACGTAG |
| SEQ ID NO: 5022 | mm46177_Slc4a10 | CACGATGCCTGTGACGACGA |
| SEQ ID NO: 5023 | mm46178_Slc4a10 | TGAGATTTGCTGGCGTGAAG |

TABLE 1-continued mmSurf sgRNA library sequences

| SEQ ID NO | id_gRNA Target | Sequence |
|---|---|---|
| SEQ ID NO: 5024 | mm46179_Slc4a10 | TTCCTGATACCAAGTCATTG |
| SEQ ID NO: 5025 | mm46204_Slc24a3 | AATCCCAATTAAGCACACAG |
| SEQ ID NO: 5026 | mm46205_Slc24a3 | GGCCCCAGAGCTGTTCACGT |
| SEQ ID NO: 5027 | mm46206_Slc24a3 | CAGCAACTGCGATGCCACTG |
| SEQ ID NO: 5028 | mm46207_Slc24a3 | TCCAATGAAGACCGACGACA |
| SEQ ID NO: 5029 | mm46244_Cadm3 | CTGGTTATAAGTCATCATTG |
| SEQ ID NO: 5030 | mm46245_Cadm3 | CTGAATCCGATTATCTCGAA |
| SEQ ID NO: 5031 | mm46246_Cadm3 | AGCTGTTGTTACATTGTGAG |
| SEQ ID NO: 5032 | mm46247_Cadm3 | GACATCTGATGAAACAGTTG |
| SEQ ID NO: 5033 | mm46252_Loxl2 | ACAGAGCCTAAATATACAGG |
| SEQ ID NO: 5034 | mm46253_Loxl2 | TACTGGCAAAGAGTCGACCC |
| SEQ ID NO: 5035 | mm46254_Lox12 | GGAACCTTGAGGGTCCATCG |
| SEQ ID NO: 5036 | mm46255_Lox12 | GGGGATGTTGCATCGCACCC |
| SEQ ID NO: 5037 | mm46260_Prg4 | GCCTGAACCTACAACCCCCA |
| SEQ ID NO: 5038 | mm46261_Prg4 | TCAGAATTAGGTGCAAGACT |
| SEQ ID NO: 5039 | mm46262_Prg4 | GCCTGAACCCACAACTCCCA |
| SEQ ID NO: 5040 | mm46263_Prg4 | TCGAGTCCTTCGCTCGAGGG |
| SEQ ID NO: 5041 | mm46268_Tmem62 | GCCAAAACAAAGGAACACTT |
| SEQ ID NO: 5042 | mm46269_Tmem62 | TCAGCCCACCAAGCGTATGG |
| SEQ ID NO: 5043 | mm46270_Tmem62 | GAATGGAAGAGCCTTTCTAG |
| SEQ ID NO: 5044 | mm46271_Tmem62 | GAAGCCAACAACATCTTCTG |
| SEQ ID NO: 5045 | mm46396_Tmem132a | AGCCGCACCGGAATACGCTG |
| SEQ ID NO: 5046 | mm46397_Tmem132a | GGTCTAACTTAGCAGTCCAG |
| SEQ ID NO: 5047 | mm46398_Tmem132a | TATGCGAGGATCTTGCACAT |
| SEQ ID NO: 5048 | mm46399_Tmem132a | ACCACTCTGGAACAAATCCG |
| SEQ ID NO: 5049 | mm46436_Slamf9 | GCAGTGGATCCTCGATACCG |
| SEQ ID NO: 5050 | mm46437_Slamf9 | GATGGTAAGACTTCGTGATG |
| SEQ ID NO: 5051 | mm46438_Slamf9 | AGCACTAACACATCCCATGA |
| SEQ ID NO: 5052 | mm46439_Slamf9 | TTAGAGTTCACAGTGATGTG |
| SEQ ID NO: 5053 | mm46572_Nat10 | GTCAATCCGATACGCCCCTG |
| SEQ ID NO: 5054 | mm46573_Nat10 | TCACCGCTTTATTAAACTCG |
| SEQ ID NO: 5055 | mm46574_Nat10 | TGGTGGGAAGATTTAACGAG |
| SEQ ID NO: 5056 | mm46575_Nat10 | TGTTCACCCAGATTATCAAG |
| SEQ ID NO: 5057 | mm46632_Tm9sf4 | GAGTTCATGTACCCTACCCG |
| SEQ ID NO: 5058 | mm46633_Tm9sf4 | TCCGGATGATAATCATGCTG |
| SEQ ID NO: 5059 | mm46634_Tm9sf4 | ACCGAACTCTAAAAGGCCAT |
| SEQ ID NO: 5060 | mm46635_Tm9sf4 | TGGCTTCACGGATGTCAACA |
| SEQ ID NO: 5061 | mm46696_Fgg | TTAGTGTACTGTGAAATCGA |

TABLE 1-continued mmSurf sgRNA library sequences

| SEQ ID NO | id_gRNA Target | Sequence |
|---|---|---|
| SEQ ID NO: 5062 | mm46697_Fgg | TAACCCACGAGACAAGCATT |
| SEQ ID NO: 5063 | mm46698_Fgg | TGTCAGGAAATTGCCAACAA |
| SEQ ID NO: 5064 | mm46699_Fgg | ATTTCCCAGCCAAAACTCTG |
| SEQ ID NO: 5065 | mm46744_Kcnc4 | GTGACGGAGATTCATCGGGT |
| SEQ ID NO: 5066 | mm46745_Kcnc4 | CTATTATGCCGAGCGAATTG |
| SEQ ID NO: 5067 | mm46746_Kcnc4 | AGCATCGCGGTGCTGCCGGT |
| SEQ ID NO: 5068 | mm46747_Kcnc4 | GTACAAAGCGTACCACACGC |
| SEQ ID NO: 5069 | mm46808_Pcsk9 | GCTGCCAGGAACCTACATTG |
| SEQ ID NO: 5070 | mm46809_Pcsk9 | TGGAGCGAATTATCCCAGCA |
| SEQ ID NO: 5071 | mm46810_Pcsk9 | AGGACCAGCCAGTTACCTTG |
| SEQ ID NO: 5072 | mm46811_Pcsk9 | CATGCTTCATGTCACAGAGT |
| SEQ ID NO: 5073 | mm46868_Smpdl3b | CAACCGCATCTATAACCAGG |
| SEQ ID NO: 5074 | mm46869_Smpdl3b | GCCACCGGAACTGCTCGCCG |
| SEQ ID NO: 5075 | mm46870_Smpdl3b | TTATTGGCCACGTGCCCCCG |
| SEQ ID NO: 5076 | mm46871_Smpdl3b | AGCACCATCGGGTCATAGCA |
| SEQ ID NO: 5077 | mm46880_Slc44a1 | CTGGAAGCAATACCGAACAG |
| SEQ ID NO: 5078 | mm46881_Slc44a1 | GTACATGTGGTGGTACCACG |
| SEQ ID NO: 5079 | mm46882_Slc44a1 | GTGGCACGGGTGTATTATGG |
| SEQ ID NO: 5080 | mm46883_Slc44a1 | CACCATCGCCTTGTTCCACG |
| SEQ ID NO: 5081 | mm46916_Slc15a4 | GCGTGGAGGGCCGTTCACAG |
| SEQ ID NO: 5082 | mm46917_Slc15a4 | GACACGACGCTGACCCGTTG |
| SEQ ID NO: 5083 | mm46918_Slc15a4 | TATCACCACCACCCATCACA |
| SEQ ID NO: 5084 | mm46919_Slc15a4 | CCAATTGAAAATCTCCGAG |
| SEQ ID NO: 5085 | mm46920_Lrrc8c | AGTGGACCCCGGACAAACTG |
| SEQ ID NO: 5086 | mm46921_Lrrc8c | TGGTTGACAAATCTGCTGCG |
| SEQ ID NO: 5087 | mm46922_Lrrc8c | CTCCTGCCGGACATACTCGA |
| SEQ ID NO: 5088 | mm46923_Lrrc8c | AGACATTGGGAACGGAAGAG |
| SEQ ID NO: 5089 | mm47008_Emilin1 | ATGATACTTCGGGAACAGTG |
| SEQ ID NO: 5090 | mm47009_Emilin1 | TGCCCATTGTTACCTCCACG |
| SEQ ID NO: 5091 | mm47010_Emilin1 | ACAGTGCTAAGTGGACGCAG |
| SEQ ID NO: 5092 | mm47011_Emilin1 | GAGGGCCGGTTACAGCTAGT |
| SEQ ID NO: 5093 | mm47068_Hepacam2 | GTGGACAGTGTATGACGGCA |
| SEQ ID NO: 5094 | mm47069_Hepacam2 | TGAGGGCAATTACATCGTGA |
| SEQ ID NO: 5095 | mm47070_Hepacam2 | AGGCTCCGTTAATAAGTCTG |
| SEQ ID NO: 5096 | mm47071_Hepacam2 | AGTTACTTACAATATATGGT |
| SEQ ID NO: 5097 | mm47208_Ano1 | GGAGCGTCGAGTACTTCTCG |
| SEQ ID NO: 5098 | mm47209_Ano1 | GAAGAGAACAACGTGCACCA |
| SEQ ID NO: 5099 | mm47210_Ano1 | GATGAGGCTCAACTACCGAT |

TABLE 1-continued mmSurf sgRNA library sequences

| SEQ ID NO | id_gRNA Target | Sequence |
|---|---|---|
| SEQ ID NO: 5100 | mm47211_Ano1 | TGACAAACGCTTCAGACGGG |
| SEQ ID NO: 5101 | mm47412_Cd276 | CGCGTCCGAGTAACCGACGA |
| SEQ ID NO: 5102 | mm47413_Cd276 | ATCACGTGCTCTAGCTACCA |
| SEQ ID NO: 5103 | mm47414_Cd276 | ATCGAACAAGCCCCGCTCGT |
| SEQ ID NO: 5104 | mm47415_Cd276 | AGCTGTGCCAGACTGAAGCC |
| SEQ ID NO: 5105 | mm47432_Slc6a8 | GGAAGCGCCACACGTTACCG |
| SEQ ID NO: 5106 | mm47433_Slc6a8 | GCATCAGTGTGACAGCCCGT |
| SEQ ID NO: 5107 | mm47434_Slc6a8 | GCACAACGAGGACCACGTAG |
| SEQ ID NO: 5108 | mm47435_Slc6a8 | ACTCGATGACAGGGGACCGG |
| SEQ ID NO: 5109 | mm47456_Slc6a15 | TTCCCGGTACCAGTAATAGG |
| SEQ ID NO: 5110 | mm47457_Slc6a15 | GAAACATATAAGGACCACGT |
| SEQ ID NO: 5111 | mm47458_Slc6a15 | TTGTTCCAAACATGCTGCCG |
| SEQ ID NO: 5112 | mm47459_Slc6a15 | ACATAAGCCCTAAATTGGGT |
| SEQ ID NO: 5113 | mm47520_Ncln | GTAATGAGCCACGATGACAA |
| SEQ ID NO: 5114 | mm47521_Ncln | GGGGGCAAGTTCAACTACCA |
| SEQ ID NO: 5115 | mm47522_Ncln | GGAGCCGCATAAGCACGCAG |
| SEQ ID NO: 5116 | mm47523_Ncln | GTACACGGTGAACTCGTGCG |
| SEQ ID NO: 5117 | mm47536_Mgat4b | CCACGCCCATACCTCCGGTG |
| SEQ ID NO: 5118 | mm47537_Mgat4b | TCTGCGAGACCGTTTGCACG |
| SEQ ID NO: 5119 | mm47538_Mgat4b | TCATGAGGAAGCAGTAATCG |
| SEQ ID NO: 5120 | mm47539_Mgat4b | GAAGGAAGACTCAGTCATCG |
| SEQ ID NO: 5121 | mm47568_Tmed4 | GCTTCTCAGTCTCGCCGATG |
| SEQ ID NO: 5122 | mm47569_Tmed4 | TATCCTTAGCAGCGATCTCG |
| SEQ ID NO: 5123 | mm47570_Tmed4 | CAACTATCGAACTCAGATGT |
| SEQ ID NO: 5124 | mm47571_Tmed4 | AGAATGGCTCTCTTCGCTGG |
| SEQ ID NO: 5125 | mm47640_Rpn1 | TCTCCCGCTACGATTACCAG |
| SEQ ID NO: 5126 | mm47641_Rpn1 | CGAGGACGTGAAGCGCACGG |
| SEQ ID NO: 5127 | mm47642_Rpn1 | TCACTTGCTCATCAAACACG |
| SEQ ID NO: 5128 | mm47643_Rpn1 | GTGAGATACCTCGATGACCC |
| SEQ ID NO: 5129 | mm47720_Acly | GAGAGAGATTGACCCCGACG |
| SEQ ID NO: 5130 | mm47721_Acly | AGAGCGATTCGAGATTACCA |
| SEQ ID NO: 5131 | mm47722_Acly | TTGTCACCTGTACACGACGG |
| SEQ ID NO: 5132 | mm47723_Acly | GGACGAAAAGCTGAATACCG |
| SEQ ID NO: 5133 | mm47896_Pld4 | GATGGGCGACACATCTACGT |
| SEQ ID NO: 5134 | mm47897_Pld4 | AGTGAGGGACCAGTAGTACG |
| SEQ ID NO: 5135 | mm47898_Pld4 | CAGTCATCGGATGTTCCCTG |
| SEQ ID NO: 5136 | mm47899_Pld4 | GCTATGTGGATCATGAGATG |
| SEQ ID NO: 5137 | mm48012_Epdr1 | GATCCCAGGATTCCACCAAG |

TABLE 1-continued mmSurf sgRNA library sequences

| SEQ ID NO | id_gRNA Target | Sequence |
|---|---|---|
| SEQ ID NO: 5138 | mm48013_Epdr1 | AAGATCAGTACTCCATCGGA |
| SEQ ID NO: 5139 | mm48014_Epdr1 | GCTGATCCCTGCAAGAGGT |
| SEQ ID NO: 5140 | mm48015_Epdr1 | GCGCTGGTTGAGACCATCGT |
| SEQ ID NO: 5141 | mm48016_Golm1 | GAATGTCAACAAGCTACACC |
| SEQ ID NO: 5142 | mm48017_Golm1 | GATTGCTAGCTCGAGAAGCG |
| SEQ ID NO: 5143 | mm48018_Golm1 | GTGTGACGAGCGGATAGAGG |
| SEQ ID NO: 5144 | mm48019_Golm1 | ACAGATGCCACAAGAGAAAG |
| SEQ ID NO: 5145 | mm48132_Ano6 | GGTGATAAACGAGATCACTC |
| SEQ ID NO: 5146 | mm48133_Ano6 | CAGATTCAACTATGAGTCGG |
| SEQ ID NO: 5147 | mm48134_Ano6 | TGAAGAAGGAATCTCTATCG |
| SEQ ID NO: 5148 | mm48135_Ano6 | CAAATTCGTGGGCTATCCCG |
| SEQ ID NO: 5149 | mm48136_Slc38a1 | ATACTTTGGTGTGCACGCGT |
| SEQ ID NO: 5150 | mm48137_Slc38a1 | TGCATGGTGTATGAGAAGCT |
| SEQ ID NO: 5151 | mm48138_Slc38a1 | TCACCATCACCACCAACACT |
| SEQ ID NO: 5152 | mm48139_Slc38a1 | AGATTGGCAGGACGGACGGG |
| SEQ ID NO: 5153 | mm48184_Lmf2 | AGAAGGCAGTAAGTCGTAGG |
| SEQ ID NO: 5154 | mm48185_Lmf2 | CAGAATGGGAGGTCTTCATG |
| SEQ ID NO: 5155 | mm48186_Lmf2 | GCAGGCACTGAGTCTCATAG |
| SEQ ID NO: 5156 | mm48187_Lmf2 | CTGGGGCTGGATACTGCCCA |
| SEQ ID NO: 5157 | mm48240_Slc45a4 | AGGTCGCTCATGCTTCGGGA |
| SEQ ID NO: 5158 | mm48241_Slc45a4 | CGTAGCCAATGGCCCCACCA |
| SEQ ID NO: 5159 | mm48242_Slc45a4 | GCATGACCCATAGGCGTGTG |
| SEQ ID NO: 5160 | mm48243_Slc45a4 | GGAAAAGTGCAACACCAATG |
| SEQ ID NO: 5161 | mm48252_Txndc11 | TGTTGCAGGACCATATCCCG |
| SEQ ID NO: 5162 | mm48253_Txndc11 | TTTGGACCAATCGAATACAA |
| SEQ ID NO: 5163 | mm48254_Txndc11 | GGAATACAATAACTGTCATG |
| SEQ ID NO: 5164 | mm48255_Txndc11 | CTAAGGATACCAGTCTCGCA |
| SEQ ID NO: 5165 | mm48332_Itfg3 | AAAGGAAAAATGCCACTGTG |
| SEQ ID NO: 5166 | mm48333_Itfg3 | CTGTCCATCCAGCAACACGC |
| SEQ ID NO: 5167 | mm48334_Itfg3 | GCAGCATCCAACATACCACA |
| SEQ ID NO: 5168 | mm48335_Itfg3 | TGGCATGGCACACTTTACAA |
| SEQ ID NO: 5169 | mm48444_Slc39a6 | CGTGGTCCGAGTGATGCTCG |
| SEQ ID NO: 5170 | mm48445_Slc39a6 | AGGAATCATTCTCTCCGTAG |
| SEQ ID NO: 5171 | mm48446_Slc39a6 | CAGCCACGGAACTTACGTGT |
| SEQ ID NO: 5172 | mm48447_Slc39a6 | GACAGCGTTGTATACCGCCG |
| SEQ ID NO: 5173 | mm48552_Tm9sf3 | GGAAGTCTGTATGCTAGACA |
| SEQ ID NO: 5174 | mm48553_Tm9sf3 | GATGTTAATCTAACTAGTGA |
| SEQ ID NO: 5175 | mm48554_Tm9sf3 | ACGAGCACGAACACACGGTG |

TABLE 1-continued mmSurf sgRNA library sequences

| SEQ ID NO | id_gRNA Target | Sequence |
|---|---|---|
| SEQ ID NO: 5176 | mm48555_Tm9sf3 | ATAGATGACTTACCAATATG |
| SEQ ID NO: 5177 | mm48580_Unc5a | CTGCGTGGCCAAGAACATCG |
| SEQ ID NO: 5178 | mm48581_Unc5a | TCTCGTAGATCTTTCCTCGG |
| SEQ ID NO: 5179 | mm48582_Unc5a | AACCCGGCACCTCTCAACGG |
| SEQ ID NO: 5180 | mm48583_Unc5a | AGCAGGATTGCCAACCATGG |
| SEQ ID NO: 5181 | mm48584_Unc5b | GCAGGGGCGAATTAGTCATG |
| SEQ ID NO: 5182 | mm48585_Unc5b | CACACCATAGACGATGACTG |
| SEQ ID NO: 5183 | mm48586_Unc5b | GGAGGAACTCTTCGGGCTCG |
| SEQ ID NO: 5184 | mm48587_Unc5b | CCTGTATCTACATATCAACA |
| SEQ ID NO: 5185 | mm48600_Eprs | GACAGTCAGATTCCCCCCAG |
| SEQ ID NO: 5186 | mm48601_Eprs | ATGGTCACATTTATAAACTG |
| SEQ ID NO: 5187 | mm48602_Eprs | CAATAAAGTCGCTGCCCAAG |
| SEQ ID NO: 5188 | mm48603_Eprs | CCACGAACTGTAGGAAACCG |
| SEQ ID NO: 5189 | mm48604_Ssr1 | GTCCTGAGGATAACGGAACG |
| SEQ ID NO: 5190 | mm48605_Ssr1 | ACACTGTAGTGCCACCCCAG |
| SEQ ID NO: 5191 | mm48606_Ssr1 | CCAAGGGTCGTCCTCCCAT |
| SEQ ID NO: 5192 | mm48607_Ssr1 | GCCGCCTCGGAGCAGCACGG |
| SEQ ID NO: 5193 | mm48608_Lgr4 | CTGATTCGTGAAATTCACAG |
| SEQ ID NO: 5194 | mm48609_Lgr4 | ACAGCACTACCAAGCTTGAA |
| SEQ ID NO: 5195 | mm48610_Lgr4 | CCATATTACCTCAGTCCCGG |
| SEQ ID NO: 5196 | mm48611_Lgr4 | AAGCCCTGTGAATATTTACT |
| SEQ ID NO: 5197 | mm48612_Ece2 | TCGGTGGTTGGAACATAACG |
| SEQ ID NO: 5198 | mm48613_Ece2 | TTTAGGTAGTAATCTCGAGA |
| SEQ ID NO: 5199 | mm48614_Ece2 | TACTGGAGAGTAATCCACAC |
| SEQ ID NO: 5200 | mm48615_Ece2 | CCACCTTCTTGGTACCGTAG |
| SEQ ID NO: 5201 | mm48640_Col16a1 | TGATGCAAATGGGTACCCAC |
| SEQ ID NO: 5202 | mm48641_Col16a1 | GGAGGAACCTCAGAACAGCA |
| SEQ ID NO: 5203 | mm48642_Col16a1 | GTATCGCCAAAACTACCCTG |
| SEQ ID NO: 5204 | mm48643_Col16a1 | CATCGAGAAACACCTCCTCA |
| SEQ ID NO: 5205 | mm48656_Mylk | GAAGCCAAAGACCATATCCG |
| SEQ ID NO: 5206 | mm48657_Mylk | GGTATACCAAAGCCTGACGT |
| SEQ ID NO: 5207 | mm48658_Mylk | CTGCACGTTCTTTAGAACCA |
| SEQ ID NO: 5208 | mm48659_Mylk | TGTCATCCACACTGTCCGCG |
| SEQ ID NO: 5209 | mm48680_Snrpd2 | CCCCATCAGGCACTGCAACA |
| SEQ ID NO: 5210 | mm48681_Snrpd2 | GACTGCGTGAGCACTGAGAG |
| SEQ ID NO: 5211 | mm48682_Snrpd2 | CAAGAGTGAGATGACCCCAG |
| SEQ ID NO: 5212 | mm48683_Snrpd2 | TGTGAAGGAGATGTGGACTG |
| SEQ ID NO: 5213 | mm48692_Slc12a6 | AATCCCCAGGATGTTACGGA |

TABLE 1-continued mmSurf sgRNA library sequences

| SEQ ID NO | id_gRNA Target | Sequence |
|---|---|---|
| SEQ ID NO: 5214 | mm48693_Slc12a6 | AACTATACAAATCTGACACA |
| SEQ ID NO: 5215 | mm48694_Slc12a6 | AATGGGGGATGGTATCCGT |
| SEQ ID NO: 5216 | mm48695_Slc12a6 | CAAGATCGACACAATTACAC |
| SEQ ID NO: 5217 | mm48784_Mgat5 | GGTACTGGAGCCATAAACAG |
| SEQ ID NO: 5218 | mm48785_Mgat5 | GTCGCTTGAGAAAATTAATG |
| SEQ ID NO: 5219 | mm48786_Mgat5 | CCTTAATGTACCTCTTGCTG |
| SEQ ID NO: 5220 | mm48787_Mgat5 | TTTGCTCTCCAAGGTAAACG |
| SEQ ID NO: 5221 | mm48792_Celsr3 | GAGTTCCACTATCGACCGAG |
| SEQ ID NO: 5222 | mm48793_Celsr3 | GTGCTGATAAGACCCGAACG |
| SEQ ID NO: 5223 | mm48794_Celsr3 | GTACCACCTTCGGCTCAATG |
| SEQ ID NO: 5224 | mm48795_Celsr3 | AAAGTAAAACAGCTCCACGT |
| SEQ ID NO: 5225 | mm48896_Grm3 | CTCACGGATCACGCTGTCGT |
| SEQ ID NO: 5226 | mm48897_Grm3 | GGTATTCATAGGGCTCACAT |
| SEQ ID NO: 5227 | mm48898_Grm3 | CAGAGGTATCCAACGCCTGG |
| SEQ ID NO: 5228 | mm48899_Grm3 | TGACTCCTGCAATGAGTAGT |
| SEQ ID NO: 5229 | mm48900_Grm5 | TAGTCATGCATTATATCCGG |
| SEQ ID NO: 5230 | mm48901_Grm5 | GTACCTGTCAAGTCGTCAGT |
| SEQ ID NO: 5231 | mm48902_Grm5 | GACCGATGCCAATTCTCTGA |
| SEQ ID NO: 5232 | mm48903_Grm5 | AAATGGATGATGATGAAGTG |
| SEQ ID NO: 5233 | mm48908_Grm7 | TCCGTTGGTGCAACGCACGT |
| SEQ ID NO: 5234 | mm48909_Grm7 | TGATACTGGTATCCATCACA |
| SEQ ID NO: 5235 | mm48910_Grm7 | CCAACCTAAGAGAGCGACTG |
| SEQ ID NO: 5236 | mm48911_Grm7 | GCCCTGCGGCGACATCAAGA |
| SEQ ID NO: 5237 | mm48912_Ltbp4 | ATTGACGAGTGTCGTGAACG |
| SEQ ID NO: 5238 | mm48913_Ltbp4 | GGCTGATTGAAGGTCACTCG |
| SEQ ID NO: 5239 | mm48914_Ltbp4 | TCATGATTGTCACCCGTGCG |
| SEQ ID NO: 5240 | mm48915_Ltbp4 | AGGCCGCTGCGACAACACCG |
| SEQ ID NO: 5241 | mm48940_Slco1a5 | CTGGTAGGAAACATCATACG |
| SEQ ID NO: 5242 | mm48941_Slco1a5 | AGACAGAAGGTACTCAAACA |
| SEQ ID NO: 5243 | mm48942_Slco1a5 | AGAATACTTACCGGCCCATG |
| SEQ ID NO: 5244 | mm48943_Slco1a5 | AATGAACGGACATACCTATG |
| SEQ ID NO: 5245 | mm48976_Slco4a1 | CATCCATCTCTACCTCATAG |
| SEQ ID NO: 5246 | mm48977_Slco4a1 | GCGCTACGTTGTTATGAGAG |
| SEQ ID NO: 5247 | mm48978_Slco4a1 | TGACCACTGACAGCCCACTG |
| SEQ ID NO: 5248 | mm48979_Slco4a1 | AGGTGCAGTATGTGTCCTCG |
| SEQ ID NO: 5249 | mm48980_Slco3a1 | TAAGTTACTTCGGAGCACGT |
| SEQ ID NO: 5250 | mm48981_Slco3a1 | GTGCCTACCTATGTAGAGCG |
| SEQ ID NO: 5251 | mm48982_Slco3a1 | TGGGAACCCAAACATCAGGA |

TABLE 1-continued mmSurf sgRNA library sequences

| SEQ ID NO | id_gRNA Target | Sequence |
|---|---|---|
| SEQ ID NO: 5252 | mm48983_Slco3a1 | GAGGCTGGCGAGATCCGATG |
| SEQ ID NO: 5253 | mm48984_U2af1 | TGCAGGTGCTGTGAGCGACG |
| SEQ ID NO: 5254 | mm48985_U2af1 | GGTGGGAACGTGTATGTCA |
| SEQ ID NO: 5255 | mm48986_U2af1 | ACACAAACCTGGCTAAAGGT |
| SEQ ID NO: 5256 | mm48987_U2af1 | AAAATCGGAGCATGTCGTCA |
| SEQ ID NO: 5257 | mm49108_Pttg1ip | CGTGTATGGACTACCCAGTG |
| SEQ ID NO: 5258 | mm49109_Pttg1ip | AAATTGAGTTCCGCTCGCTG |
| SEQ ID NO: 5259 | mm49110_Pttg1ip | CCGAGGAGCATCACCCAGTG |
| SEQ ID NO: 5260 | mm49111_Pttg1ip | GCGCAGGAACCTCCGAGAGT |
| SEQ ID NO: 5261 | mm49424_Tspan9 | ACAACACAGAGAACAACGTG |
| SEQ ID NO: 5262 | mm49425_Tspan9 | GAAGCCCGTCACCATGACGA |
| SEQ ID NO: 5263 | mm49426_Tspan9 | CCCACAGATGCGGTGTTGTG |
| SEQ ID NO: 5264 | mm49427_Tspan9 | CTTCTTCGTCTACATGGACA |
| SEQ ID NO: 5265 | mm49480_Cdcp1 | AGGACTGCCTATAGCAGTAG |
| SEQ ID NO: 5266 | mm49481_Cdcp1 | AGTTCGCAACCCCTCGACTG |
| SEQ ID NO: 5267 | mm49482_Cdcp1 | ATCATCGAGTCAGTATTTGA |
| SEQ ID NO: 5268 | mm49483_Cdcp1 | ACCGAGTTGATTATCAGACC |
| SEQ ID NO: 5269 | mm49484_Pkn2 | CATCGTTGTATCGGATCCAG |
| SEQ ID NO: 5270 | mm49485_Pkn2 | TTTGAAGCTAGATAATACTG |
| SEQ ID NO: 5271 | mm49486_Pkn2 | TGTGCCAGAATGATTTACTG |
| SEQ ID NO: 5272 | mm49487_Pkn2 | ATAGAATTTGCAGTAGCCGA |
| SEQ ID NO: 5273 | mm49528_Upk1a | GACCGGATCATGATTGAGGT |
| SEQ ID NO: 5274 | mm49529_Upk1a | CGCCCATCAGTGGGTACACG |
| SEQ ID NO: 5275 | mm49530_Upk1a | CCACACTGTCTCCGCAAACA |
| SEQ ID NO: 5276 | mm49531_Upk1a | CCCCACTCACATAGTCGCGG |
| SEQ ID NO: 5277 | mm49560_Ank2 | TCAGAATCATTATCCCACCT |
| SEQ ID NO: 5278 | mm49561_Ank2 | TGCTCAGTACTCCACCCTCG |
| SEQ ID NO: 5279 | mm49562_Ank2 | ACCGCAACCTGGCTTCAATG |
| SEQ ID NO: 5280 | mm49563_Ank2 | CAGTGCCATGATTGACGACA |
| SEQ ID NO: 5281 | mm49576_Itga1 | ATTCGGATTCTCGAACGGTG |
| SEQ ID NO: 5282 | mm49577_Itga1 | ACTTTAGTCACCAATCCGAA |
| SEQ ID NO: 5283 | mm49578_Itga1 | GCAAACAAAATAGGCCGCAG |
| SEQ ID NO: 5284 | mm49579_Itga1 | TGGCCGGTGTGATTGTACCG |
| SEQ ID NO: 5285 | mm49672_Gusb | GTATCTTGGGTCCATCGCCG |
| SEQ ID NO: 5286 | mm49673_Gusb | TGTTCGAATCCCGATAGGAA |
| SEQ ID NO: 5287 | mm49674_Gusb | GGAGCGCGCACCTCCCGTAG |
| SEQ ID NO: 5288 | mm49675_Gusb | GGTGTCAGTCTTGTAGACGA |
| SEQ ID NO: 5289 | mm49696_Bmp3 | TCCAACGTAGAAATACAGTG |

TABLE 1-continued mmSurf sgRNA library sequences

| SEQ ID NO | id_gRNA Target | Sequence |
|---|---|---|
| SEQ ID NO: 5290 | mm49697_Bmp3 | GAGCACACGAGCTACCCAAG |
| SEQ ID NO: 5291 | mm49698_Bmp3 | TCGGGCTACCACCTGTCGCG |
| SEQ ID NO: 5292 | mm49699_Bmp3 | ACCGTGTTACCACCGCGCAG |
| SEQ ID NO: 5293 | mm49732_Fgb | GAAGACGCGAAGAAGTACTG |
| SEQ ID NO: 5294 | mm49733_Fgb | GGAGCACACGAAGATTAAGG |
| SEQ ID NO: 5295 | mm49734_Fgb | TGTTGCAATGTACATCCCGT |
| SEQ ID NO: 5296 | mm49735_Fgb | TACTCTGTACGGCTTGATGG |
| SEQ ID NO: 5297 | mm49864_Ly6a | CCATACTTTCAATATTAGGA |
| SEQ ID NO: 5298 | mm49865_Ly6a | GAGTAACACAGACTCCATCA |
| SEQ ID NO: 5299 | mm49866_Ly6a | GGTAGGGGCAGGTAATTGAT |
| SEQ ID NO: 5300 | mm49867_Ly6a | TTCTTGCAGATTCTCAAACA |
| SEQ ID NO: 5301 | mm49892_H2-Q6 | AGACCTGAAAACCTGGACGG |
| SEQ ID NO: 5302 | mm49893_H2-Q6 | CGGGCCAGGACACAGCAGTG |
| SEQ ID NO: 5303 | mm49894_H2-Q6 | GGATGTATGGCTGTGACGTG |
| SEQ ID NO: 5304 | mm49895_H2-Q6 | ACAGAAAGCCAAGGGCCATG |
| SEQ ID NO: 5305 | mm49960_Adgrv1 | GGACACGTTGAGGATCGACA |
| SEQ ID NO: 5306 | mm49961_Adgrv1 | ACATCCGAATACTTCCGCTG |
| SEQ ID NO: 5307 | mm49962_Adgrv1 | TATGGTGTAATACGAACTCG |
| SEQ ID NO: 5308 | mm49963_Adgrv1 | TGATCTGCCGGAGTTATCCG |
| SEQ ID NO: 5309 | mm50016_Kcnq3 | GTTCGCCTTTCTAATCCTCG |
| SEQ ID NO: 5310 | mm50017_Kcnq3 | GGATGTTGCTGTCGATACAA |
| SEQ ID NO: 5311 | mm50018_Kcnq3 | TGCGCATGCTTCGAATGGAT |
| SEQ ID NO: 5312 | mm50019_Kcnq3 | CAATCGAAGGAACTTACTGC |
| SEQ ID NO: 5313 | mm50056_Hspa13 | GAGGACAAGACTTCAATCAG |
| SEQ ID NO: 5314 | mm50057_Hspa13 | GTGTTGGTCATAGACTTGGG |
| SEQ ID NO: 5315 | mm50058_Hspa13 | AAATACACCAACCGAACAGT |
| SEQ ID NO: 5316 | mm50059_Hspa13 | GACAATTCATCAGTCTGCCC |
| SEQ ID NO: 5317 | mm50072_D1Pas1 | CACAAGGACGAACTCGAGAG |
| SEQ ID NO: 5318 | mm50073_D1Pas1 | AAGGCGTTCTACGACAAAGA |
| SEQ ID NO: 5319 | mm50074_D1Pas1 | ACATCACACAGAAAGTCGTG |
| SEQ ID NO: 5320 | mm50075_D1Pas1 | CGGAGTGACTACGAGAGTGT |
| SEQ ID NO: 5321 | mm50252_Kiss1r | GTCAACGCCTCGGATGACCC |
| SEQ ID NO: 5322 | mm50253_Kiss1r | CGGCGGTGAAGTGCACGCAG |
| SEQ ID NO: 5323 | mm50254_Kiss1r | ACAGTTACCAACTTCTACAT |
| SEQ ID NO: 5324 | mm50255_Kiss1r | GTGCGGGCGTACAGCCGCA |
| SEQ ID NO: 5325 | mm50280_Slc5a5 | CTGCACCTTGTACACGACCG |
| SEQ ID NO: 5326 | mm50281_Slc5a5 | GCTGGCCGCTAGCTTCATGT |
| SEQ ID NO: 5327 | mm50282_Slc5a5 | GTCCACCAGTATCAACGCTA |

TABLE 1-continued mmSurf sgRNA library sequences

| SEQ ID NO | id_gRNA Target | Sequence |
|---|---|---|
| SEQ ID NO: 5328 | mm50283_Slc5a5 | GTACATGCCATTGCTCGTGT |
| SEQ ID NO: 5329 | mm50296_Clic1 | CACAGACACCAACAAGATCG |
| SEQ ID NO: 5330 | mm50297_Clic1 | CACCTTCAACGTTACCACTG |
| SEQ ID NO: 5331 | mm50298_Clic1 | TCTTGCACAGACCTAGAGAA |
| SEQ ID NO: 5332 | mm50299_Clic1 | GAGCACCATGAACAGTCTCT |
| SEQ ID NO: 5333 | mm50344_Ly6g5c | CTTCGGTCTCCAGCAGACAT |
| SEQ ID NO: 5334 | mm50345_Ly6g5c | TCTAGGTGATACCAAGCTCG |
| SEQ ID NO: 5335 | mm50346_Ly6g5c | GACATTAAAACCGCTGCCTA |
| SEQ ID NO: 5336 | mm50347_Ly6g5c | TGTTAAGAGGACAGCACACA |
| SEQ ID NO: 5337 | mm50348_Ly6g6d | AAGCAGACAGTGATCACTTG |
| SEQ ID NO: 5338 | mm50349_Ly6g6d | CGCAGTCATAGCACCGCGTG |
| SEQ ID NO: 5339 | mm50350_Ly6g6d | CAAGTGGCCATAGAGTCAGT |
| SEQ ID NO: 5340 | mm50351_Ly6g6d | GTGATGGCTCAAGGTCGCGG |
| SEQ ID NO: 5341 | mm50428_Dscaml1 | GAAGTTCGCTCAGTACGGCG |
| SEQ ID NO: 5342 | mm50429_Dscaml1 | AAGGTCAATGCGTGGCAACG |
| SEQ ID NO: 5343 | mm50430_Dscaml1 | GCGGATTGGCATGTCCCCCG |
| SEQ ID NO: 5344 | mm50431_Dscaml1 | CAGGACGTGGCGTATCAGCA |
| SEQ ID NO: 5345 | mm50456_Egfrl1 | GATGGCCGCACAATCCACAG |
| SEQ ID NO: 5346 | mm50457_Egfrl1 | CGTGACCACACATCACCCGT |
| SEQ ID NO: 5347 | mm50458_Egfrl1 | AGCCCATGGTATTTGCACCT |
| SEQ ID NO: 5348 | mm50459_Egfrl1 | CACGTGCCGTGTATCTAACA |
| SEQ ID NO: 5349 | mm50588_Ttyh2 | GAAACAGCGAGACCAACGAT |
| SEQ ID NO: 5350 | mm50589_Ttyh2 | CCTGGTAAGTTTCGTCGCCG |
| SEQ ID NO: 5351 | mm50590_Ttyh2 | ACAGGGAGCCAGATCAACTC |
| SEQ ID NO: 5352 | mm50591_Ttyh2 | TCACCTGTAGTATTCCACAT |
| SEQ ID NO: 5353 | mm50592_Steap4 | TGTGTACTGTGCAATACGAG |
| SEQ ID NO: 5354 | mm50593_Steap4 | GATAATCAACTAGTTCCGTG |
| SEQ ID NO: 5355 | mm50594_Steap4 | AATACCAGGGAGGTACACCA |
| SEQ ID NO: 5356 | mm50595_Steap4 | GTTAAATGCTTTGACCACGT |
| SEQ ID NO: 5357 | mm50632_B3galt6 | GCGCGCCAGGTACAACAGAG |
| SEQ ID NO: 5358 | mm50633_B3galt6 | CCTGGTGGACCTACGCGCAC |
| SEQ ID NO: 5359 | mm50634_B3galt6 | GTTCTCGTAGGCGTCGCGCA |
| SEQ ID NO: 5360 | mm50635_B3galt6 | TGGCGGACCCGAGGACGTGT |
| SEQ ID NO: 5361 | mm50644_Boc | GGGAAGCCGCCGTTCCCTCG |
| SEQ ID NO: 5362 | mm50645_Boc | GTAGGCTGTACCGACGACGT |
| SEQ ID NO: 5363 | mm50646_Boc | CCGATGTATGGCCAGCAATG |
| SEQ ID NO: 5364 | mm50647_Boc | CTACGTAGTGAAGCATCGTA |
| SEQ ID NO: 5365 | mm50668_Cspg4 | CCACGGTTGAAAGTACGCGT |

TABLE 1-continued mmSurf sgRNA library sequences

| SEQ ID NO | id_gRNA Target | Sequence |
|---|---|---|
| SEQ ID NO: 5366 | mm50669_Cspg4 | GGAATCAGCCGACCCCTAAG |
| SEQ ID NO: 5367 | mm50670_Cspg4 | AAGGCCCGCTTTGTTCACGA |
| SEQ ID NO: 5368 | mm50671_Cspg4 | GTCAGTAGAAACGAACGCGG |
| SEQ ID NO: 5369 | mm50684_Strc | GCTTTACCAAAGGACGACTG |
| SEQ ID NO: 5370 | mm50685_Strc | TGTTATTAGAGGGTACACGC |
| SEQ ID NO: 5371 | mm50686_Strc | AGGGCCGGAGAAGTGTACTG |
| SEQ ID NO: 5372 | mm50687_Strc | CATGTCGATAAAGAGTTGGG |
| SEQ ID NO: 5373 | mm50708_Igf2bp1 | AGAGGCTTACGAGAACGACG |
| SEQ ID NO: 5374 | mm50709_Igf2bp1 | ATAGCGCCTACATACTGCGT |
| SEQ ID NO: 5375 | mm50710_Igf2bp1 | TCATCGCCCAGTGCTCGTCG |
| SEQ ID NO: 5376 | mm50711_Igf2bp1 | CGTCGGGCGACTCATTGGCA |
| SEQ ID NO: 5377 | mm50760_Igsf8 | TCACGCCTCACAGTGCACGA |
| SEQ ID NO: 5378 | mm50761_Igsf8 | GCAGTTCTAAGGGTTCGCCT |
| SEQ ID NO: 5379 | mm50762_Igsf8 | CCATTCCGGAGGCGCCAGTG |
| SEQ ID NO: 5380 | mm50763_Igsf8 | TCCACAGATACGCAGTACCT |
| SEQ ID NO: 5381 | mm50764_Plxnb2 | GCAGTACTACGAGTGTCGGG |
| SEQ ID NO: 5382 | mm50765_Plxnb2 | TGACGTCAAGAAGATAACTG |
| SEQ ID NO: 5383 | mm50766_Plxnb2 | ACCGTCCATCCGTATCAGCA |
| SEQ ID NO: 5384 | mm50767_Plxnb2 | TTCTCACGGACTTTATCTAG |
| SEQ ID NO: 5385 | mm50768_Plxnb3 | GGACGAGTGATTCGAGTCAG |
| SEQ ID NO: 5386 | mm50769_Plxnb3 | GGGCACCACTAGGCCTACTG |
| SEQ ID NO: 5387 | mm50770_Plxnb3 | GTGCCCATCTATGTAACCAG |
| SEQ ID NO: 5388 | mm50771_Plxnb3 | GGGGTGGTACAGACCACATG |
| SEQ ID NO: 5389 | mm50792_Emid1 | GACAGTCCGGGTCACCACGT |
| SEQ ID NO: 5390 | mm50793_Emid1 | CGTGGACGGACAGCGGCATG |
| SEQ ID NO: 5391 | mm50794_Emid1 | CAGTGACGGCCCGAGAATGG |
| SEQ ID NO: 5392 | mm50795_Emid1 | GAGTGCTACAGAACTGCCCG |
| SEQ ID NO: 5393 | mm50836_Colec12 | GACTAGTGTGTTATTCAAGG |
| SEQ ID NO: 5394 | mm50837_Colec12 | GGAGAAGTTGCAAGCAAATG |
| SEQ ID NO: 5395 | mm50838_Colec12 | AGACCTTCAGGACTTACACA |
| SEQ ID NO: 5396 | mm50839_Colec12 | CAACAACCTGAACCTAACCC |
| SEQ ID NO: 5397 | mm50892_Tlr3 | CTTAGATGAAATCCCAGTCG |
| SEQ ID NO: 5398 | mm50893_Tlr3 | GTTGTAGGAAAGATCGAGCT |
| SEQ ID NO: 5399 | mm50894_Tlr3 | GAATGGTCAAGTTACGAAGA |
| SEQ ID NO: 5400 | mm50895_Tlr3 | ATCTACAAAGTTGGGAACGG |
| SEQ ID NO: 5401 | mm50936_Cntnap4 | GGAGGACCAAATAACTCCTG |
| SEQ ID NO: 5402 | mm50937_Cntnap4 | TTGTGTCCAACAAATACCAG |
| SEQ ID NO: 5403 | mm50938_Cntnap4 | AAGATTGTGATTACGGACAC |

TABLE 1-continued mmSurf sgRNA library sequences

| SEQ ID NO | id_gRNA Target | Sequence |
|---|---|---|
| SEQ ID NO: 5404 | mm50939_Cntnap4 | ACTCACCTTGCTGATTAACG |
| SEQ ID NO: 5405 | mm50956_Kirrel | TGGGTAAACTACAATCCGGG |
| SEQ ID NO: 5406 | mm50957_Kirrel | GAGCCCACGACCCGGTACCG |
| SEQ ID NO: 5407 | mm50958_Kirrel | CACCATTAATAATGTCATGG |
| SEQ ID NO: 5408 | mm50959_Kirrel | CATCGTGCCTCGGATCGGAG |
| SEQ ID NO: 5409 | mm51084_Tlr8 | AGTTCAAGAAATTGCCTCGG |
| SEQ ID NO: 5410 | mm51085_Tlr8 | CTCCAAGAGTTACTTATCAG |
| SEQ ID NO: 5411 | mm51086_Tlr8 | TACTGAAATAGTGTGCATTG |
| SEQ ID NO: 5412 | mm51087_Tlr8 | AACTTGGCAACCATCAACTT |
| SEQ ID NO: 5413 | mm51180_Cd209e | TGAAGAACGTCCAATCCCAA |
| SEQ ID NO: 5414 | mm51181_Cd209e | CCAAGAAAATAGCTACACC |
| SEQ ID NO: 5415 | mm51182_Cd209e | AGTCATCATCAAAAGTCATG |
| SEQ ID NO: 5416 | mm51183_Cd209e | GCTGCAACACCAGGGGAATG |
| SEQ ID NO: 5417 | mm51184_Cd209a | CAAGTTGAGCCCCCACATTG |
| SEQ ID NO: 5418 | mm51185_Cd209a | GTGCCAAGGGGACTTGACTG |
| SEQ ID NO: 5419 | mm51186_Cd209a | ACCTACGCCAGCCTTCAACT |
| SEQ ID NO: 5420 | mm51187_Cd209a | GGAAGTGCGTCCAGTCCCAG |
| SEQ ID NO: 5421 | mm51276_Il17rc | CTGTGGAACGATGACAACAT |
| SEQ ID NO: 5422 | mm51277_Il17rc | AGCAATACTTACCCCAGAGG |
| SEQ ID NO: 5423 | mm51278_Il17rc | GGAGCCACAAGATTTCCAGT |
| SEQ ID NO: 5424 | mm51279_Il17rc | ATCTAGCTGCCATACCCCTG |
| SEQ ID NO: 5425 | mm51284_Fut10 | CCAGCATCATCCGATGACCA |
| SEQ ID NO: 5426 | mm51285_Fut10 | CGACTGAACATATACCAATG |
| SEQ ID NO: 5427 | mm51286_Fut10 | GTGGGGATCCGTAATACAC |
| SEQ ID NO: 5428 | mm51287_Fut10 | ACTGCGTAGTCAGTGGCAAG |
| SEQ ID NO: 5429 | mm51616_Havcr1 | GGAATCACAACGACATGTTG |
| SEQ ID NO: 5430 | mm51617_Havcr1 | TGGTCTGTATTGTTGTCGAG |
| SEQ ID NO: 5431 | mm51618_Havcr1 | TCCCCATGAGACAACAGCTG |
| SEQ ID NO: 5432 | mm51619_Havcr1 | GCAGTCGGTACAACTTAAAG |
| SEQ ID NO: 5433 | mm51620_Timd2 | GATATACGGTCACACATCAG |
| SEQ ID NO: 5434 | mm51621_Timd2 | GGAATCGTTCCTATGTGTTG |
| SEQ ID NO: 5435 | mm51622_Timd2 | TGTTGGAAGTTAAACCAGGT |
| SEQ ID NO: 5436 | mm51623_Timd2 | CTGATCTGGATAAAATGTAG |
| SEQ ID NO: 5437 | mm51624_Havcr2 | GTTACACTCTATCTACACCT |
| SEQ ID NO: 5438 | mm51625_Havcr2 | TTCTCCAAGAACCCTAACCA |
| SEQ ID NO: 5439 | mm51626_Havcr2 | CTAAAGGGCGATCTCAACAA |
| SEQ ID NO: 5440 | mm51627_Havcr2 | ATCAGTTCTGAGCAACTCGT |
| SEQ ID NO: 5441 | mm51632_Trpm8 | CAAAAGCAAGATCCCTTGTG |

TABLE 1-continued mmSurf sgRNA library sequences

| SEQ ID NO | id_gRNA Target | Sequence |
|---|---|---|
| SEQ ID NO: 5442 | mm51633_Trpm8 | CTCACCTTTGTACAGCGCAT |
| SEQ ID NO: 5443 | mm51634_Trpm8 | CCTGATGAAGTACATAGGCG |
| SEQ ID NO: 5444 | mm51635_Trpm8 | GTCCACACCTAAATGATACG |
| SEQ ID NO: 5445 | mm51644_Il17rd | TGGCCAGAATCACATGAACG |
| SEQ ID NO: 5446 | mm51645_Il17rd | CTTCCCGCCGGGATTCAAGT |
| SEQ ID NO: 5447 | mm51646_Il17rd | ACTCGCCTTGCGCCTCGCCG |
| SEQ ID NO: 5448 | mm51647_Il17rd | CCTCCAAAACGTTTCTCCAG |
| SEQ ID NO: 5449 | mm51648_Gpr3711 | CCTACCAGAATGCCCGCATG |
| SEQ ID NO: 5450 | mm51649_Gpr3711 | GGGCATAGACCGATTCCATG |
| SEQ ID NO: 5451 | mm51650_Gpr3711 | TCTCGGTCACCGGATACAGG |
| SEQ ID NO: 5452 | mm51651_Gpr3711 | TCGACCCCGAAGAGGCACCA |
| SEQ ID NO: 5453 | mm51744_Nlgn1 | CAAACACAGTGATTCGCAAG |
| SEQ ID NO: 5454 | mm51745_Nlgn1 | GCGTTCCGGATGTCAGACCA |
| SEQ ID NO: 5455 | mm51746_Nlgn1 | AAGGCTATGTGGTATCGGGC |
| SEQ ID NO: 5456 | mm51747_Nlgn1 | GTGAGCCAAAGTTCGAGTGA |
| SEQ ID NO: 5457 | mm51772_Stab1 | GTGTGCAAAAACGACGAGGT |
| SEQ ID NO: 5458 | mm51773_Stab1 | GCTTGTGTTTCGCTACCACG |
| SEQ ID NO: 5459 | mm51774_Stab1 | GCGACATCACGTGATCCTTG |
| SEQ ID NO: 5460 | mm51775_Stab1 | CATCCGTAGACTGAGCCTCG |
| SEQ ID NO: 5461 | mm51776_Stab2 | AATGCATCCAAGCTAGCACG |
| SEQ ID NO: 5462 | mm51777_Stab2 | GCAGATTCTGGCAAACAACG |
| SEQ ID NO: 5463 | mm51778_Stab2 | TCCTGCCGCACATTTGCACG |
| SEQ ID NO: 5464 | mm51779_Stab2 | AGGTAGGAACAACTTGCGTG |
| SEQ ID NO: 5465 | mm51804_Lrrc4 | GGCTAAGTTGAGTTCCACGA |
| SEQ ID NO: 5466 | mm51805_Lrrc4 | AAGGTGGTGTGCACCCGCCG |
| SEQ ID NO: 5467 | mm51806_Lrrc4 | CCCCCAAGTCCAGACGCATG |
| SEQ ID NO: 5468 | mm51807_Lrrc4 | CCAGAGTGTTGAGACTGGCG |
| SEQ ID NO: 5469 | mm51820_Prom2 | CGTGCGACGATTCCTCTCCG |
| SEQ ID NO: 5470 | mm51821_Prom2 | AACACACACATAGTCAGACG |
| SEQ ID NO: 5471 | mm51822_Prom2 | AACAATATGAGACATACAGG |
| SEQ ID NO: 5472 | mm51823_Prom2 | GCCACGAGGAGAATTGCAAG |
| SEQ ID NO: 5473 | mm51928_Trpv1 | TAAGCTGAATAACACCGTTG |
| SEQ ID NO: 5474 | mm51929_Trpv1 | AAGCCACATACTCCTTGCGA |
| SEQ ID NO: 5475 | mm51930_Trpv1 | CCTGCGATCATAGAGCCTTG |
| SEQ ID NO: 5476 | mm51931_Trpv1 | GCTCCACGAGAAGCATGTCG |
| SEQ ID NO: 5477 | mm52152_Ggt7 | GGTCATGCAAATCTACTTCG |
| SEQ ID NO: 5478 | mm52153_Ggt7 | CGCAGGCGGTGTCATAACCG |
| SEQ ID NO: 5479 | mm52154_Ggt7 | GCGACGGCCTGATCTCGCTG |

TABLE 1-continued mmSurf sgRNA library sequences

| SEQ ID NO | id_gRNA Target | Sequence |
|---|---|---|
| SEQ ID NO: 5480 | mm52155_Ggt7 | TGTTGGTACATGATATCCGG |
| SEQ ID NO: 5481 | mm52200_Elfn2 | GAACGAGATTTCCTACATCG |
| SEQ ID NO: 5482 | mm52201_Elfn2 | GCACCAAGTCACCTTCACCT |
| SEQ ID NO: 5483 | mm52202_Elfn2 | GATAGTCATGATGTAGTGCG |
| SEQ ID NO: 5484 | mm52203_Elfn2 | CCTATTCCACGGATGCGCAG |
| SEQ ID NO: 5485 | mm52228_Thsd4 | TGATAACACGGGCTGCCAGG |
| SEQ ID NO: 5486 | mm52229_Thsd4 | ACTATGAGTACGTGATCATG |
| SEQ ID NO: 5487 | mm52230_Thsd4 | ATGAACCAGCTGGGACATCG |
| SEQ ID NO: 5488 | mm52231_Thsd4 | TTCTGACGTGAATACCTCAG |
| SEQ ID NO: 5489 | mm52380_Btla | CAGTGCAACTTACTATTACG |
| SEQ ID NO: 5490 | mm52381_Btla | TTCATAGACCTAATGTGACT |
| SEQ ID NO: 5491 | mm52382_Btla | TCACATGGATGGTTACTGAA |
| SEQ ID NO: 5492 | mm52383_Btla | TTTGATACTTACTTATTAGT |
| SEQ ID NO: 5493 | mm52408_Ghsr | GCTCGACACCCATACCATCA |
| SEQ ID NO: 5494 | mm52409_Ghsr | CAACCTCTACCTATCCAGCA |
| SEQ ID NO: 5495 | mm52410_Ghsr | CGGCACTCGTTGGTGTCCCG |
| SEQ ID NO: 5496 | mm52411_Ghsr | CACCACGAAGAGCGCCACGC |
| SEQ ID NO: 5497 | mm52424_Tmem132c | TTGGGTGAGGACGCGCACTG |
| SEQ ID NO: 5498 | mm52425_Tmem132c | AGGAAGCTATAATCAGCACA |
| SEQ ID NO: 5499 | mm52426_Tmem132c | GGAAGAGAATAGCACCCTGA |
| SEQ ID NO: 5500 | mm52427_Tmem132c | TAGCTGACGTTTAATACCGG |
| SEQ ID NO: 5501 | mm52436_Tor1aip1 | GAAAACTCTTAGAACACCAG |
| SEQ ID NO: 5502 | mm52437_Tor1aip1 | AGAGTCAAAACGAGAAGCTG |
| SEQ ID NO: 5503 | mm52438_Tor1aip1 | AGCGATTCTCTTGAGTCAAG |
| SEQ ID NO: 5504 | mm52439_Tor1aip1 | ACCAAAATAGTCCCACTGCA |
| SEQ ID NO: 5505 | mm52576_Tmem63a | AGATGCGTATCCCACGTGTG |
| SEQ ID NO: 5506 | mm52577_Tmem63a | AAGGTACCTGGTGAGACCGA |
| SEQ ID NO: 5507 | mm52578_Tmem63a | CCAGGGCCTTCGGTGCAAAG |
| SEQ ID NO: 5508 | mm52579_Tmem63a | CACCCAGCAAGTCTCCCGAG |
| SEQ ID NO: 5509 | mm52712_Enox2 | ACACTTACCAGACAGATAGA |
| SEQ ID NO: 5510 | mm52713_Enox2 | TCTGAATAGTGGACCACTGG |
| SEQ ID NO: 5511 | mm52714_Enox2 | TTTGCTACCGGCATATCTGG |
| SEQ ID NO: 5512 | mm52715_Enox2 | TGGGACAGAGCAGATCATTG |
| SEQ ID NO: 5513 | mm52728_Igsf1 | TTCCTGGCCCCGGATTGGAA |
| SEQ ID NO: 5514 | mm52729_Igsf1 | GGAACAATTGAAAGTCACTC |
| SEQ ID NO: 5515 | mm52730_Igsf1 | ACTTGGAATGTCTTGTAAGG |
| SEQ ID NO: 5516 | mm52731_Igsf1 | TAGATTACCAAGTCCCAACT |
| SEQ ID NO: 5517 | mm52744_Wfdc6a | CCAGAGAGTTACCTTGCCTG |

TABLE 1-continued mmSurf sgRNA library sequences

| SEQ ID NO | id_gRNA Target | Sequence |
|---|---|---|
| SEQ ID NO: 5518 | mm52745_Wfdc6a | AAGAGTCAGAGTGAAGTGTG |
| SEQ ID NO: 5519 | mm52746_Wfdc6a | AAGAAAGAAATGAGTGTACA |
| SEQ ID NO: 5520 | mm52747_Wfdc6a | AGGTGTTGCCTGTTCAGCTG |
| SEQ ID NO: 5521 | mm52760_Itih5 | GCATGCTCTACTACGTCAGG |
| SEQ ID NO: 5522 | mm52761_Itih5 | AAATAACCATTCAGAACCTG |
| SEQ ID NO: 5523 | mm52762_Itih5 | GCAGAAGCTCTTCATAACTG |
| SEQ ID NO: 5524 | mm52763_Itih5 | AGGTGGGTTTCCCATCGGTG |
| SEQ ID NO: 5525 | mm52820_Enpp3 | GGTTTGTATCCGGAGTCACA |
| SEQ ID NO: 5526 | mm52821_Enpp3 | ACATAGATGGTATAAAAACT |
| SEQ ID NO: 5527 | mm52822_Enpp3 | GTGCAATTTATTCCGTTGTG |
| SEQ ID NO: 5528 | mm52823_Enpp3 | ATATTACGAGTCCTGATTCG |
| SEQ ID NO: 5529 | mm52892_Slc38a5 | AGCTACAGGCAGGAACGCGA |
| SEQ ID NO: 5530 | mm52893_Slc38a5 | ACCTGCCGGGAAAGTAGTCG |
| SEQ ID NO: 5531 | mm52894_Slc38a5 | GGAAGGTGCCAATAACAAGG |
| SEQ ID NO: 5532 | mm52895_Slc38a5 | ACCTCAGCAACGCTATCATG |
| SEQ ID NO: 5533 | mm52928_Iglon5 | ACAGACGGTTTCACCTCAGA |
| SEQ ID NO: 5534 | mm52929_Iglon5 | GCTGCTCATCAACACACCCG |
| SEQ ID NO: 5535 | mm52930_Iglon5 | TGTGAACATCTCCTCACCCG |
| SEQ ID NO: 5536 | mm52931_Iglon5 | CACACTGTATAGTTGTCCGC |
| SEQ ID NO: 5537 | mm52980_Gprc6a | CTACTCTGAAACATCCATCG |
| SEQ ID NO: 5538 | mm52981_Gprc6a | TCCCGATTGTCGGATCAGGT |
| SEQ ID NO: 5539 | mm52982_Gprc6a | ACCAGTATTTAAATCCCCGT |
| SEQ ID NO: 5540 | mm52983_Gprc6a | ATGCAACAATGAAACCCACT |
| SEQ ID NO: 5541 | mm53084_Unc5d | ACCATGGCAAGAATCACTCG |
| SEQ ID NO: 5542 | mm53085_Unc5d | GTGAGTCTACTCATACCACA |
| SEQ ID NO: 5543 | mm53086_Unc5d | CTGTATGGCAGCCAACATCG |
| SEQ ID NO: 5544 | mm53087_Unc5d | ACCTGGGAACGTCCAAGAGT |
| SEQ ID NO: 5545 | mm53172_Lrrc25 | CTGCATGGTTCACCCGAGCA |
| SEQ ID NO: 5546 | mm53173_Lrrc25 | CCTGCAGGCCATTCTTAGAC |
| SEQ ID NO: 5547 | mm53174_Lrrc25 | CTGGTTGTGGGTGACAATCA |
| SEQ ID NO: 5548 | mm53175_Lrrc25 | GGCACCTGCCTCAATTTCAG |
| SEQ ID NO: 5549 | mm53188_Cln5 | GACAAAATTCGAACAGTCGT |
| SEQ ID NO: 5550 | mm53189_Cln5 | CCAGCGTTGCCCAGACGTCG |
| SEQ ID NO: 5551 | mm53190_Cln5 | GCCCCTTGGTTACACCAGAA |
| SEQ ID NO: 5552 | mm53191_Cln5 | ATATTTAAATTCCCAAATCG |
| SEQ ID NO: 5553 | mm53196_Nrg1 | AGTCGTGGAGTGATGAGCTG |
| SEQ ID NO: 5554 | mm53197_Nrg1 | GGTGGTCGGCATCATGTGTG |
| SEQ ID NO: 5555 | mm53198_Nrg1 | GCAAGGTGACCATGTCGCTG |

TABLE 1-continued mmSurf sgRNA library sequences

| SEQ ID NO | id_gRNA Target | Sequence |
| --- | --- | --- |
| SEQ ID NO: 5556 | mm53199_Nrg1 | CAGCCATCTCATAAAGTGTG |
| SEQ ID NO: 5557 | mm53248_Tmem87a | GTTGACTTACAATCATCAGT |
| SEQ ID NO: 5558 | mm53249_Tmem87a | AGGAGTCCTCAGAGTTACAG |
| SEQ ID NO: 5559 | mm53250_Tmem87a | TTTCAGAATATCCGATACAA |
| SEQ ID NO: 5560 | mm53251_Tmem87a | AGATGAAATAGAGTCATACT |
| SEQ ID NO: 5561 | mm53268_Mrgprf | GATGTGTCCTGGTATGAGCG |
| SEQ ID NO: 5562 | mm53269_Mrgprf | GCTGAAGAGGTACATCCCAT |
| SEQ ID NO: 5563 | mm53270_Mrgprf | TCTTCGAATGTAGTCGGGGA |
| SEQ ID NO: 5564 | mm53271_Mrgprf | GAATGATAGCATCCAGAGCA |
| SEQ ID NO: 5565 | mm53280_Ptchd1 | AACCCAAGTAGGCCTAACCA |
| SEQ ID NO: 5566 | mm53281_Ptchd1 | TCTGACGGCTAGATTCAGTG |
| SEQ ID NO: 5567 | mm53282_Ptchd1 | TATAATGGGCACCAACTCGG |
| SEQ ID NO: 5568 | mm53283_Ptchd1 | TTGAAATGTTATCCTCGTGG |
| SEQ ID NO: 5569 | mm53584_Dse | GTCAAAGTATAAGCATGACC |
| SEQ ID NO: 5570 | mm53585_Dse | CAGCACACAGAACATTGCCA |
| SEQ ID NO: 5571 | mm53586_Dse | AGTTTCATACATATAGCCCG |
| SEQ ID NO: 5572 | mm53587_Dse | TAATGAACGGCACACCATTG |
| SEQ ID NO: 5573 | mm53624_Wbscr17 | TGACCGAAGTATCACAGACA |
| SEQ ID NO: 5574 | mm53625_Wbscr17 | GGGCCACCCTTGAACATGGA |
| SEQ ID NO: 5575 | mm53626_Wbscr17 | ATCTGGAATAGACCGGTCCA |
| SEQ ID NO: 5576 | mm53627_Wbscr17 | GCTACGAGAACTCCGCCCAC |
| SEQ ID NO: 5577 | mm53664_Slc39a14 | GAGCGAGCGATCTCAGATCG |
| SEQ ID NO: 5578 | mm53665_Slc39a14 | GTAGAGGGTTCCAATCGCCA |
| SEQ ID NO: 5579 | mm53666_Slc39a14 | TAAAATGGTTATGCCCGTGA |
| SEQ ID NO: 5580 | mm53667_Slc39a14 | GTGACCGAGAAGCTACAGAA |
| SEQ ID NO: 5581 | mm53708_Tapbpl | GCCGCCACTCCACGCCAGTG |
| SEQ ID NO: 5582 | mm53709_Tapbpl | AAGGCATCACAGATTTCCAG |
| SEQ ID NO: 5583 | mm53710_Tapbpl | GGAGCCTGAGGAGCTACTCA |
| SEQ ID NO: 5584 | mm53711_Tapbpl | GAAATACTTGGAGATCTCGC |
| SEQ ID NO: 5585 | mm53848_Slc44a3 | AGGATGGCACACGTCCACAG |
| SEQ ID NO: 5586 | mm53849_Slc44a3 | GTTCATCATGGGTTATTCGG |
| SEQ ID NO: 5587 | mm53850_Slc44a3 | GAACCGGAAGGCGAACAACA |
| SEQ ID NO: 5588 | mm53851_Slc44a3 | CCACCACATATACCGAATGC |
| SEQ ID NO: 5589 | mm53884_Casd1 | CATGCACATTCGAGTTCTGG |
| SEQ ID NO: 5590 | mm53885_Casd1 | TGTGAATACCTTCTCTCGAG |
| SEQ ID NO: 5591 | mm53886_Casd1 | TGTGGTGTTATGTATCGTAA |
| SEQ ID NO: 5592 | mm53887_Casd1 | GAAGATAGACGCCTACAATG |
| SEQ ID NO: 5593 | mm53932_Slc18a2 | CGAGCCATACGTACCTACGA |

TABLE 1-continued mmSurf sgRNA library sequences

| SEQ ID NO | id_gRNA Target | Sequence |
|---|---|---|
| SEQ ID NO: 5594 | mm53933_Slc18a2 | CCATCTGCTTTGCAAACATG |
| SEQ ID NO: 5595 | mm53934_Slc18a2 | GTACATACCTAAGACCCCCA |
| SEQ ID NO: 5596 | mm53935_Slc18a2 | ATGCAGAATCCAGCAAACAT |
| SEQ ID NO: 5597 | mm53948_Nipal4 | ATTCCTTTGCCCGTAACGTG |
| SEQ ID NO: 5598 | mm53949_Nipal4 | GCTACCTGAAGGACCCAATG |
| SEQ ID NO: 5599 | mm53950_Nipal4 | TGCCTCTCACGATCTGACAG |
| SEQ ID NO: 5600 | mm53951_Nipal4 | GGATGACACTGGTGCCGATG |
| SEQ ID NO: 5601 | mm53988_Disp2 | CAAGTGTACCGGAAGCAACG |
| SEQ ID NO: 5602 | mm53989_Disp2 | GCTTCCACTAAACACAGCGT |
| SEQ ID NO: 5603 | mm53990_Disp2 | CTACAGTACAGAGTACGGCC |
| SEQ ID NO: 5604 | mm53991_Disp2 | CGAAACTTAATGACACCACA |
| SEQ ID NO: 5605 | mm54068_Tmprss4 | CCACGGCCAAGAATCCACAG |
| SEQ ID NO: 5606 | mm54069_Tmprss4 | AGGGCAGGCTCAAACATACT |
| SEQ ID NO: 5607 | mm54070_Tmprss4 | CTGTGACTTGAGCAACAGGG |
| SEQ ID NO: 5608 | mm54071_Tmprss4 | GCTGCTGTGAGGATCCAGTG |
| SEQ ID NO: 5609 | mm54112_Sidt2 | ATAGTTGTAACCCTCGTAAG |
| SEQ ID NO: 5610 | mm54113_Sidt2 | TCTTGGACCATAGATATCAG |
| SEQ ID NO: 5611 | mm54114_Sidt2 | CAAAAACGTCATTCGAACCA |
| SEQ ID NO: 5612 | mm54115_Sidt2 | TGTTGTCCAGATCATAGACA |
| SEQ ID NO: 5613 | mm54188_Lman2l | TCTTGACATAGCGAATCACG |
| SEQ ID NO: 5614 | mm54189_Lman2l | TCTTACCACCCGGTTCCACA |
| SEQ ID NO: 5615 | mm54190_Lman2l | TCGCTGTCGAAGCCCTACCA |
| SEQ ID NO: 5616 | mm54191_Lman2l | CTTGGCAATCTGGTACACAA |
| SEQ ID NO: 5617 | mm54360_Rab11fip3 | GGACGGCTTCGTCCGCATCG |
| SEQ ID NO: 5618 | mm54361_Rab11fip3 | CGCACCGTGCCTCTTGACGG |
| SEQ ID NO: 5619 | mm54362_Rab11fip3 | GGAGCAGCAGCAATGCACCA |
| SEQ ID NO: 5620 | mm54363_Rab11fip3 | ATTCTGTCACTTGCTCAAGG |
| SEQ ID NO: 5621 | mm54400_Rnpep | TGATAACGTCGGCTAACGAG |
| SEQ ID NO: 5622 | mm54401_Rnpep | AGCAGTAACCTTTCTCGTAG |
| SEQ ID NO: 5623 | mm54402_Rnpep | TGTGATGAGTGCAGACACCT |
| SEQ ID NO: 5624 | mm54403_Rnpep | TGGCACCTTACCAAACAGGA |
| SEQ ID NO: 5625 | mm54464_Adgrg6 | AATGCTGTTGATATTAGCCG |
| SEQ ID NO: 5626 | mm54465_Adgrg6 | CTTGTGTGGAATAATTCTTG |
| SEQ ID NO: 5627 | mm54466_Adgrg6 | CATCACTAGAGGATGGACTG |
| SEQ ID NO: 5628 | mm54467_Adgrg6 | CACATGCATCTCATTCACGC |
| SEQ ID NO: 5629 | mm54504_Fam26f | GGGACACTGGAACACCACTG |
| SEQ ID NO: 5630 | mm54505_Fam26f | CGCTCCCGCTGACAGCACAT |
| SEQ ID NO: 5631 | mm54506_Fam26f | GGTGAGGGGCGCGAATGCCG |

TABLE 1-continued mmSurf sgRNA library sequences

| SEQ ID NO | id_gRNA Target | Sequence |
|---|---|---|
| SEQ ID NO: 5632 | mm54507_Fam26f | GGAGCGCGCGATTCAGTTCG |
| SEQ ID NO: 5633 | mm54544_Lrrtm3 | GGGGGTTAACGTGATCGATG |
| SEQ ID NO: 5634 | mm54545_Lrrtm3 | CAACCGGCAGATATACTCGA |
| SEQ ID NO: 5635 | mm54546_Lrrtm3 | CACTGAGAACCATCCCGGTG |
| SEQ ID NO: 5636 | mm54547_Lrrtm3 | TCTCGTCGATATTGCTGATG |
| SEQ ID NO: 5637 | mm54624_Ckap4 | TCTGTCGGACGGGATCCACG |
| SEQ ID NO: 5638 | mm54625_Ckap4 | AGAGGACATCCGGAGACTGG |
| SEQ ID NO: 5639 | mm54626_Ckap4 | CCGCACCTCTGTGTAGACGT |
| SEQ ID NO: 5640 | mm54627_Ckap4 | CCGCAGAACCAGGCGCACCG |
| SEQ ID NO: 5641 | mm54672_Tspan8 | TGAGGCAAAAGACTTCCAGA |
| SEQ ID NO: 5642 | mm54673_Tspan8 | GTATGTGGTACACTGATCTT |
| SEQ ID NO: 5643 | mm54674_Tspan8 | ACGTACCTCAGGTTTGAAAG |
| SEQ ID NO: 5644 | mm54675_Tspan8 | AGATATTCACAGCAATGAAG |
| SEQ ID NO: 5645 | mm54684_Tmem5 | TGCATAAATTAACCACTGGG |
| SEQ ID NO: 5646 | mm54685_Tmem5 | GCGCCCGAAGAAGACGTGGT |
| SEQ ID NO: 5647 | mm54686_Tmem5 | ATGTCTGCACCATTAATCCA |
| SEQ ID NO: 5648 | mm54687_Tmem5 | TCTTTACAGTGACTTACCAA |
| SEQ ID NO: 5649 | mm54900_Nlgn2 | ACCAGCCGCTCAAGTACACG |
| SEQ ID NO: 5650 | mm54901_Nlgn2 | GCTCACAAAAAACGTGACG |
| SEQ ID NO: 5651 | mm54902_Nlgn2 | GAAAGTGTAAAAGTAGACGG |
| SEQ ID NO: 5652 | mm54903_Nlgn2 | CCGAGATCCTCATGCAACAG |
| SEQ ID NO: 5653 | mm55124_Fam171a2 | CCCGAGACTTAGCATCCTCG |
| SEQ ID NO: 5654 | mm55125_Fam171a2 | GTGGCCCAGATAATGGTCGA |
| SEQ ID NO: 5655 | mm55126_Fam171a2 | GGTACCCAGGCGGTAACTGA |
| SEQ ID NO: 5656 | mm55127_Fam171a2 | CTGTGGGTACGAAATGGCAC |
| SEQ ID NO: 5657 | mm55140_Abca9 | TGGGCGCTTACAAAGCGATG |
| SEQ ID NO: 5658 | mm55141_Abca9 | GCTGCCCATCGCAATGTAAG |
| SEQ ID NO: 5659 | mm55142_Abca9 | TAGGTAAGTACGGACATCAA |
| SEQ ID NO: 5660 | mm55143_Abca9 | CTGGGTTGGATCCACTCTCG |
| SEQ ID NO: 5661 | mm55208_Rhbdf2 | ACAGATATCCTCTTGCGGCG |
| SEQ ID NO: 5662 | mm55209_Rhbdf2 | GTGAACGAACGTCAGCCAGT |
| SEQ ID NO: 5663 | mm55210_Rhbdf2 | TAAAGTGGCAGAATGATACT |
| SEQ ID NO: 5664 | mm55211_Rhbdf2 | ACCAGAAAAGAATACAGCGG |
| SEQ ID NO: 5665 | mm55216_Tmc6 | GGAGTCATGTCGCTCCAGAG |
| SEQ ID NO: 5666 | mm55217_Tmc6 | TTTCCAAGGTCGCAGCCGTG |
| SEQ ID NO: 5667 | mm55218_Tmc6 | GACCAGAAAACGTAGGCACG |
| SEQ ID NO: 5668 | mm55219_Tmc6 | TACCGGGTTGGCAGTACCAA |
| SEQ ID NO: 5669 | mm55316_Mgat2 | GAAGTTCAACTGGTACACCA |

TABLE 1-continued mmSurf sgRNA library sequences

| SEQ ID NO | id_gRNA Target | Sequence |
|---|---|---|
| SEQ ID NO: 5670 | mm55317_Mgat2 | TGTAATGGCCGAAGGAGTCA |
| SEQ ID NO: 5671 | mm55318_Mgat2 | AAAAGTCTGGGGCTAAGTAG |
| SEQ ID NO: 5672 | mm55319_Mgat2 | CTGGACGCGGAGCCCGTACG |
| SEQ ID NO: 5673 | mm55380_Tmem63c | CCTGACCTCACTGATCTACG |
| SEQ ID NO: 5674 | mm55381_Tmem63c | GATTACAAGTACATCCATTG |
| SEQ ID NO: 5675 | mm55382_Tmem63c | GAATGACCACCATAAACACC |
| SEQ ID NO: 5676 | mm55383_Tmem63c | TCTCCCAACTCCAGTTCACG |
| SEQ ID NO: 5677 | mm55384_Pomt2 | TGGACAGATCCAGTACGGTG |
| SEQ ID NO: 5678 | mm55385_Pomt2 | GTAGTCCTTATGCAAATAGG |
| SEQ ID NO: 5679 | mm55386_Pomt2 | CCTGCACAGTCACTATCATG |
| SEQ ID NO: 5680 | mm55387_Pomt2 | TCTTTATCATCGTGCAAGTG |
| SEQ ID NO: 5681 | mm55568_Clptm1l | CCTACGACAAGATCTCATTG |
| SEQ ID NO: 5682 | mm55569_Clptm1l | TGAGTGTTTACACCACCACA |
| SEQ ID NO: 5683 | mm55570_Clptm1l | CTGGCGTTGCTTCAGCACTG |
| SEQ ID NO: 5684 | mm55571_Clptm1l | CAAACCCCCAGGATTCAGCT |
| SEQ ID NO: 5685 | mm55592_Serinc5 | CCAGAGAGATTAGCACGCAT |
| SEQ ID NO: 5686 | mm55593_Serinc5 | GCACCGTCCGTAATAAGCTG |
| SEQ ID NO: 5687 | mm55594_Serinc5 | TGCCGGGCCTACATTCACAA |
| SEQ ID NO: 5688 | mm55595_Serinc5 | ACACCGCAGAATACCCTACC |
| SEQ ID NO: 5689 | mm55640_Il31ra | GAAGGTGCGATTGTTGTGGA |
| SEQ ID NO: 5690 | mm55641_Il31ra | ACGAACTGGACCATCGAGCA |
| SEQ ID NO: 5691 | mm55642_Il31ra | AACCGCGTGAAAAGACTCGT |
| SEQ ID NO: 5692 | mm55643_Il31ra | TGCCAGTTCACCACCAACAG |
| SEQ ID NO: 5693 | mm55672_Slc4a7 | TCAGGAACATAAGGTCCATG |
| SEQ ID NO: 5694 | mm55673_Slc4a7 | TCTGCAAAGGATCGAACCAG |
| SEQ ID NO: 5695 | mm55674_Slc4a7 | ACAGTATAGGAAAAGAATCG |
| SEQ ID NO: 5696 | mm55675_Slc4a7 | GCAGATCCATTAGGAAACAC |
| SEQ ID NO: 5697 | mm56140_Rtp2 | GAGCAGTGTTACGATGAGGA |
| SEQ ID NO: 5698 | mm56141_Rtp2 | GCTATCAGTGCGGCACGTCG |
| SEQ ID NO: 5699 | mm56142_Rtp2 | ATGCTGGAGGAGAATATCGA |
| SEQ ID NO: 5700 | mm56143_Rtp2 | TGGAGCAACATGCCTCAGGC |
| SEQ ID NO: 5701 | mm56152_Atp13a3 | ATAGTGCAGGACTGACACAG |
| SEQ ID NO: 5702 | mm56153_Atp13a3 | TTCAGCGAGTGGAAAATACC |
| SEQ ID NO: 5703 | mm56154_Atp13a3 | TTAATAAGTACTGCATCACA |
| SEQ ID NO: 5704 | mm56155_Atp13a3 | TAACCGGATCATGCCTACTG |
| SEQ ID NO: 5705 | mm56212_Cldnd1 | TGACTCGAATAAAATCGCCT |
| SEQ ID NO: 5706 | mm56213_Cldnd1 | TGCCGCTATTGTGGTTGCCG |
| SEQ ID NO: 5707 | mm56214_Cldnd1 | ATCTACATGGCGGCCTCCAT |

TABLE 1-continued mmSurf sgRNA library sequences

| SEQ ID NO | id_gRNA Target | Sequence |
|---|---|---|
| SEQ ID NO: 5708 | mm56215_Cldnd1 | ACTGGTATGCGCCACCGGAA |
| SEQ ID NO: 5709 | mm56384_Adgrf5 | GTACGCTGTGACTTTCCACG |
| SEQ ID NO: 5710 | mm56385_Adgrf5 | AAGAGCATGGTGATAAAACG |
| SEQ ID NO: 5711 | mm56386_Adgrf5 | TCCCTCGAATTGGAAAACTG |
| SEQ ID NO: 5712 | mm56387_Adgrf5 | CTCACCGTTCCACTCTCGGG |
| SEQ ID NO: 5713 | mm56388_Enpp4 | TGTTATAGACTTGACCCCTG |
| SEQ ID NO: 5714 | mm56389_Enpp4 | AAGGATACCAGAAGTAACCG |
| SEQ ID NO: 5715 | mm56390_Enpp4 | TGATCATTACAAGCGATCAT |
| SEQ ID NO: 5716 | mm56391_Enpp4 | GACTGGGTAACGTTACCACA |
| SEQ ID NO: 5717 | mm56400_Tmem63b | ATGATCAACCCCAAACCGTG |
| SEQ ID NO: 5718 | mm56401_Tmem63b | CAGTAGCGTAGGGAAGAACT |
| SEQ ID NO: 5719 | mm56402_Tmem63b | GCTCTGTCGACTTTGACCAA |
| SEQ ID NO: 5720 | mm56403_Tmem63b | AAAGTGAACGAGAAACCTCT |
| SEQ ID NO: 5721 | mm56672_Mppe1 | ATTGGCTGGACAAATTACGA |
| SEQ ID NO: 5722 | mm56673_Mppe1 | AAGTGGAGCTCCGATCAGGT |
| SEQ ID NO: 5723 | mm56674_Mppe1 | CATGGTCAACAGCGTTGCAA |
| SEQ ID NO: 5724 | mm56675_Mppe1 | TAAACTGAATTGCTCCCAAG |
| SEQ ID NO: 5725 | mm56704_Cd226 | ATTGACGCATAACTTAACCC |
| SEQ ID NO: 5726 | mm56705_Cd226 | ACTTCCTAAACTCAACAGTG |
| SEQ ID NO: 5727 | mm56706_Cd226 | GCTAAGATGTCTACCTGATG |
| SEQ ID NO: 5728 | mm56707_Cd226 | TGCAGACAGGTAGCTATCCG |
| SEQ ID NO: 5729 | mm56732_Lrfn4 | CAAAGGAGCGAGCCCCAATG |
| SEQ ID NO: 5730 | mm56733_Lrfn4 | GCTGTTTGTGCCACCCAACG |
| SEQ ID NO: 5731 | mm56734_Lrfn4 | TGTGTGTGCCGGGCAATCAG |
| SEQ ID NO: 5732 | mm56735_Lrfn4 | CTCATCGATGCACTACCCCC |
| SEQ ID NO: 5733 | mm56836_Ermp1 | GCATCTCCGTAGATATACAG |
| SEQ ID NO: 5734 | mm56837_Ermp1 | ATTGCGTACCCTTCTCGTGT |
| SEQ ID NO: 5735 | mm56838_Ermp1 | GATGTTGAGTAATAAAACCA |
| SEQ ID NO: 5736 | mm56839_Ermp1 | TGGTGCTGAGCCGGACCTCG |
| SEQ ID NO: 5737 | mm57020_Lamc1 | ATGTAGCGATGGGTACTATG |
| SEQ ID NO: 5738 | mm57021_Lamc1 | TTGACCTCTATCAAGATCCG |
| SEQ ID NO: 5739 | mm57022_Lamc1 | ACGTACTCAAAGGCTAACCG |
| SEQ ID NO: 5740 | mm57023_Lamc1 | CAGTCGCGGCCAGACACATG |
| SEQ ID NO: 5741 | mm57200_Slc39a10 | CGTGCGTATGCTGATGACTG |
| SEQ ID NO: 5742 | mm57201_Slc39a10 | TGAACAATATGAGCATAACC |
| SEQ ID NO: 5743 | mm57202_Slc39a10 | AGTCGTTGAGATTAATCACG |
| SEQ ID NO: 5744 | mm57203_Slc39a10 | CGATCTGATACAGCAATGCA |
| SEQ ID NO: 5745 | mm57256_Aamp | TGGATGTGGAAGGTCCCGAA |

TABLE 1-continued mmSurf sgRNA library sequences

| SEQ ID NO | id_gRNA Target | Sequence |
|---|---|---|
| SEQ ID NO: 5746 | mm57257_Aamp | ATCACCGAGCCTCCACACGA |
| SEQ ID NO: 5747 | mm57258_Aamp | AAGACCACTCATGTCCCCTG |
| SEQ ID NO: 5748 | mm57259_Aamp | GGAGGGCCCGGATGATAGTG |
| SEQ ID NO: 5749 | mm57268_Dner | AACACTCTAAGTCATTTGAG |
| SEQ ID NO: 5750 | mm57269_Dner | CATTCCCACAGGCAACATCA |
| SEQ ID NO: 5751 | mm57270_Dner | GAACAATGGCACTTGCTACG |
| SEQ ID NO: 5752 | mm57271_Dner | CACACTTCGACCATCTATGA |
| SEQ ID NO: 5753 | mm57304_Slco4c1 | TTATAGTTCGGATCTGACTG |
| SEQ ID NO: 5754 | mm57305_Slco4c1 | ACAAAGATACGTGCTTAACA |
| SEQ ID NO: 5755 | mm57306_Slco4c1 | TTTCCCCTTAGAATTTGATG |
| SEQ ID NO: 5756 | mm57307_Slco4c1 | AGAGAGGACACAAACCTCGC |
| SEQ ID NO: 5757 | mm57400_Qsox2 | TGGTGCAGTTCCACTCGTCG |
| SEQ ID NO: 5758 | mm57401_Qsox2 | GAGGAGAAAAACGATCGTAG |
| SEQ ID NO: 5759 | mm57402_Qsox2 | AGAAGTGGATGTCATATGTG |
| SEQ ID NO: 5760 | mm57403_Qsox2 | GGGATGTCAAGGAAGTCGAT |
| SEQ ID NO: 5761 | mm57612_Lrp4 | ATAGTGCCAACAAGTTTACG |
| SEQ ID NO: 5762 | mm57613_Lrp4 | TGACATCTGTCCAATACACG |
| SEQ ID NO: 5763 | mm57614_Lrp4 | GACAACAGTGACGAGCAATG |
| SEQ ID NO: 5764 | mm57615_Lrp4 | TGGTATAATACAATGGCCCG |
| SEQ ID NO: 5765 | mm58020_Pbxip1 | TGTTGATACCCTGATTCTCG |
| SEQ ID NO: 5766 | mm58021_Pbxip1 | GAGCCTCGGACCAGACACAC |
| SEQ ID NO: 5767 | mm58022_Pbxip1 | CGTGGTACCCGTAGATGTGG |
| SEQ ID NO: 5768 | mm58023_Pbxip1 | TATGCTGCTCCAATAAGCTG |
| SEQ ID NO: 5769 | mm58060_Adamtsl4 | TGAGATTTCCCGAAACCAGG |
| SEQ ID NO: 5770 | mm58061_Adamtsl4 | GGGGAATCCGCACCTGACGT |
| SEQ ID NO: 5771 | mm58062_Adamtsl4 | CATACTGATAAAAAACACCT |
| SEQ ID NO: 5772 | mm58063_Adamtsl4 | GAACTGAACTGCCGCCCCCG |
| SEQ ID NO: 5773 | mm58136_Amigo1 | GCTTGCAGTCGCACTCCAAG |
| SEQ ID NO: 5774 | mm58137_Amigo1 | CGGGACAACTAACCACAGAT |
| SEQ ID NO: 5775 | mm58138_Amigo1 | AGTACCTAAGGTTGGGTACG |
| SEQ ID NO: 5776 | mm58139_Amigo1 | GCAAGGCATGACCAAAGTGT |
| SEQ ID NO: 5777 | mm58248_Npr2 | CAGCGGGGTACACACAACCG |
| SEQ ID NO: 5778 | mm58249_Npr2 | ATGGCAGGACAATCGAACCC |
| SEQ ID NO: 5779 | mm58250_Npr2 | ACAGGACGAAATCAGTCTCG |
| SEQ ID NO: 5780 | mm58251_Npr2 | CAACTCGGATCGCTATCACA |
| SEQ ID NO: 5781 | mm58268_Tmeff1 | GCACCAGAAAGACATAACCG |
| SEQ ID NO: 5782 | mm58269_Tmeff1 | ATTGTTATAGGAACTCCCGT |
| SEQ ID NO: 5783 | mm58270_Tmeff1 | CCCTGTCTGTGGGTCAAACG |

TABLE 1-continued mmSurf sgRNA library sequences

| SEQ ID NO | id_gRNA Target | Sequence |
|---|---|---|
| SEQ ID NO: 5784 | mm58271_Tmeff1 | CGCCGTCTGCGGCTACACGT |
| SEQ ID NO: 5785 | mm58312_Megf9 | GGACGGACACACTCCCACCA |
| SEQ ID NO: 5786 | mm58313_Megf9 | TGGGAATTGCCAATGCAAAG |
| SEQ ID NO: 5787 | mm58314_Megf9 | CACCACAGTCCGCAAAACCG |
| SEQ ID NO: 5788 | mm58315_Megf9 | CTGTGTAACCATCTTTACAT |
| SEQ ID NO: 5789 | mm58364_Fam151a | ATCAATGCTGACATCCTGAG |
| SEQ ID NO: 5790 | mm58365_Fam151a | GTACTGGCCTCATCTCAGAA |
| SEQ ID NO: 5791 | mm58366_Fam151a | CTTGTAAATAGGCGATGTCA |
| SEQ ID NO: 5792 | mm58367_Fam151a | GGAGATCTTCTACTGACACG |
| SEQ ID NO: 5793 | mm58368_Yipf1 | CAACGACTCTGACGAGACCG |
| SEQ ID NO: 5794 | mm58369_Yipf1 | GGGGTCCTCAATGTTTATCG |
| SEQ ID NO: 5795 | mm58370_Yipf1 | TGCTATGGCAAAGACCAACG |
| SEQ ID NO: 5796 | mm58371_Yipf1 | GACACACACGATCTCCAGAA |
| SEQ ID NO: 5797 | mm58476_Epha10 | GCGATGGTGTCAATCTTGCG |
| SEQ ID NO: 5798 | mm58477_Epha10 | GCTTCACGCAGGGTGACCTG |
| SEQ ID NO: 5799 | mm58478_Epha10 | GACTGCACTGCCAAGCACTG |
| SEQ ID NO: 5800 | mm58479_Epha10 | CAGACAGGCTGGATCAGCCG |
| SEQ ID NO: 5801 | mm58592_Ece1 | GCACGCACGGTAGTACACTT |
| SEQ ID NO: 5802 | mm58593_Ece1 | AGTGACACGGAAAACAACCT |
| SEQ ID NO: 5803 | mm58594_Ece1 | CAATGAGTCTGAGCCAATCG |
| SEQ ID NO: 5804 | mm58595_Ece1 | CTTCTCTGTTTATGTCAGCG |
| SEQ ID NO: 5805 | mm58608_Igsf21 | GTATCTACGACCGAGCCACG |
| SEQ ID NO: 5806 | mm58609_Igsf21 | TCACGGTGGACTGATACACA |
| SEQ ID NO: 5807 | mm58610_Igsf21 | TCGGCGCTGTGTACCCAACG |
| SEQ ID NO: 5808 | mm58611_Igsf21 | AACCTCCAAGCACTTACCAT |
| SEQ ID NO: 5809 | mm58660_Ajap1 | TTCAACGATTTCGACTTCCG |
| SEQ ID NO: 5810 | mm58661_Ajap1 | TGCGAAGTGGACCCCCAACG |
| SEQ ID NO: 5811 | mm58662_Ajap1 | GCCACCCTCGGACCCAAAGG |
| SEQ ID NO: 5812 | mm58663_Ajap1 | GCAAACACGGAAGACAACGG |
| SEQ ID NO: 5813 | mm58676_Tnfrsf14 | TGGGCGGTATATGTCTGTGG |
| SEQ ID NO: 5814 | mm58677_Tnfrsf14 | TATGTGCTGACTGCCTAACA |
| SEQ ID NO: 5815 | mm58678_Tnfrsf14 | CCTGGATCACAGACTCCGCA |
| SEQ ID NO: 5816 | mm58679_Tnfrsf14 | GCCCATGTGCAACCCAGGT |
| SEQ ID NO: 5817 | mm58832_Tmprss11d | TACGGAGCTGTACCCGTCGT |
| SEQ ID NO: 5818 | mm58833_Tmprss11d | CTAATAATGTCCACCACTG |
| SEQ ID NO: 5819 | mm58834_Tmprss11d | CCTAAACGTTGAATACACTG |
| SEQ ID NO: 5820 | mm58835_Tmprss11d | TCGTTGTCATAATAACGGTA |
| SEQ ID NO: 5821 | mm58864_Fras1 | TGGTGGGTGTGCTTACAACG |

TABLE 1-continued mmSurf sgRNA library sequences

| SEQ ID NO | id_gRNA Target | Sequence |
|---|---|---|
| SEQ ID NO: 5822 | mm58865_Fras1 | CCCCACTTGGCAATAAACCG |
| SEQ ID NO: 5823 | mm58866_Fras1 | ACTGGGGCTGAATAACACTT |
| SEQ ID NO: 5824 | mm58867_Fras1 | CTGAAGAGTACGCCATACAG |
| SEQ ID NO: 5825 | mm58924_P2rx2 | GGAATACGTAAAGCCCCCGG |
| SEQ ID NO: 5826 | mm58925_P2rx2 | CTGTGTACCCTATTACCATG |
| SEQ ID NO: 5827 | mm58926_P2rx2 | TTTGATGAGAGTTCGAGTGG |
| SEQ ID NO: 5828 | mm58927_P2rx2 | ATCTCCACCCTAGAGCATGA |
| SEQ ID NO: 5829 | mm59160_Tmem150a | GCCAAGTCTCTACACTACAT |
| SEQ ID NO: 5830 | mm59161_Tmem150a | GCACACGTGGCGGTTCATCA |
| SEQ ID NO: 5831 | mm59162_Tmem150a | GAAAATTGCCGACCACCACG |
| SEQ ID NO: 5832 | mm59163_Tmem150a | TAGGCCATAGCCATGTCCAG |
| SEQ ID NO: 5833 | mm59244_Slc6a1 | CACCAACATGACCAGCGCCG |
| SEQ ID NO: 5834 | mm59245_Slc6a1 | GCAGAAATACACGAGCACCC |
| SEQ ID NO: 5835 | mm59246_Slc6a1 | TACCTCTGTGGGAAAAACGG |
| SEQ ID NO: 5836 | mm59247_Slc6a1 | TCCATGTGTCCCGGTCAGGG |
| SEQ ID NO: 5837 | mm59264_A2m | CCCTTGACTCACGATGAAGG |
| SEQ ID NO: 5838 | mm59265_A2m | CCGGAAGACCGATATTTGGG |
| SEQ ID NO: 5839 | mm59266_A2m | GGGCACGTCCCTAACTGTCA |
| SEQ ID NO: 5840 | mm59267_A2m | AAGGCTTGGAAATCGATCAC |
| SEQ ID NO: 5841 | mm59276_Clstn3 | CAGACGCTCCACAAAGACCG |
| SEQ ID NO: 5842 | mm59277_Clstn3 | CAGTTACCTGCATAGCGCAG |
| SEQ ID NO: 5843 | mm59278_Clstn3 | ACCGAGACAACTATTCAGAG |
| SEQ ID NO: 5844 | mm59279_Clstn3 | AGTAGTGGTGGATCAGCAAG |
| SEQ ID NO: 5845 | mm59292_Klrb1f | AATAAACATTTGTTCCAGTG |
| SEQ ID NO: 5846 | mm59293_Klrb1f | GAAGATGCTTGCTTATACCC |
| SEQ ID NO: 5847 | mm59294_Klrb1f | CTAAGACACTGAGTCCAATC |
| SEQ ID NO: 5848 | mm59295_Klrb1f | AGAGCCAAATGATGCCAGTG |
| SEQ ID NO: 5849 | mm59300_Clec12a | AACTCAATCAGTATGGAACA |
| SEQ ID NO: 5850 | mm59301_Clec12a | GAGATTGTGCTTCAGCTGTA |
| SEQ ID NO: 5851 | mm59302_Clec12a | CAGAAGTCTGACAAATGTGG |
| SEQ ID NO: 5852 | mm59303_Clec12a | GAGCTGTATAGCAAAGAACC |
| SEQ ID NO: 5853 | mm59304_Clec9a | CATTGGTGAACCTTACACAG |
| SEQ ID NO: 5854 | mm59305_Clec9a | ATTACCTGAACATTTGCTAG |
| SEQ ID NO: 5855 | mm59306_Clec9a | CAAGCCCATACAGACCACAC |
| SEQ ID NO: 5856 | mm59307_Clec9a | GTTACTATGTCTTTGAACGC |
| SEQ ID NO: 5857 | mm59372_Tspan33 | GCCAGGCTAATGAAGCACGC |
| SEQ ID NO: 5858 | mm59373_Tspan33 | GAATATGTACTTCAACTGCT |
| SEQ ID NO: 5859 | mm59374_Tspan33 | AAGGCAGATGTTCTCCCGAA |

TABLE 1-continued mmSurf sgRNA library sequences

| SEQ ID NO | id_gRNA Target | Sequence |
|---|---|---|
| SEQ ID NO: 5860 | mm59375_Tspan33 | CGTGCATTATCGAGATGACC |
| SEQ ID NO: 5861 | mm59608_Lrfn3 | CCTAGGCAACGTCAACACGT |
| SEQ ID NO: 5862 | mm59609_Lrfn3 | CCTAAGCGTGTTGTGCCCAG |
| SEQ ID NO: 5863 | mm59610_Lrfn3 | GGTGATACCCAACGCACTCG |
| SEQ ID NO: 5864 | mm59611_Lrfn3 | GCACCAGCTGTGACCCCCCG |
| SEQ ID NO: 5865 | mm59712_Siglech | GATGCACAAAAGGGTGACAA |
| SEQ ID NO: 5866 | mm59713_Siglech | CAAAACATGGAATTTCTGTG |
| SEQ ID NO: 5867 | mm59714_Siglech | GTTCCCCGTTCACAAGCCCA |
| SEQ ID NO: 5868 | mm59715_Siglech | ACTGAGGAGAGTGTGGTCGT |
| SEQ ID NO: 5869 | mm59760_Picalm | CCTCAGGGAGCGAGTACATG |
| SEQ ID NO: 5870 | mm59761_Picalm | TGGCCTATCTCTGACCAAAG |
| SEQ ID NO: 5871 | mm59762_Picalm | AGTTCATTACTATTAACCTA |
| SEQ ID NO: 5872 | mm59763_Picalm | GCCACGACCCACGAGATCAT |
| SEQ ID NO: 5873 | mm59788_Gdpd5 | AGTCGCTCCAGTAGCCCATG |
| SEQ ID NO: 5874 | mm59789_Gdpd5 | CCCCGTGATCACCCCTACCG |
| SEQ ID NO: 5875 | mm59790_Gdpd5 | CTCGCACGATGACACCACGC |
| SEQ ID NO: 5876 | mm59791_Gdpd5 | GAACCTGCACTGGATACACA |
| SEQ ID NO: 5877 | mm59824_Spon1 | TCACTGAAAGCACCCCTCGG |
| SEQ ID NO: 5878 | mm59825_Spon1 | GTCCGAGAAGACTCATCCGA |
| SEQ ID NO: 5879 | mm59826_Spon1 | GAACGTGGGCCTATCTGCAG |
| SEQ ID NO: 5880 | mm59827_Spon1 | AGGTGGGTCCATCACACAAG |
| SEQ ID NO: 5881 | mm59836_Acsm2 | AAACTAATACCCATACAGTG |
| SEQ ID NO: 5882 | mm59837_Acsm2 | CAACATCCGGTAAATGATGG |
| SEQ ID NO: 5883 | mm59838_Acsm2 | GTGTCTGAAAACAGTCGAGA |
| SEQ ID NO: 5884 | mm59839_Acsm2 | CTGTGGTGGATGAATGGCAG |
| SEQ ID NO: 5885 | mm59880_Slc5a11 | CGATGCCAGAATATCTAAGG |
| SEQ ID NO: 5886 | mm59881_Slc5a11 | GCGATGTCTGAACAGCCAGA |
| SEQ ID NO: 5887 | mm59882_Slc5a11 | ATGTGGAAGGCATCTTCTCG |
| SEQ ID NO: 5888 | mm59883_Slc5a11 | CCTGCACAATGGGGATCCAG |
| SEQ ID NO: 5889 | mm59908_Sez6l2 | TATGCTAACACTGTTCGACG |
| SEQ ID NO: 5890 | mm59909_Sez6l2 | GGATACAATGCGACCCAGTG |
| SEQ ID NO: 5891 | mm59910_Sez6l2 | GTCAGAGTCGTAAATCACAG |
| SEQ ID NO: 5892 | mm59911_Sez6l2 | CCACACATTCGATAGCATTG |
| SEQ ID NO: 5893 | mm60040_Gpm6a | GAGGATGTGTGAATCTACTG |
| SEQ ID NO: 5894 | mm60041_Gpm6a | CCGGAACACCACTCTAGTGG |
| SEQ ID NO: 5895 | mm60042_Gpm6a | TGTACATGTATTTCAATGTG |
| SEQ ID NO: 5896 | mm60043_Gpm6a | TGCTTGGATCTGCGTCAGTT |
| SEQ ID NO: 5897 | mm60060_Psd3 | TCTAGACAGATTCAAGAGAT |

TABLE 1-continued mmSurf sgRNA library sequences

| SEQ ID NO | id_gRNA Target | Sequence |
| --- | --- | --- |
| SEQ ID NO: 5898 | mm60061_Psd3 | TAGATGCTGGTTCTGAAATG |
| SEQ ID NO: 5899 | mm60062_Psd3 | TCTCATCAGTACCTTCTGAG |
| SEQ ID NO: 5900 | mm60063_Psd3 | GTTGAGCAGCATCATAGCAC |
| SEQ ID NO: 5901 | mm60292_Spire2 | GTACGAGCAGCCCATCAACG |
| SEQ ID NO: 5902 | mm60293_Spire2 | CTGCATCAGCATCTCGAAGG |
| SEQ ID NO: 5903 | mm60294_Spire2 | GGGACGGTTCGGTTGGCGCG |
| SEQ ID NO: 5904 | mm60295_Spire2 | GGTCGTGTTCCGAAAAGAG |
| SEQ ID NO: 5905 | mm60380_Adamts15 | TAATGACATACTCCGCACCT |
| SEQ ID NO: 5906 | mm60381_Adamts15 | AATGGTCAAGTTTCACGGCG |
| SEQ ID NO: 5907 | mm60382_Adamts15 | CAACGGTGGAAAATACTGCG |
| SEQ ID NO: 5908 | mm60383_Adamts15 | ATGAGCTTACACTTGTCACG |
| SEQ ID NO: 5909 | mm60528_Prtg | GTGTTGCAGATCTACGACGT |
| SEQ ID NO: 5910 | mm60529_Prtg | CGGCTCTCTATACATCAGTG |
| SEQ ID NO: 5911 | mm60530_Prtg | AAATAACGAGGAATATCAGG |
| SEQ ID NO: 5912 | mm60531_Prtg | GCTTGACATCTGATATAATG |
| SEQ ID NO: 5913 | mm60544_Cd109 | ACTGTGACGGAATCACTCAC |
| SEQ ID NO: 5914 | mm60545_Cd109 | AGTCTAATGTGATCCAACAG |
| SEQ ID NO: 5915 | mm60546_Cd109 | TTTGGCTAGACGCCTACATG |
| SEQ ID NO: 5916 | mm60547_Cd109 | CTCAATGAGTATCACAACCT |
| SEQ ID NO: 5917 | mm60604_Plxnb1 | TAAGACCGTAACGACCACCC |
| SEQ ID NO: 5918 | mm60605_Plxnb1 | GCTTCCCGGGCCACACAACG |
| SEQ ID NO: 5919 | mm60606_Plxnb1 | CTTGCTGATACCGGTCCATG |
| SEQ ID NO: 5920 | mm60607_Plxnb1 | GGACGTGAGATATGGGTCCG |
| SEQ ID NO: 5921 | mm60612_Soap | CTGTTGGATGTACGCCACGG |
| SEQ ID NO: 5922 | mm60613_Soap | ATGATGTAGGTGGTCACGAG |
| SEQ ID NO: 5923 | mm60614_Soap | CCTTAGGTCCGGACTCCCAG |
| SEQ ID NO: 5924 | mm60615_Soap | GCGTAGCCGTAGTCATCGCA |
| SEQ ID NO: 5925 | mm60640_Rtp3 | GTACCTCCCTTACCTAGCAA |
| SEQ ID NO: 5926 | mm60641_Rtp3 | TAGGGAACACCAGTCTCGAA |
| SEQ ID NO: 5927 | mm60642_Rtp3 | TTGAGGTACAGCTAATCTTG |
| SEQ ID NO: 5928 | mm60643_Rtp3 | ATGAGGGTCCATTTGTGCCA |
| SEQ ID NO: 5929 | mm60744_Slc9a7 | TACTTACGAGGATAGTACAA |
| SEQ ID NO: 5930 | mm60745_Slc9a7 | CATGAAGGAAACGCACCCGG |
| SEQ ID NO: 5931 | mm60746_Slc9a7 | CAGAAATCTTATGTATGGAG |
| SEQ ID NO: 5932 | mm60747_Slc9a7 | CCCTGGCAAGATCAACAACG |
| SEQ ID NO: 5933 | mm60848_Adgrg2 | GGCTTGCTGGAAGACGATAA |
| SEQ ID NO: 5934 | mm60849_Adgrg2 | GGATGTTCGAGATAGGTCCT |
| SEQ ID NO: 5935 | mm60850_Adgrg2 | GTCTTGGGCTGCAAAAGTCG |

TABLE 1-continued mmSurf sgRNA library sequences

| SEQ ID NO | id_gRNA Target | Sequence |
|---|---|---|
| SEQ ID NO: 5936 | mm60851_Adgrg2 | CAGTTCTGTAGGGACAGATG |
| SEQ ID NO: 5937 | mm60872_Lrp11 | CGGTACGGCGGTCTACCGGG |
| SEQ ID NO: 5938 | mm60873_Lrp11 | CAGTTGAACAGGTAGCAGCG |
| SEQ ID NO: 5939 | mm60874_Lrp11 | TTACACCCTCAGTCGCGCCG |
| SEQ ID NO: 5940 | mm60875_Lrp11 | CTGAAGCAGCCTATCCACTC |
| SEQ ID NO: 5941 | mm60928_Lingo3 | CAGGTGACCCAGCGACTCCG |
| SEQ ID NO: 5942 | mm60929_Lingo3 | GTGTGATGGACAACGACGTG |
| SEQ ID NO: 5943 | mm60930_Lingo3 | GATTGCCCACGTGGAACCTG |
| SEQ ID NO: 5944 | mm60931_Lingo3 | CCCATCAGCATGGTGCCACG |
| SEQ ID NO: 5945 | mm61016_Col23a1 | CCTGGAGCGCCTGTTACGGG |
| SEQ ID NO: 5946 | mm61017_Col23a1 | TGGTAATCGACTATGACGGC |
| SEQ ID NO: 5947 | mm61018_Col23a1 | GGGACTTCCAGGCCCCAAAG |
| SEQ ID NO: 5948 | mm61019_Col23a1 | GCCATCCATCATCCCCCTG |
| SEQ ID NO: 5949 | mm61048_Rtn4rl1 | CCTTCGCAGCCATTCCCACA |
| SEQ ID NO: 5950 | mm61049_Rtn4rl1 | GGGTAGCACACACAGTCTCG |
| SEQ ID NO: 5951 | mm61050_Rtn4rl1 | GCCCTCTACCTCTATAAGTG |
| SEQ ID NO: 5952 | mm61051_Rtn4rl1 | GCATGAGAACCAGCTACAGT |
| SEQ ID NO: 5953 | mm61120_Sdk2 | CCGCTGGAGCGAGATCCCGG |
| SEQ ID NO: 5954 | mm61121_Sdk2 | TGCGCACACACGAGGACGGT |
| SEQ ID NO: 5955 | mm61122_Sdk2 | GGGGCCTCTGGTGATATTAG |
| SEQ ID NO: 5956 | mm61123_Sdk2 | ATGGACCAATTACGAGATCG |
| SEQ ID NO: 5957 | mm61188_Tmem30b | GCTCGTAGTAGAGGTACACG |
| SEQ ID NO: 5958 | mm61189_Tmem30b | CGAGCGGCACCTCGACGAAG |
| SEQ ID NO: 5959 | mm61190_Tmem30b | GAGCTGGAGTACGACTACAC |
| SEQ ID NO: 5960 | mm61191_Tmem30b | CGATAGGCAGACCGTCGGAG |
| SEQ ID NO: 5961 | mm61196_Kcnh5 | ACTCGTATTGTAGCGATATG |
| SEQ ID NO: 5962 | mm61197_Kcnh5 | ATAGAGGATGACTCAACGAA |
| SEQ ID NO: 5963 | mm61198_Kcnh5 | ATACATTTGCTGGAAAATTG |
| SEQ ID NO: 5964 | mm61199_Kcnh5 | ATTGGCACACGCATGAGCAA |
| SEQ ID NO: 5965 | mm61232_Slc24a4 | TCTCATCCACCATAACCACG |
| SEQ ID NO: 5966 | mm61233_Slc24a4 | ACCCACGGAGATGTCGGTGT |
| SEQ ID NO: 5967 | mm61234_Slc24a4 | TCTGTGCAGTTCTTAGCCAG |
| SEQ ID NO: 5968 | mm61235_Slc24a4 | AAACGGGAGACATGAGAACA |
| SEQ ID NO: 5969 | mm61252_Adam6a | TCTCATGACTGTGTATACCG |
| SEQ ID NO: 5970 | mm61253_Adam6a | TAGGCCTAAAACATGATGAG |
| SEQ ID NO: 5971 | mm61254_Adam6a | TCTGTATATAGTGCTTCTGG |
| SEQ ID NO: 5972 | mm61255_Adam6a | ATGCTGTTAATCCAGCTGAG |
| SEQ ID NO: 5973 | mm61268_Btn2a2 | GGCAACCATGAAGCTTATGG |

TABLE 1-continued mmSurf sgRNA library sequences

| SEQ ID NO | id_gRNA Target | Sequence |
|---|---|---|
| SEQ ID NO: 5974 | mm61269_Btn2a2 | GAGCAGATGGTGGCATACCG |
| SEQ ID NO: 5975 | mm61270_Btn2a2 | TGGTCCTATGACAGTAAACT |
| SEQ ID NO: 5976 | mm61271_Btn2a2 | CAGGTACAACTTCATCATAG |
| SEQ ID NO: 5977 | mm61336_Pde4d | TCACATCTGCAGACTCAAGT |
| SEQ ID NO: 5978 | mm61337_Pde4d | CTGCTATTCGGAAAACGTGG |
| SEQ ID NO: 5979 | mm61338_Pde4d | ATGGATGGTTGGTTGCACAT |
| SEQ ID NO: 5980 | mm61339_Pde4d | GGTCATAGTCGCTGTCAGAT |
| SEQ ID NO: 5981 | mm61440_Slitrk6 | TTTGTATCTTGAGTACAATG |
| SEQ ID NO: 5982 | mm61441_Slitrk6 | CCAATTGGAGGACAATAAGT |
| SEQ ID NO: 5983 | mm61442_Slitrk6 | CTTAAGTGGAAAGGTCGTGA |
| SEQ ID NO: 5984 | mm61443_Slitrk6 | ATGTATTCTTGCTTGATAGG |
| SEQ ID NO: 5985 | mm61480_Rspo2 | AGAACAACTTCTGTTGACAT |
| SEQ ID NO: 5986 | mm61481_Rspo2 | GGTGTCCATAATACCCTGAT |
| SEQ ID NO: 5987 | mm61482_Rspo2 | CATTCCATAGTCTCATCTAA |
| SEQ ID NO: 5988 | mm61483_Rspo2 | GTTGGTCATTGGAGCGAATG |
| SEQ ID NO: 5989 | mm61552_Slc2a13 | CATGGCCCCGACACCACGC |
| SEQ ID NO: 5990 | mm61553_Slc2a13 | CCTCGGTGGCTGATTCAGAA |
| SEQ ID NO: 5991 | mm61554_Slc2a13 | CACATCCCACAACTAACGCT |
| SEQ ID NO: 5992 | mm61555_Slc2a13 | AAGGATAATCAGTGCTACTG |
| SEQ ID NO: 5993 | mm61608_Rtp1 | TGGAAGAGGATGACTACATG |
| SEQ ID NO: 5994 | mm61609_Rtp1 | GCTACGAGTGCGGTACAGCA |
| SEQ ID NO: 5995 | mm61610_Rtp1 | ATGTGTAAGAGTGTGACCAC |
| SEQ ID NO: 5996 | mm61611_Rtp1 | CTACACTTTATAGAGAACGT |
| SEQ ID NO: 5997 | mm61640_Cd200r4 | TAAATGCAGTATTAATCACA |
| SEQ ID NO: 5998 | mm61641_Cd200r4 | TGAACTTCAGATCAGTGCAG |
| SEQ ID NO: 5999 | mm61642_Cd200r4 | AGTTCATCTTCTCTGACACA |
| SEQ ID NO: 6000 | mm61643_Cd200r4 | CTGAGGTAACCTACTTTCCA |
| SEQ ID NO: 6001 | mm61652_Cadm2 | GACGAAAATCCACTAATCTG |
| SEQ ID NO: 6002 | mm61653_Cadm2 | CCGCCACTCCATCATCGCTA |
| SEQ ID NO: 6003 | mm61654_Cadm2 | TCCACTAACTCAGAATGTCA |
| SEQ ID NO: 6004 | mm61655_Cadm2 | ATGATAACACCTCCCTCCAG |
| SEQ ID NO: 6005 | mm61680_Lnpep | ATATTGGAATATGCCAAAGG |
| SEQ ID NO: 6006 | mm61681_Lnpep | TCCTGTTAGAAGAGGTTCCG |
| SEQ ID NO: 6007 | mm61682_Lnpep | TGTGAAAATGAGCACATACC |
| SEQ ID NO: 6008 | mm61683_Lnpep | TGCAGTGGTGGAATGACCTG |
| SEQ ID NO: 6009 | mm61696_Mmp25 | AGAAACGCACCCTGACATGG |
| SEQ ID NO: 6010 | mm61697_Mmp25 | ATCAGGCCTTACATTCCAGG |
| SEQ ID NO: 6011 | mm61698_Mmp25 | CGTTCAGCTTGGACGGACCG |

TABLE 1-continued mmSurf sgRNA library sequences

| SEQ ID NO | id_gRNA Target | Sequence |
|---|---|---|
| SEQ ID NO: 6012 | mm61699_Mmp25 | CTGAGACTGGACAAATGGGT |
| SEQ ID NO: 6013 | mm61920_Sulf1 | CAGTTGACGACTCTGTCGAG |
| SEQ ID NO: 6014 | mm61921_Sulf1 | AGAAATACGTACATCGACCC |
| SEQ ID NO: 6015 | mm61922_Sulf1 | GCACGCAACCTCTACTCTCG |
| SEQ ID NO: 6016 | mm61923_Sulf1 | CTGGCGTGATACATTCCTAG |
| SEQ ID NO: 6017 | mm61956_Tor1aip2 | AGTGCCCTAGTTCTAAACTA |
| SEQ ID NO: 6018 | mm61957_Tor1aip2 | TAATACGGTCTAAGAACACT |
| SEQ ID NO: 6019 | mm61958_Tor1aip2 | TTCTATTAGCAGGATTGTCA |
| SEQ ID NO: 6020 | mm61959_Tor1aip2 | ATTCACACTGCCCTGATTGT |
| SEQ ID NO: 6021 | mm61968_Tnfsf18 | GTGTGAATACGACATCTGAT |
| SEQ ID NO: 6022 | mm61969_Tnfsf18 | ATATATCTGTACTACGAAGG |
| SEQ ID NO: 6023 | mm61970_Tnfsf18 | CTACGGCCAAGTGATTCCTG |
| SEQ ID NO: 6024 | mm61971_Tnfsf18 | CTCACCAAACTTAACCATGC |
| SEQ ID NO: 6025 | mm62004_Pgap1 | ATAGACAACAATATGCGACA |
| SEQ ID NO: 6026 | mm62005_Pgap1 | ATATGTAACTTACCACACGA |
| SEQ ID NO: 6027 | mm62006_Pgap1 | AGAATTTGCTCCTACAAGTG |
| SEQ ID NO: 6028 | mm62007_Pgap1 | GTCGTCAGACTGTCAGTATG |
| SEQ ID NO: 6029 | mm62068_Itga8 | CAGCCGGATATCGTAGAAGG |
| SEQ ID NO: 6030 | mm62069_Itga8 | TTTGCAGGCAAGGATCAACG |
| SEQ ID NO: 6031 | mm62070_Itga8 | ATATACTTACTGTTTCGACA |
| SEQ ID NO: 6032 | mm62071_Itga8 | AATTCTCGCTCCATAAAGAG |
| SEQ ID NO: 6033 | mm62076_Gpr158 | GGCACAAAAACTAGCCGAGG |
| SEQ ID NO: 6034 | mm62077_Gpr158 | TTGTTCACTGAGAAGACACG |
| SEQ ID NO: 6035 | mm62078_Gpr158 | CTGCTGTCATGTAATCCCAG |
| SEQ ID NO: 6036 | mm62079_Gpr158 | GATGCGACTCTCCTCGCGGG |
| SEQ ID NO: 6037 | mm62092_Lrrc8a | TCGACACCAGTACAACTACG |
| SEQ ID NO: 6038 | mm62093_Lrrc8a | CTCGTTCGAGTCGATCCGAG |
| SEQ ID NO: 6039 | mm62094_Lrrc8a | ACGGATTGAGCAGGGCATCG |
| SEQ ID NO: 6040 | mm62095_Lrrc8a | GATGTTGTGCACATAGTAGA |
| SEQ ID NO: 6041 | mm62112_Crb2 | GACTGCCCGAGACCTTACCG |
| SEQ ID NO: 6042 | mm62113_Crb2 | AAGGCCCATAGGTCCCCGGT |
| SEQ ID NO: 6043 | mm62114_Crb2 | TCTGACCCGACCTTGTACGG |
| SEQ ID NO: 6044 | mm62115_Crb2 | ACTCTCGAGACATGGCACTG |
| SEQ ID NO: 6045 | mm62168_Tspan18 | GAGCTTACCAAGCACTACCA |
| SEQ ID NO: 6046 | mm62169_Tspan18 | CGTCAGCAGCCGAAACACGG |
| SEQ ID NO: 6047 | mm62170_Tspan18 | GATCATGACTGAATTCCAGG |
| SEQ ID NO: 6048 | mm62171_Tspan18 | TGGCTGCTGAGAGCTCTACC |
| SEQ ID NO: 6049 | mm62280_Frem2 | AATTTCCTACTGGAATAGCG |

TABLE 1-continued mmSurf sgRNA library sequences

| SEQ ID NO | id_gRNA Target | Sequence |
|---|---|---|
| SEQ ID NO: 6050 | mm62281_Frem2 | TTGGAGTGCACGGATCGAAG |
| SEQ ID NO: 6051 | mm62282_Frem2 | GGTCGAGCTGCATTCGCGAG |
| SEQ ID NO: 6052 | mm62283_Frem2 | TGGGAGAACCCAGAATAACA |
| SEQ ID NO: 6053 | mm62288_Igsf10 | ATAGAGACTTAACACATCGA |
| SEQ ID NO: 6054 | mm62289_Igsf10 | TCAGGACGTGAAATATCCCG |
| SEQ ID NO: 6055 | mm62290_Igsf10 | ACAGGTTCGGCACATCCCAG |
| SEQ ID NO: 6056 | mm62291_Igsf10 | GTTGTGATCCAGGTGCAACC |
| SEQ ID NO: 6057 | mm62292_Ppm1l | GTCCCGGCTAGACTTAACGA |
| SEQ ID NO: 6058 | mm62293_Ppm1l | TCCCCGAGAGTCACCAACGT |
| SEQ ID NO: 6059 | mm62294_Ppm1l | CTTCGAAGCGATCTTCCATG |
| SEQ ID NO: 6060 | mm62295_Ppm1l | GCAGATCTTGTCAATTGACC |
| SEQ ID NO: 6061 | mm62308_Vtcn1 | AAAGCCAATGATGAGTGCGA |
| SEQ ID NO: 6062 | mm62309_Vtcn1 | GGTGCGGATGTAACATGTGT |
| SEQ ID NO: 6063 | mm62310_Vtcn1 | AACCTTGAGTATAAGACCGG |
| SEQ ID NO: 6064 | mm62311_Vtcn1 | TCAACGGCATCGTCATCCAG |
| SEQ ID NO: 6065 | mm62324_Pde5a | AACCCTCTGATCCTTTAACG |
| SEQ ID NO: 6066 | mm62325_Pde5a | TCAACTTCTGCATTGAACCG |
| SEQ ID NO: 6067 | mm62326_Pde5a | TCATCACTATCAAATCTTGG |
| SEQ ID NO: 6068 | mm62327_Pde5a | TGGCAAGGTCAAGTAACACC |
| SEQ ID NO: 6069 | mm62356_Impad1 | ATTCCTGTGTAGCATCAAGT |
| SEQ ID NO: 6070 | mm62357_Impad1 | TCCTTCACGAGAAGTCCAAG |
| SEQ ID NO: 6071 | mm62358_Impad1 | CTCCCACTAGATAAATACTG |
| SEQ ID NO: 6072 | mm62359_Impad1 | GCTTGGGCAATGGTAGATGG |
| SEQ ID NO: 6073 | mm62392_Tmem8b | GAATCCATAGGTGAGCGCGT |
| SEQ ID NO: 6074 | mm62393_Tmem8b | CAGCACGTATCGGCTCCGAA |
| SEQ ID NO: 6075 | mm62394_Tmem8b | ATTCGGATGCCTGACTCATG |
| SEQ ID NO: 6076 | mm62395_Tmem8b | GCCCAGCTGTATTTGCCCTG |
| SEQ ID NO: 6077 | mm62400_Gabbr2 | CCTGCGACTCTACGACACCG |
| SEQ ID NO: 6078 | mm62401_Gabbr2 | CATGGAAGGCTACATCGGAG |
| SEQ ID NO: 6079 | mm62402_Gabbr2 | GCTGACAGGATGCTATACAG |
| SEQ ID NO: 6080 | mm62403_Gabbr2 | CTTATCCGCAAGAACAGGCG |
| SEQ ID NO: 6081 | mm62696_Elfn1 | CTACATTGAAGTGCGCACGG |
| SEQ ID NO: 6082 | mm62697_Elfn1 | GTTTCCGAAGCGGCTCAGGG |
| SEQ ID NO: 6083 | mm62698_Elfn1 | CACCAACTACACATACTGCG |
| SEQ ID NO: 6084 | mm62699_Elfn1 | CCTACAGGCCAACCTCATCG |
| SEQ ID NO: 6085 | mm62700_Slc29a4 | GCTGTTGCACCGATACGTCG |
| SEQ ID NO: 6086 | mm62701_Slc29a4 | ACTGCCCAAGAGGTACACGC |
| SEQ ID NO: 6087 | mm62702_Slc29a4 | GTGGTGAAGATAGTCGACAT |

TABLE 1-continued mmSurf sgRNA library sequences

| SEQ ID NO | id_gRNA Target | Sequence |
|---|---|---|
| SEQ ID NO: 6088 | mm62703_Slc29a4 | TGTGCTCCTAAACAACGTTG |
| SEQ ID NO: 6089 | mm62704_Tmem130 | TCTAACCTCGACCATCCACG |
| SEQ ID NO: 6090 | mm62705_Tmem130 | TCAGCATCGTTGGATCTGCG |
| SEQ ID NO: 6091 | mm62706_Tmem130 | GTTGATAACTGACAACCCTG |
| SEQ ID NO: 6092 | mm62707_Tmem130 | GCTGACGGTCCTGCTACCGT |
| SEQ ID NO: 6093 | mm62788_Slc6a11 | CTCCCAGAACTCCATGACCG |
| SEQ ID NO: 6094 | mm62789_Slc6a11 | AGGCATTGGCTATGCAACAC |
| SEQ ID NO: 6095 | mm62790_Slc6a11 | GTTGTTGTAACTCCCCAGAG |
| SEQ ID NO: 6096 | mm62791_Slc6a11 | GGGTACTAAGTCGACTGGAA |
| SEQ ID NO: 6097 | mm62808_Klre1 | AGCCATCAGGAGAAGGCACA |
| SEQ ID NO: 6098 | mm62809_Klre1 | CAGACCCAGTTCTCTGGACA |
| SEQ ID NO: 6099 | mm62810_Klre1 | AATTGTCATCCATTGAGCAG |
| SEQ ID NO: 6100 | mm62811_Klre1 | CTCACACTTTGTGGTAAAAG |
| SEQ ID NO: 6101 | mm62820_Plxna4 | GAAGGAACATTATCTCTCGG |
| SEQ ID NO: 6102 | mm62821_Plxna4 | GCCACACTCGAAATCCGGGT |
| SEQ ID NO: 6103 | mm62822_Plxna4 | ACATGATGTAGAGTTGCTCG |
| SEQ ID NO: 6104 | mm62823_Plxna4 | CATTGGCTGTGAGCGCAATG |
| SEQ ID NO: 6105 | mm62844_Gp6 | CGATATAAATCCACATCTGG |
| SEQ ID NO: 6106 | mm62845_Gp6 | TGATGATGGGGAAATTGGCC |
| SEQ ID NO: 6107 | mm62846_Gp6 | CCAGTAACCACAAGCACTAG |
| SEQ ID NO: 6108 | mm62847_Gp6 | TTAGCTCAAGCTGGTCACTT |
| SEQ ID NO: 6109 | mm62872_Fkrp | GCTGGACTTGACCTTCGCCG |
| SEQ ID NO: 6110 | mm62873_Fkrp | CCAATGGCAGAAGTCCGGCG |
| SEQ ID NO: 6111 | mm62874_Fkrp | CCATCCAAAGCGTCGCAGCG |
| SEQ ID NO: 6112 | mm62875_Fkrp | CACAAACTCGGTGGCTACGT |
| SEQ ID NO: 6113 | mm62880_Mill2 | AGGAAGCGAGGTATCTCTGG |
| SEQ ID NO: 6114 | mm62881_Mill2 | TGTCAGAGCCCATTCTCTGG |
| SEQ ID NO: 6115 | mm62882_Mill2 | CCCTTAATCCAGCATCCCAA |
| SEQ ID NO: 6116 | mm62883_Mill2 | CTGCTCCTTAGAGACTCACG |
| SEQ ID NO: 6117 | mm62980_Rgma | ACCATCGTGGTGCGACAGGT |
| SEQ ID NO: 6118 | mm62981_Rgma | ACAGAACTCCGGCACGTCGT |
| SEQ ID NO: 6119 | mm62982_Rgma | GAGGGTCGGCCACAATCCCA |
| SEQ ID NO: 6120 | mm62983_Rgma | AGGTAATTATTGTCGATGAG |
| SEQ ID NO: 6121 | mm63056_5830411N06Rik | TCAGGTGTCAAAACATACCG |
| SEQ ID NO: 6122 | mm63057_5830411N06Rik | CCTTCAATCTTACACCCAGG |
| SEQ ID NO: 6123 | mm63058_5830411N06Rik | GCCATAAGACCATTCCTGTG |
| SEQ ID NO: 6124 | mm63059_5830411N06Rik | GTGGTACCACACTACAAATG |
| SEQ ID NO: 6125 | mm63060_Tnfrsf26 | ACTCTGAAAACTGTTTGGAG |

TABLE 1-continued mmSurf sgRNA library sequences

| SEQ ID NO | id_gRNA Target | Sequence |
| --- | --- | --- |
| SEQ ID NO: 6126 | mm63061_Tnfrsf26 | GAACTCACCAATCTTACACA |
| SEQ ID NO: 6127 | mm63062_Tnfrsf26 | AGTAGGTGCCCTGCTTACAC |
| SEQ ID NO: 6128 | mm63063_Tnfrsf26 | TCTCCTGGCATGGATTCCGG |
| SEQ ID NO: 6129 | mm63164_Pkd1l3 | GCGACTTCTTCATCGTGCCG |
| SEQ ID NO: 6130 | mm63165_Pkd1l3 | AAGTGGAGCGTCATTAGGAG |
| SEQ ID NO: 6131 | mm63166_Pkd1l3 | GCTGACGAGCAGCTCCGACA |
| SEQ ID NO: 6132 | mm63167_Pkd1l3 | GTTGTTGTTAGACGTCCAAG |
| SEQ ID NO: 6133 | mm63188_Sipa1l2 | TTCAGAACGGTTATCCACGG |
| SEQ ID NO: 6134 | mm63189_Sipa1l2 | CATCAGTGATATCGATACGG |
| SEQ ID NO: 6135 | mm63190_Sipa1l2 | AGTTATCATCCAGCCCCACG |
| SEQ ID NO: 6136 | mm63191_Sipa1l2 | GTCGCAGTTCAACTACAGGG |
| SEQ ID NO: 6137 | mm63220_Olfm2 | GAGAGCCATTGTATACCACA |
| SEQ ID NO: 6138 | mm63221_Olfm2 | GGACTTGCAACAGCGCGTGA |
| SEQ ID NO: 6139 | mm63222_Olfm2 | CAGTAACCCTATTACCATCC |
| SEQ ID NO: 6140 | mm63223_Olfm2 | GCAGCTTTATACGTCAGCCC |
| SEQ ID NO: 6141 | mm63308_Col6a6 | TGCGTCATGAGATTCCCCGT |
| SEQ ID NO: 6142 | mm63309_Col6a6 | ATGGGCAGCAGGATCAACGC |
| SEQ ID NO: 6143 | mm63310_Col6a6 | TGAGGCTCAGGACATAGTAA |
| SEQ ID NO: 6144 | mm63311_Col6a6 | ATGGGTGGGAATACCAACAC |
| SEQ ID NO: 6145 | mm63388_Slitrk4 | AAGCAAGAACTATGCCCCAT |
| SEQ ID NO: 6146 | mm63389_Slitrk4 | AGATGATAGAAATTAGACCA |
| SEQ ID NO: 6147 | mm63390_Slitrk4 | CTTTAATGCTACCAAGTCGC |
| SEQ ID NO: 6148 | mm63391_Slitrk4 | TTAATCAAGTATATTGAACG |
| SEQ ID NO: 6149 | mm63392_Slitrk2 | CTGACTCACTTAGACCTGAG |
| SEQ ID NO: 6150 | mm63393_Slitrk2 | CAAACTGGAGGTATTGCGAG |
| SEQ ID NO: 6151 | mm63394_Slitrk2 | GAGGTTAATCAAAGCATCAA |
| SEQ ID NO: 6152 | mm63395_Slitrk2 | CTGATAGATGCGATACTGGG |
| SEQ ID NO: 6153 | mm63404_Dkc1 | TTTACTGCAGCAATAAGTGG |
| SEQ ID NO: 6154 | mm63405_Dkc1 | TCTCTACCCGAAGTATTCGT |
| SEQ ID NO: 6155 | mm63406_Dkc1 | TACGCATAGTGTCCGAATGT |
| SEQ ID NO: 6156 | mm63407_Dkc1 | ATGATGTACTCGATGCTCAG |
| SEQ ID NO: 6157 | mm63428_Eda2r | CTACCGAAAGACACGCATTG |
| SEQ ID NO: 6158 | mm63429_Eda2r | CCCTGGACAGGAGCTCTCGA |
| SEQ ID NO: 6159 | mm63430_Eda2r | ACAAGTGTGGCTTCCCTAGG |
| SEQ ID NO: 6160 | mm63431_Eda2r | ACACACTGAACCTCGGAAGA |
| SEQ ID NO: 6161 | mm63556_Atg9a | AGATAAACTTGATAAGCCGG |
| SEQ ID NO: 6162 | mm63557_Atg9a | CTCGGCTTGCTGGTACACTG |
| SEQ ID NO: 6163 | mm63558_Atg9a | CTTCATCCCAGACCAGCACA |

TABLE 1-continued mmSurf sgRNA library sequences

| SEQ ID NO | id_gRNA Target | Sequence |
|---|---|---|
| SEQ ID NO: 6164 | mm63559_Atg9a | AGGCCGAGTACAAACGTGGA |
| SEQ ID NO: 6165 | mm63620_Defb15 | AGAAATGCAGCAGGGTTAAT |
| SEQ ID NO: 6166 | mm63621_Defb15 | GTTCTCTTCTTTCTGGACCC |
| SEQ ID NO: 6167 | mm63622_Defb15 | CACAGCACTTCAGATTCTTC |
| SEQ ID NO: 6168 | mm63623_Defb15 | GAGAAATGCAGCAGGGTTAA |
| SEQ ID NO: 6169 | mm63624_Defb13 | CTTCTCATTCAACTTTACCC |
| SEQ ID NO: 6170 | mm63625_Defb13 | TAAAGCACTCAGCTTCACAT |
| SEQ ID NO: 6171 | mm63626_Defb13 | CCTGGGGCACATTGTACAGA |
| SEQ ID NO: 6172 | mm63627_Defb13 | TTCCTCTGTAAAAAGATGAA |
| SEQ ID NO: 6173 | mm63628_Defb35 | CAAAAAACAAAAAACGTCTG |
| SEQ ID NO: 6174 | mm63629_Defb35 | GCAGCTCTTTCCTGGCACAG |
| SEQ ID NO: 6175 | mm63630_Defb35 | TTGCTGTGTGCGAGACATGC |
| SEQ ID NO: 6176 | mm63631_Defb35 | GAGACATGCAGGCTCGGCCG |
| SEQ ID NO: 6177 | mm63652_Kcne2 | TGAGCACGGTGAAGTCGAAG |
| SEQ ID NO: 6178 | mm63653_Kcne2 | CGGCATGTTCTCGTTCATCG |
| SEQ ID NO: 6179 | mm63654_Kcne2 | ACATGCCGATCATCACCATG |
| SEQ ID NO: 6180 | mm63655_Kcne2 | TTATTACTTATATGGACAGC |
| SEQ ID NO: 6181 | mm63656_Vasn | TGGGGCAGTCGATAGTACGG |
| SEQ ID NO: 6182 | mm63657_Vasn | AGACCTTATAGTAGGTACTG |
| SEQ ID NO: 6183 | mm63658_Vasn | TATTGCCCAGATACGGCCCG |
| SEQ ID NO: 6184 | mm63659_Vasn | ACATGGTTCTCACGCACCCA |
| SEQ ID NO: 6185 | mm63668_Otoa | TGCTACTTCAGGCATCGCGG |
| SEQ ID NO: 6186 | mm63669_Otoa | GAAGGCATTTCATGGCGGTG |
| SEQ ID NO: 6187 | mm63670_Otoa | GAGCTGAAGTCTGGTCATAG |
| SEQ ID NO: 6188 | mm63671_Otoa | GCTGTTCCAGCTTTGACGTG |
| SEQ ID NO: 6189 | mm63692_Fcgr4 | ACTTGATAGAATTGTCCTCG |
| SEQ ID NO: 6190 | mm63693_Fcgr4 | TATGGACCTCTAGTTGCACT |
| SEQ ID NO: 6191 | mm63694_Fcgr4 | GCAAAACAGACCTGTACGGA |
| SEQ ID NO: 6192 | mm63695_Fcgr4 | GGTGAACCTAGACCCCAAGT |
| SEQ ID NO: 6193 | mm63732_Defb19 | TGGGTAACAGAGGATTCTGT |
| SEQ ID NO: 6194 | mm63733_Defb19 | GCAACGGAACTGGTCGTGTC |
| SEQ ID NO: 6195 | mm63734_Defb19 | TTACCCATGCATTGAAGGAT |
| SEQ ID NO: 6196 | mm63735_Defb19 | CAGTTCCGTTGCCACAAGTA |
| SEQ ID NO: 6197 | mm63740_Emilin2 | CTCCCCGACTTACACCAGGG |
| SEQ ID NO: 6198 | mm63741_Emilin2 | TGAATCACTCCGAATGTACG |
| SEQ ID NO: 6199 | mm63742_Emilin2 | CGGAGTGATAGAGCTGATCG |
| SEQ ID NO: 6200 | mm63743_Emilin2 | GCTGGATCTCCAGTCCACCG |
| SEQ ID NO: 6201 | mm63876_Cables2 | GGGTATATACCTCTGCACCG |

TABLE 1-continued mmSurf sgRNA library sequences

| SEQ ID NO | id_gRNA Target | Sequence |
|---|---|---|
| SEQ ID NO: 6202 | mm63877_Cables2 | TCTGCCTACAGGAAGCGACG |
| SEQ ID NO: 6203 | mm63878_Cables2 | GTATAACCAGAGCATTAGTA |
| SEQ ID NO: 6204 | mm63879_Cables2 | AAGCAGAGGCACCCATCCGG |
| SEQ ID NO: 6205 | mm63884_Tpcn1 | AGAAACACGAGGTAACTCCA |
| SEQ ID NO: 6206 | mm63885_Tpcn1 | CCTCGATGAACTGCACCACG |
| SEQ ID NO: 6207 | mm63886_Tpcn1 | CAAGCCCCGGATGAGTGCAA |
| SEQ ID NO: 6208 | mm63887_Tpcn1 | CTGGGAGATGAATTATCAAG |
| SEQ ID NO: 6209 | mm63896_Nod2 | CCGACCCATCGTAAGTACTG |
| SEQ ID NO: 6210 | mm63897_Nod2 | AGATGCCGACACCATACTGG |
| SEQ ID NO: 6211 | mm63898_Nod2 | GCAGAGTCTGGACTGACGTG |
| SEQ ID NO: 6212 | mm63899_Nod2 | GTTGTAGAGTCTCCTCACAA |
| SEQ ID NO: 6213 | mm67724_Cadm4 | GTGGATCGCAAGGACGACGG |
| SEQ ID NO: 6214 | mm67725_Cadm4 | GAGCGTGGCGATCTGATGGT |
| SEQ ID NO: 6215 | mm67726_Cadm4 | TCGTCATTCAGAACCCAGCC |
| SEQ ID NO: 6216 | mm67727_Cadm4 | ACAGACCGAGAATGTGACTG |
| SEQ ID NO: 6217 | mm67784_Ly6g5b | GCTGTCCACAGCCCCGTACG |
| SEQ ID NO: 6218 | mm67785_Ly6g5b | CAGAAATGCAGCCTAGCGAA |
| SEQ ID NO: 6219 | mm67786_Ly6g5b | TAGATGGTGATCACCATACA |
| SEQ ID NO: 6220 | mm67787_Ly6g5b | AGCACCAGAGCACCCTGCGT |
| SEQ ID NO: 6221 | mm67788_Defb36 | CTCGTGTCCCAGCTCACTCC |
| SEQ ID NO: 6222 | mm67789_Defb36 | GAGTGAGCTGGGACACGAGC |
| SEQ ID NO: 6223 | mm67790_Defb36 | CAGAAATGCTGGAATCTCCA |
| SEQ ID NO: 6224 | mm67791_Defb36 | CCGCCACCGATGCTCCAGGA |
| SEQ ID NO: 6225 | mm67816_Mill1 | GGGTGACAACCAAAGACTGG |
| SEQ ID NO: 6226 | mm67817_Mill1 | GACCTTCAGGAACTATCCAG |
| SEQ ID NO: 6227 | mm67818_Mill1 | CTCATCATCGAAGTATCTCA |
| SEQ ID NO: 6228 | mm67819_Mill1 | GAAGACTCTCACATGGACAG |
| SEQ ID NO: 6229 | mm67820_Rps15a | CTCACCGTGCTTCATCATCA |
| SEQ ID NO: 6230 | mm67821_Rps15a | CCTCACAGGAAGGTTGAACA |
| SEQ ID NO: 6231 | mm67822_Rps15a | CTTTAGAACATGGCCTGATG |
| SEQ ID NO: 6232 | mm67823_Rps15a | ATCAACAACGCTGAGAAGAG |
| SEQ ID NO: 6233 | mm67896_Rab11fip4 | CCACGCGTAGAAAGCCGTCG |
| SEQ ID NO: 6234 | mm67897_Rab11fip4 | CGCCTCTCTTATCAGCAACG |
| SEQ ID NO: 6235 | mm67898_Rab11fip4 | GGCATGTCGCATCTTCCTTG |
| SEQ ID NO: 6236 | mm67899_Rab11fip4 | GAACGACAGCCTGACGAGCG |
| SEQ ID NO: 6237 | mm67932_Mgat5b | GGAGCCAGCGTACAACCACG |
| SEQ ID NO: 6238 | mm67933_Mgat5b | TCTCATAGTACACGGTACCG |
| SEQ ID NO: 6239 | mm67934_Mgat5b | GGCAGCCTTGGTCCACTGTG |

TABLE 1-continued mmSurf sgRNA library sequences

| SEQ ID NO | id_gRNA Target | Sequence |
|---|---|---|
| SEQ ID NO: 6240 | mm67935_Mgat5b | TGGCCTGGATCCTTTCAATG |
| SEQ ID NO: 6241 | mm67960_Serpina5 | AAGGCTAAAGAGTCCTCGGT |
| SEQ ID NO: 6242 | mm67961_Serpina5 | ATTTACCACTATCATGACAT |
| SEQ ID NO: 6243 | mm67962_Serpina5 | GACCCCAAAAGGACCACAC |
| SEQ ID NO: 6244 | mm67963_Serpina5 | AACTCATAGACACGCTCAAG |
| SEQ ID NO: 6245 | mm67988_Slc38a9 | GAGACTTGACCATTGCCCAA |
| SEQ ID NO: 6246 | mm67989_Slc38a9 | TACTCACATAGTAACTAAGC |
| SEQ ID NO: 6247 | mm67990_Slc38a9 | TTCACATTGACAATGTTGGT |
| SEQ ID NO: 6248 | mm67991_Slc38a9 | TGTTCGCTTAGGATTCCATC |
| SEQ ID NO: 6249 | mm68028_Egflam | CGGTCACACAACGTCCCGGT |
| SEQ ID NO: 6250 | mm68029_Egflam | GTGTCAATGACTACGCCTGG |
| SEQ ID NO: 6251 | mm68030_Egflam | AGAGCAACAGGGACAAACCG |
| SEQ ID NO: 6252 | mm68031_Egflam | CACAGAGTAGGACTGAATTG |
| SEQ ID NO: 6253 | mm68100_Scube3 | CGAGTGCCGCTTAAACAACG |
| SEQ ID NO: 6254 | mm68101_Scube3 | CTGCAAGTCCGGCTACACGG |
| SEQ ID NO: 6255 | mm68102_Scube3 | TTGACGTGGCAGCCGCACCG |
| SEQ ID NO: 6256 | mm68103_Scube3 | GAATGTAGCATCAATAAGGG |
| SEQ ID NO: 6257 | mm68124_Ltbp1 | GGGTACCGGATGTCACGGAG |
| SEQ ID NO: 6258 | mm68125_Ltbp1 | CCACACTGGTCGCATCAAGG |
| SEQ ID NO: 6259 | mm68126_Ltbp1 | GGGCAGTGCAGAAATACCGA |
| SEQ ID NO: 6260 | mm68127_Ltbp1 | ATGAATAGTTGAAACCCCTG |
| SEQ ID NO: 6261 | mm68176_Dpp10 | TACAGTGCTCCAGTAAACCG |
| SEQ ID NO: 6262 | mm68177_Dpp10 | GAGAACATACTTTAAATCTG |
| SEQ ID NO: 6263 | mm68178_Dpp10 | AGAAACAAGACTGTCACTAG |
| SEQ ID NO: 6264 | mm68179_Dpp10 | TGGTAGATTCACAGAGTGTG |
| SEQ ID NO: 6265 | mm68184_Nfasc | CGAGCGGTACCGAACCAGTG |
| SEQ ID NO: 6266 | mm68185_Nfasc | GGAAAACCTAGACCCCGTCG |
| SEQ ID NO: 6267 | mm68186_Nfasc | TGCCACTCCGAAGATCGTCA |
| SEQ ID NO: 6268 | mm68187_Nfasc | TGATCCTTTATAACCGGACA |
| SEQ ID NO: 6269 | mm68236_Acvr1c | GACTAAGAGACACAACGTGG |
| SEQ ID NO: 6270 | mm68237_Acvr1c | TGAGAGATCTTGGTTCCGTG |
| SEQ ID NO: 6271 | mm68238_Acvr1c | CCTGAGCATTTAGTTCCGGG |
| SEQ ID NO: 6272 | mm68239_Acvr1c | CGTAGGAAAGGTCGGTTTG |
| SEQ ID NO: 6273 | mm68240_Rtn4rl2 | TGCAGAGCATAGGACAGCTG |
| SEQ ID NO: 6274 | mm68241_Rtn4rl2 | GAACTCGAGCGCCGGCAGGT |
| SEQ ID NO: 6275 | mm68242_Rtn4rl2 | CACCCAGGATGACTTGTTCG |
| SEQ ID NO: 6276 | mm68243_Rtn4rl2 | CTCACGGAGCACGTGTTCCG |
| SEQ ID NO: 6277 | mm68244_Muc15 | TCATTTCATTACCATTTGCG |

TABLE 1-continued mmSurf sgRNA library sequences

| SEQ ID NO | id_gRNA Target | Sequence |
|---|---|---|
| SEQ ID NO: 6278 | mm68245_Muc15 | GGGAGGAACAGAATATGTGG |
| SEQ ID NO: 6279 | mm68246_Muc15 | GAATGTTCGGAGACCTGTAA |
| SEQ ID NO: 6280 | mm68247_Muc15 | AAGGTTGTAGATAAATTCAA |
| SEQ ID NO: 6281 | mm68260_Slc28a2 | TCTTGAGCAAAGATACACAC |
| SEQ ID NO: 6282 | mm68261_Slc28a2 | TGGACAAGGCAAGTGCACAA |
| SEQ ID NO: 6283 | mm68262_Slc28a2 | AGAGAGTCCTACGAACACCC |
| SEQ ID NO: 6284 | mm68263_Slc28a2 | TGGTTCCTGCAAATTACCAT |
| SEQ ID NO: 6285 | mm68264_Slc4a11 | ATCCAAAAGCAATGGTCGGT |
| SEQ ID NO: 6286 | mm68265_Slc4a11 | AGCGGTTTAGCATAGTTCGG |
| SEQ ID NO: 6287 | mm68266_Slc4a11 | CTGCTGTCAGATACCATCCA |
| SEQ ID NO: 6288 | mm68267_Slc4a11 | GGCTGGCGTTGAGTGCAGTG |
| SEQ ID NO: 6289 | mm68300_Lrig2 | TTGCGCCATATGGTGGACAT |
| SEQ ID NO: 6290 | mm68301_Lrig2 | ACTGGAGAGATTGAATTTAG |
| SEQ ID NO: 6291 | mm68302_Lrig2 | ACAGATACTCAAGGGACTCA |
| SEQ ID NO: 6292 | mm68303_Lrig2 | AGCACATTCTAATCTTGCCA |
| SEQ ID NO: 6293 | mm68464_Megf8 | GATGTGTCCCTAGTCTACCG |
| SEQ ID NO: 6294 | mm68465_Megf8 | GAATTGCAACGCCCACACCG |
| SEQ ID NO: 6295 | mm68466_Megf8 | CACACCCTTACTGCCCGTCG |
| SEQ ID NO: 6296 | mm68467_Megf8 | TGTTCTAGGAAACTACATGG |
| SEQ ID NO: 6297 | mm68472_Chsy1 | GGTGTAAGGTGATCGCTCGG |
| SEQ ID NO: 6298 | mm68473_Chsy1 | GCGTGTGAACCCCATGTACG |
| SEQ ID NO: 6299 | mm68474_Chsy1 | AAGAGAAAGTTCCTGTCGCG |
| SEQ ID NO: 6300 | mm68475_Chsy1 | CAAGTACGAGTGGTTTATGA |
| SEQ ID NO: 6301 | mm68572_Fat3 | GTGACAATCAGACCTGACCG |
| SEQ ID NO: 6302 | mm68573_Fat3 | CAAAGTAACCGAGATTGTAG |
| SEQ ID NO: 6303 | mm68574_Fat3 | ACGAGACAATCATAATGGAG |
| SEQ ID NO: 6304 | mm68575_Fat3 | ACTTCTGGTGTATCAGATTG |
| SEQ ID NO: 6305 | mm68584_Amica1 | TATGACTCCAACATGCGTAG |
| SEQ ID NO: 6306 | mm68585_Amica1 | TACACTTGCAGCATCTACGT |
| SEQ ID NO: 6307 | mm68586_Amica1 | CCAACCTTAGCGTGCCTACG |
| SEQ ID NO: 6308 | mm68587_Amica1 | GTGGGTGAATCAGTCTTGAT |
| SEQ ID NO: 6309 | mm68600_Myo9a | TTTATCAAGAGCATAATGAA |
| SEQ ID NO: 6310 | mm68601_Myo9a | ACTATATAAAGACTTAGCCA |
| SEQ ID NO: 6311 | mm68602_Myo9a | CATGCTTAAAGCGATTCCGT |
| SEQ ID NO: 6312 | mm68603_Myo9a | CCGAAGCTGTCTTAGTACCA |
| SEQ ID NO: 6313 | mm68608_Ephb1 | GTGTTGTAGCCTGTCCTGCG |
| SEQ ID NO: 6314 | mm68609_Ephb1 | GATAGATGTCTCATTCACGA |
| SEQ ID NO: 6315 | mm68610_Ephb1 | CAGCACGTATCGATGGGCTA |

TABLE 1-continued mmSurf sgRNA library sequences

| SEQ ID NO | id_gRNA Target | Sequence |
| --- | --- | --- |
| SEQ ID NO: 6316 | mm68611_Ephb1 | TCATCCAATAAGGCTCCCCA |
| SEQ ID NO: 6317 | mm68700_Cd200r2 | ACAGACACTATGGTGTACAC |
| SEQ ID NO: 6318 | mm68701_Cd200r2 | TGAAGTAACCTACTTTCTCG |
| SEQ ID NO: 6319 | mm68702_Cd200r2 | TCCTGACCTTCAGATCAGTG |
| SEQ ID NO: 6320 | mm68703_Cd200r2 | TGTGAGATAACAACACCTGA |
| SEQ ID NO: 6321 | mm68776_Lppr1 | AAGTGATAGAAAAAGCTCGG |
| SEQ ID NO: 6322 | mm68777_Lppr1 | GTATTTCATAAAGTCAACAA |
| SEQ ID NO: 6323 | mm68778_Lppr1 | ACTTAATGAAGCCTTACCCG |
| SEQ ID NO: 6324 | mm68779_Lppr1 | TGATGATCCTTCGGAGTAAG |
| SEQ ID NO: 6325 | mm68796_Lrrc4b | CACAGGCACATCCATGACGT |
| SEQ ID NO: 6326 | mm68797_Lrrc4b | CACGGCCGACACGTTAAGCG |
| SEQ ID NO: 6327 | mm68798_Lrrc4b | CCTGGTGCGAAAGATCGAGG |
| SEQ ID NO: 6328 | mm68799_Lrrc4b | GAGGCTGGAGTACATATCTG |
| SEQ ID NO: 6329 | mm68856_Pigs | ACCATAATGCCACCCCAGCG |
| SEQ ID NO: 6330 | mm68857_Pigs | GGGCGACCTGGACTATGCGA |
| SEQ ID NO: 6331 | mm68858_Pigs | GATCTCTCGCTCATGCACAA |
| SEQ ID NO: 6332 | mm68859_Pigs | CTACCTAAGCTGGACTTGAG |
| SEQ ID NO: 6333 | mm69064_Tlr13 | AATATTCGGACTCTCAACCA |
| SEQ ID NO: 6334 | mm69065_Tlr13 | AGTAATTGGGAGCTTAGACA |
| SEQ ID NO: 6335 | mm69066_Tlr13 | AACTTTGTGAGGTTAATCAG |
| SEQ ID NO: 6336 | mm69067_Tlr13 | TCAATTTGGAAGATCGACGA |
| SEQ ID NO: 6337 | mm69068_Pcdh19 | GCTCGCTATTGACCGACAGG |
| SEQ ID NO: 6338 | mm69069_Pcdh19 | GAGCCGAGTTGGACACCACG |
| SEQ ID NO: 6339 | mm69070_Pcdh19 | TTGGCCTGGAAATAAAGACG |
| SEQ ID NO: 6340 | mm69071_Pcdh19 | GTTCTCATTAAAGGTACGAG |
| SEQ ID NO: 6341 | mm69332_Rpl17 | TTACCTTAAAGTGAACACGA |
| SEQ ID NO: 6342 | mm69333_Rpl17 | GAGAATCTACGTCTAAACCC |
| SEQ ID NO: 6343 | mm69334_Rpl17 | TGGAGTTGGTAGGTGCGCCC |
| SEQ ID NO: 6344 | mm69335_Rpl17 | AGCAATGTGTGCCATTCCGG |
| SEQ ID NO: 6345 | mm69424_Dpep2 | CAAGCACCCAATGACCCTTG |
| SEQ ID NO: 6346 | mm69425_Dpep2 | AGAAACTTCGAAGCACAGCG |
| SEQ ID NO: 6347 | mm69426_Dpep2 | TTACGTACCATGCCAGACGC |
| SEQ ID NO: 6348 | mm69427_Dpep2 | AGGAGTTCCCGCTTATAGAT |
| SEQ ID NO: 6349 | mm69456_Itga11 | CAACGTGACCAGATACGCTG |
| SEQ ID NO: 6350 | mm69457_Itga11 | CCAAAGTAGGAGCCTATCTG |
| SEQ ID NO: 6351 | mm69458_Itga11 | TTAAGGTAGGACTCTCGGTG |
| SEQ ID NO: 6352 | mm69459_Itga11 | TGGCGTTGATTTGAACTACA |
| SEQ ID NO: 6353 | mm69472_Nrcam | GGACGTATACTTGTGTCGCA |

TABLE 1-continued mmSurf sgRNA library sequences

| SEQ ID NO | id_gRNA Target | Sequence |
|---|---|---|
| SEQ ID NO: 6354 | mm69473_Nrcam | GCCGGAGGTAATCCAATCGG |
| SEQ ID NO: 6355 | mm69474_Nrcam | CATTAGTTTACCGTAAATGG |
| SEQ ID NO: 6356 | mm69475_Nrcam | GCTGATGTGAGAATCCGAGG |
| SEQ ID NO: 6357 | mm69516_Defb20 | GCAACGTAGAAGGCTACTGT |
| SEQ ID NO: 6358 | mm69517_Defb20 | TAGGAAGAAATGCAGATTAG |
| SEQ ID NO: 6359 | mm69518_Defb20 | TTAGTGGAGATATCTGAGAT |
| SEQ ID NO: 6360 | mm69519_Defb20 | GTGCCACAAACAGCAAAACA |
| SEQ ID NO: 6361 | mm69588_Podxl2 | GCTATAGTTCTGAACCCCCG |
| SEQ ID NO: 6362 | mm69589_Podxl2 | CTTACCTGAGTAGAGTCCCA |
| SEQ ID NO: 6363 | mm69590_Podxl2 | TCCTGCAGAGGCATATGCCA |
| SEQ ID NO: 6364 | mm69591_Podxl2 | TGGGACTGAGGTCCCCAGTG |
| SEQ ID NO: 6365 | mm69636_Smo | GAACTCCAATCGCTACCCTG |
| SEQ ID NO: 6366 | mm69637_Smo | TCAGAACCCGCTGTTCACCG |
| SEQ ID NO: 6367 | mm69638_Smo | CAAGTGTGAGAATGACCGAG |
| SEQ ID NO: 6368 | mm69639_Smo | GTAGATGGAGACTCCGTGAG |
| SEQ ID NO: 6369 | mm69676_Rc3h2 | GTTTCTCAGCTAATCCCACG |
| SEQ ID NO: 6370 | mm69677_Rc3h2 | AGAATTCATTCGATCTCGAG |
| SEQ ID NO: 6371 | mm69678_Rc3h2 | AGTGGCAAAAAATGCGTAG |
| SEQ ID NO: 6372 | mm69679_Rc3h2 | GCCGAGATTTACGACAACAA |
| SEQ ID NO: 6373 | mm69784_Casc4 | TCAAGCGGCTAGAATACGAG |
| SEQ ID NO: 6374 | mm69785_Casc4 | CTGAAGCAGAACGTGGCGGG |
| SEQ ID NO: 6375 | mm69786_Casc4 | AGGCCTGGGAAGAGATGCG |
| SEQ ID NO: 6376 | mm69787_Casc4 | ATGGGGAAGATGATTGCTTG |
| SEQ ID NO: 6377 | mm69796_Sidt1 | TTTCGATCGCGTCTACAGCG |
| SEQ ID NO: 6378 | mm69797_Sidt1 | TTGTGCTTGTCCATCATGTG |
| SEQ ID NO: 6379 | mm69798_Sidt1 | CCCGCGGCTACAGATACCAA |
| SEQ ID NO: 6380 | mm69799_Sidt1 | GAACGGAGACAACTGAACAC |
| SEQ ID NO: 6381 | mm69808_Nceh1 | TAGATGACGCTGCGTCGCAG |
| SEQ ID NO: 6382 | mm69809_Nceh1 | TACCTAACCATGACATGACG |
| SEQ ID NO: 6383 | mm69810_Nceh1 | ATTCTTCAGGCTGGCAACGT |
| SEQ ID NO: 6384 | mm69811_Nceh1 | TCACTCAATAGAAACGATGA |
| SEQ ID NO: 6385 | mm70116_Lmbrd2 | GCTCCATTCCAGTATGACCG |
| SEQ ID NO: 6386 | mm70117_Lmbrd2 | TCAAGTACAACCACCCACTG |
| SEQ ID NO: 6387 | mm70118_Lmbrd2 | TACCATTCTAAATGCAAACG |
| SEQ ID NO: 6388 | mm70119_Lmbrd2 | GATAGACAAAACCACAGCAA |
| SEQ ID NO: 6389 | mm70120_Cachd1 | CCTACCGTTCATGAGGGCGT |
| SEQ ID NO: 6390 | mm70121_Cachd1 | TCCAACCGGATGATTGATG |
| SEQ ID NO: 6391 | mm70122_Cachd1 | TGGGTGTTGCTATGTAACGG |

TABLE 1-continued mmSurf sgRNA library sequences

| SEQ ID NO | id_gRNA Target | Sequence |
|---|---|---|
| SEQ ID NO: 6392 | mm70123_Cachd1 | TGGGTATCGACTTCACACTG |
| SEQ ID NO: 6393 | mm70132_Tmem104 | TGGAAATGACTCTTGCGGCG |
| SEQ ID NO: 6394 | mm70133_Tmem104 | TGGTATTCGTAGGCTTCATG |
| SEQ ID NO: 6395 | mm70134_Tmem104 | TCAGCCAAGACAACTACGAG |
| SEQ ID NO: 6396 | mm70135_Tmem104 | ACCCCCAAGAAGTTGGCTAG |
| SEQ ID NO: 6397 | mm70164_Islr2 | AAGATTACGGTACTAAGGCG |
| SEQ ID NO: 6398 | mm70165_Islr2 | GCAGCGCGCTCAAGTTACGA |
| SEQ ID NO: 6399 | mm70166_Islr2 | ATGGTTAGACACATAGCGAG |
| SEQ ID NO: 6400 | mm70167_Islr2 | CACCCGTAAGGACGTTGAGT |
| SEQ ID NO: 6401 | mm70276_Tmem117 | AGCTGGGACAAACTGAACCG |
| SEQ ID NO: 6402 | mm70277_Tmem117 | ACATCGTCATCCACGACCCA |
| SEQ ID NO: 6403 | mm70278_Tmem117 | TCTGGAAGAAAGGCAACGTG |
| SEQ ID NO: 6404 | mm70279_Tmem117 | ATATACTGTCCATATTCATG |
| SEQ ID NO: 6405 | mm70292_Slc26a9 | TTGTGGGGAGATCCGACAA |
| SEQ ID NO: 6406 | mm70293_Slc26a9 | GGGTCTGGAAGATCACAACC |
| SEQ ID NO: 6407 | mm70294_Slc26a9 | AGAGAGCGCAGCAAATGACG |
| SEQ ID NO: 6408 | mm70295_Slc26a9 | TTCTAGACTCACAAAGACGA |
| SEQ ID NO: 6409 | mm70324_Mdga2 | TTACTACAAGGATCTGACAA |
| SEQ ID NO: 6410 | mm70325_Mdga2 | AAAGTTATGATGGGACCCTG |
| SEQ ID NO: 6411 | mm70326_Mdga2 | GCATTCTTGGAAATCCGTCA |
| SEQ ID NO: 6412 | mm70327_Mdga2 | TTAGTATGTGTTACAACTGG |
| SEQ ID NO: 6413 | mm70336_Pkn1 | GCTCAAGCTGGACAACACAG |
| SEQ ID NO: 6414 | mm70337_Pkn1 | CAGTAAGTCTAGGCGTCGAG |
| SEQ ID NO: 6415 | mm70338_Pkn1 | ATGATCCAGACCTATAGCAA |
| SEQ ID NO: 6416 | mm70339_Pkn1 | AAAGTCGCCCCTGACACTTG |
| SEQ ID NO: 6417 | mm70372_Negr1 | AGATGAACCTGCATTGTCCG |
| SEQ ID NO: 6418 | mm70373_Negr1 | AATGTGGAAATGGAAACTCG |
| SEQ ID NO: 6419 | mm70374_Negr1 | TTATGGAATTACAAGGGACC |
| SEQ ID NO: 6420 | mm70375_Negr1 | CAGAGCCTGTCATTTCCTGG |
| SEQ ID NO: 6421 | mm70396_Cdh10 | ATAAAAACGTGGATCCACAT |
| SEQ ID NO: 6422 | mm70397_Cdh10 | AAGCCACTGATGCTGACACG |
| SEQ ID NO: 6423 | mm70398_Cdh10 | TGATTATCAATATGTAGGCA |
| SEQ ID NO: 6424 | mm70399_Cdh10 | TGAGATAATTCACGATCAAG |
| SEQ ID NO: 6425 | mm70404_Itgb8 | CCAGATAATAAAGATCCACG |
| SEQ ID NO: 6426 | mm70405_Itgb8 | ACATGAATGTATCCATGGGG |
| SEQ ID NO: 6427 | mm70406_Itgb8 | ATTTCAGAACACAATAGATG |
| SEQ ID NO: 6428 | mm70407_Itgb8 | ATGAAAACATGTGATATCAT |
| SEQ ID NO: 6429 | mm70428_Lrrn4 | GAGTGGTGACTCCCGCGGCG |

TABLE 1-continued mmSurf sgRNA library sequences

| SEQ ID NO | id_gRNA Target | Sequence |
|---|---|---|
| SEQ ID NO: 6430 | mm70429_Lrrn4 | CAAAAACTGAATGATCGAAG |
| SEQ ID NO: 6431 | mm70430_Lrrn4 | ATTAGGCTCAAGGATATGTG |
| SEQ ID NO: 6432 | mm70431_Lrrn4 | CGCCCAGGAGGCATTCGCGG |
| SEQ ID NO: 6433 | mm70512_Tmem26 | CTCACCCTCAAGTTCAAGCG |
| SEQ ID NO: 6434 | mm70513_Tmem26 | TAATATTAATCATTGGACGG |
| SEQ ID NO: 6435 | mm70514_Tmem26 | CCAGACCGGTTCACATACCA |
| SEQ ID NO: 6436 | mm70515_Tmem26 | GTGCATTTCAAGAAGCCACA |
| SEQ ID NO: 6437 | mm70732_Mslnl | GGCAAGCAGCCACCACACTG |
| SEQ ID NO: 6438 | mm70733_Mslnl | GCTTACTGTCATGCAGACTG |
| SEQ ID NO: 6439 | mm70734_Mslnl | TCCACTGGCCTATTTCAGCG |
| SEQ ID NO: 6440 | mm70735_Mslnl | GCAGGGAGATCCTGTGTCCG |
| SEQ ID NO: 6441 | mm70760_Treml2 | GAACCGCCGGAACTTAGTTG |
| SEQ ID NO: 6442 | mm70761_Treml2 | CAAGGTAGTCCGTATCACCA |
| SEQ ID NO: 6443 | mm70762_Treml2 | CGTGACAAATCCATCCATGG |
| SEQ ID NO: 6444 | mm70763_Treml2 | TACAGTTTCATCGATACCAG |
| SEQ ID NO: 6445 | mm70792_Pkd2l1 | TCAGTACAATAACATGAACG |
| SEQ ID NO: 6446 | mm70793_Pkd2l1 | CGTGCGCAATGACTCCTGTG |
| SEQ ID NO: 6447 | mm70794_Pkd2l1 | CACACAGACAGATGTCCACG |
| SEQ ID NO: 6448 | mm70795_Pkd2l1 | GATCCGCTATGTGAATAACT |
| SEQ ID NO: 6449 | mm70836_Tnn | AATTGATGGACCAACCAATG |
| SEQ ID NO: 6450 | mm70837_Tnn | GGGTGTCTGCCAGTGCCACG |
| SEQ ID NO: 6451 | mm70838_Tnn | GGCTGACATCGACAGGTATG |
| SEQ ID NO: 6452 | mm70839_Tnn | CAGCACACCTATGACATCAC |
| SEQ ID NO: 6453 | mm70916_Fat4 | GACATCGTGGACGATCGAGG |
| SEQ ID NO: 6454 | mm70917_Fat4 | CAGTTATCTCATCACTACCG |
| SEQ ID NO: 6455 | mm70918_Fat4 | GGGATGTCGAAAGAGTACAC |
| SEQ ID NO: 6456 | mm70919_Fat4 | ATTAGATCCTATGTCCGCGT |
| SEQ ID NO: 6457 | mm70960_Tmem67 | TCACAAATGTTGGTTCGCAG |
| SEQ ID NO: 6458 | mm70961_Tmem67 | ATTGATTGGGAACGGCCGAA |
| SEQ ID NO: 6459 | mm70962_Tmem67 | TTGCTACCCAGATTTCACTG |
| SEQ ID NO: 6460 | mm70963_Tmem67 | GCTGCTTCCTATGATATACG |
| SEQ ID NO: 6461 | mm71032_Slc5a6 | CTTACTTAATCCCAGAGATG |
| SEQ ID NO: 6462 | mm71033_Slc5a6 | CAAACATGACCAGACCAATG |
| SEQ ID NO: 6463 | mm71034_Slc5a6 | GCAGTTCACCAACGGTATGG |
| SEQ ID NO: 6464 | mm71035_Slc5a6 | ATCCTATAGGTGATATACAT |
| SEQ ID NO: 6465 | mm71088_Sdk1 | TGTGAAATCATATCCGAGGG |
| SEQ ID NO: 6466 | mm71089_Sdk1 | AATGAGGCAAGTGAACATCG |
| SEQ ID NO: 6467 | mm71090_Sdk1 | TGTGCGAGGCGACACTCCGG |

TABLE 1-continued mmSurf sgRNA library sequences

| SEQ ID NO | id_gRNA Target | Sequence |
|---|---|---|
| SEQ ID NO: 6468 | mm71091_Sdk1 | GAAGGTGTGAGGACTACCGC |
| SEQ ID NO: 6469 | mm71096_Pon2 | AGGTGAAATATTGATCCCGT |
| SEQ ID NO: 6470 | mm71097_Pon2 | GACATACTTGAACCTACACT |
| SEQ ID NO: 6471 | mm71098_Pon2 | GCGGTTCCTAGCGCTCAGGT |
| SEQ ID NO: 6472 | mm71099_Pon2 | ATCTCAAAGACGAGAGACCG |
| SEQ ID NO: 6473 | mm71100_Thsd7a | CTGTAGGGGATGTGACATCG |
| SEQ ID NO: 6474 | mm71101_Thsd7a | CATCTGTGTGCGAGTCAACG |
| SEQ ID NO: 6475 | mm71102_Thsd7a | TGTGCGTTATATTTGTCACA |
| SEQ ID NO: 6476 | mm71103_Thsd7a | CGCGAAAAGCCTTATAACGG |
| SEQ ID NO: 6477 | mm71176_Bsph1 | ATTTCACTTCTATACAAGAA |
| SEQ ID NO: 6478 | mm71177_Bsph1 | ATTTCAATCTGAAACACAAG |
| SEQ ID NO: 6479 | mm71178_Bsph1 | GATTATTATGCACCAACTAT |
| SEQ ID NO: 6480 | mm71179_Bsph1 | CACAGTATTTCCAGTAACCT |
| SEQ ID NO: 6481 | mm71320_Slc9a9 | CACTTACCCTATGACCACAC |
| SEQ ID NO: 6482 | mm71321_Slc9a9 | TGTTGACTAGTAGAGTTGAT |
| SEQ ID NO: 6483 | mm71322_Slc9a9 | GAGTGTACTGAATGATGCGG |
| SEQ ID NO: 6484 | mm71323_Slc9a9 | ATCCGATGACAGATTGTTGT |
| SEQ ID NO: 6485 | mm71352_Il1rapl1 | TTGAAAATGGAAACGGACGT |
| SEQ ID NO: 6486 | mm71353_Il1rapl1 | AATTTCATGCCGAGACATAG |
| SEQ ID NO: 6487 | mm71354_Il1rapl1 | CCAGTGGAATCAAGAGACTG |
| SEQ ID NO: 6488 | mm71355_Il1rapl1 | CAACATTACTACAGGACAGT |
| SEQ ID NO: 6489 | mm71544_Cd59b | TATTATGAGCCGATTAGACG |
| SEQ ID NO: 6490 | mm71545_Cd59b | ATGCTACAACTGTTTAGACC |
| SEQ ID NO: 6491 | mm71546_Cd59b | GGCAAGTGTATCAACAGTGT |
| SEQ ID NO: 6492 | mm71547_Cd59b | TTGATACACTTGCCTTCCTG |
| SEQ ID NO: 6493 | mm71592_Ust | CAAGTGTGGCAGTCGTACCG |
| SEQ ID NO: 6494 | mm71593_Ust | GAATAAATAGGGCTGTTCGG |
| SEQ ID NO: 6495 | mm71594_Ust | TAGACAGAAATCTACTGACG |
| SEQ ID NO: 6496 | mm71595_Ust | ACAGGCCTTACCTTACTAGG |
| SEQ ID NO: 6497 | mm71692_Gjd3 | TCGACCGTGTGCGGACAAGG |
| SEQ ID NO: 6498 | mm71693_Gjd3 | GAACACCGCACCTCCCACCG |
| SEQ ID NO: 6499 | mm71694_Gjd3 | GAGTAGATGACGAACAGCAC |
| SEQ ID NO: 6500 | mm71695_Gjd3 | GTGTGTAACACGTTGCAGCC |
| SEQ ID NO: 6501 | mm71816_Defb34 | AGAAATGCAGCAGGATTAAT |
| SEQ ID NO: 6502 | mm71817_Defb34 | AAGAACTTGTTGCTCTCTGC |
| SEQ ID NO: 6503 | mm71818_Defb34 | TCTTTGCTGTTCTCTTCTTT |
| SEQ ID NO: 6504 | mm71819_Defb34 | AAAAAAAATGCATTCT |
| SEQ ID NO: 6505 | mm71888_Lrrc24 | TCCCACCGGGAATCCCTCCG |

TABLE 1-continued mmSurf sgRNA library sequences

| SEQ ID NO | id_gRNA Target | Sequence |
|---|---|---|
| SEQ ID NO: 6506 | mm71889_Lrrc24 | AGTCTACTAGAAGTATCTGG |
| SEQ ID NO: 6507 | mm71890_Lrrc24 | GCTTGAGGCTTACCATCGCG |
| SEQ ID NO: 6508 | mm71891_Lrrc24 | GAGGTCCAGTAGGGCTAAGG |
| SEQ ID NO: 6509 | mm71892_Raet1e | GAGCACTTCACGTCACACCA |
| SEQ ID NO: 6510 | mm71893_Raet1e | TCCTGGCACAAATCGTTCAG |
| SEQ ID NO: 6511 | mm71894_Raet1e | GAACTCACCATCCAGCCCGT |
| SEQ ID NO: 6512 | mm71895_Raet1e | TCTACACAGAGAATATGAGC |
| SEQ ID NO: 6513 | mm71948_Tmem102 | CTGCCTGGGGTGGAAAACGA |
| SEQ ID NO: 6514 | mm71949_Tmem102 | AAGCCAAGTCCCAAAGCCGT |
| SEQ ID NO: 6515 | mm71950_Tmem102 | GCTCTTCGACTTGATCCCGG |
| SEQ ID NO: 6516 | mm71951_Tmem102 | GTGCCATCCAGAGAAAACAC |
| SEQ ID NO: 6517 | mm72092_Tmem106c | CAGCCAACTCACGTTCTCTG |
| SEQ ID NO: 6518 | mm72093_Tmem106c | TGATGCCGTTATCGTCCACG |
| SEQ ID NO: 6519 | mm72094_Tmem106c | CACATAGGGGAACTGAGCGA |
| SEQ ID NO: 6520 | mm72095_Tmem106c | GAACTCCAACTTCTATCCTG |
| SEQ ID NO: 6521 | mm72404_Gpr176 | TGTAGATCAGAACATACACC |
| SEQ ID NO: 6522 | mm72405_Gpr176 | GGTGCTCAAATTCCTACACA |
| SEQ ID NO: 6523 | mm72406_Gpr176 | CCGGTGGTGCAACTGCACCA |
| SEQ ID NO: 6524 | mm72407_Gpr176 | AGTCTGGTAGACAACCAGGG |
| SEQ ID NO: 6525 | mm72448_Dpy19l4 | CATCATGAAAGTGTACGTCG |
| SEQ ID NO: 6526 | mm72449_Dpy19l4 | AAGGCGCCGTCATTCGAGAG |
| SEQ ID NO: 6527 | mm72450_Dpy19l4 | AAGATTCAAGGTCACCGGCA |
| SEQ ID NO: 6528 | mm72451_Dpy19l4 | GTTACAAGTTGGCTTATGAG |
| SEQ ID NO: 6529 | mm72628_Clec4b2 | GGCATCCCAGAATAAGAGTG |
| SEQ ID NO: 6530 | mm72629_Clec4b2 | TGAGATTGGAATGGTATGTG |
| SEQ ID NO: 6531 | mm72630_Clec4b2 | CTGCTTTAGTGAAGGAACTA |
| SEQ ID NO: 6532 | mm72631_Clec4b2 | CTGGTCCCTGAGACTCTGGA |
| SEQ ID NO: 6533 | mm73048_Fndc5 | GCTCTTCAAGACCCCACGCG |
| SEQ ID NO: 6534 | mm73049_Fndc5 | GATGCTCCGGTTCATTCAGG |
| SEQ ID NO: 6535 | mm73050_Fndc5 | CAGGACATCCCAGCTGACCA |
| SEQ ID NO: 6536 | mm73051_Fndc5 | GCCGGACGGTCACGTTCACA |
| SEQ ID NO: 6537 | mm73304_Tas2r118 | TTGGAAGGTATCAGTCGTCT |
| SEQ ID NO: 6538 | mm73305_Tas2r118 | TGTTAAATATCACATCCAGA |
| SEQ ID NO: 6539 | mm73306_Tas2r118 | CTTTCAAAGACTGTCACCGG |
| SEQ ID NO: 6540 | mm73307_Tas2r118 | AATTGTGCAAAGTTGCACAA |
| SEQ ID NO: 6541 | mm73472_Defb21 | GGTAATATTTGCATGATCCA |
| SEQ ID NO: 6542 | mm73473_Defb21 | TCTACCTCCCAAGAGCCATG |
| SEQ ID NO: 6543 | mm73474_Defb21 | TGGGGTAGAAGAGCAAGGAC |

TABLE 1-continued mmSurf sgRNA library sequences

| SEQ ID NO | id_gRNA Target | Sequence |
|---|---|---|
| SEQ ID NO: 6544 | mm73475_Defb21 | CTTCTACCCCAAGTGACACC |
| SEQ ID NO: 6545 | mm73820_Itprip | ATAAACAAGTGGCACCGTAG |
| SEQ ID NO: 6546 | mm73821_Itprip | ACTGTATCCGGAGCACCACG |
| SEQ ID NO: 6547 | mm73822_Itprip | TCAAAATCAAGTTCCGCTCG |
| SEQ ID NO: 6548 | mm73823_Itprip | GTTGCGACAGAACCATCAGG |
| SEQ ID NO: 6549 | mm73860_Gnptab | TGTTTGCAATGGACGCGTGG |
| SEQ ID NO: 6550 | mm73861_Gnptab | TCTGCCCATGCCAATCGACG |
| SEQ ID NO: 6551 | mm73862_Gnptab | AGGAGTGAAATATTTACCCG |
| SEQ ID NO: 6552 | mm73863_Gnptab | CATGCTGGACCGTTTAAGGG |
| SEQ ID NO: 6553 | mm73900_Dnaic2 | ACAGCCAACCAAGTTCATGG |
| SEQ ID NO: 6554 | mm73901_Dnaic2 | GGCGTTAATCATGTCGAGGG |
| SEQ ID NO: 6555 | mm73902_Dnaic2 | CAACGCCATCGACATCTACG |
| SEQ ID NO: 6556 | mm73903_Dnaic2 | GAACTACGACTCCTACATCT |
| SEQ ID NO: 6557 | mm74076_Defb45 | TAGGTTACCTGGAATGACCT |
| SEQ ID NO: 6558 | mm74077_Defb45 | AGACTTCCAGCATCTTTCAG |
| SEQ ID NO: 6559 | mm74078_Defb45 | GAAGACTGCGGTGTTAACTA |
| SEQ ID NO: 6560 | mm74079_Defb45 | GAAAGATGCTGGAAGTCTTT |
| SEQ ID NO: 6561 | mm74188_Lrrc8b | CAGTGGCGGAACAGTCAGTG |
| SEQ ID NO: 6562 | mm74189_Lrrc8b | CGTGTACCATTCGTCCCTGG |
| SEQ ID NO: 6563 | mm74190_Lrrc8b | CAAGCTCGTGAAAAACTCGC |
| SEQ ID NO: 6564 | mm74191_Lrrc8b | AGGTCGTTCTGGATCCGGAG |
| SEQ ID NO: 6565 | mm74625_Defb22 | GCAACGAGCAAATGTCCCAT |
| SEQ ID NO: 6566 | mm74626_Defb22 | ATAATCTTGTCACAGCAGGT |
| SEQ ID NO: 6567 | mm74627_Defb22 | TTCAAAATTAGTGGTCACTG |
| SEQ ID NO: 6568 | mm74628_Defb22 | AAAAAGTGTGCAAACACATT |
| SEQ ID NO: 6569 | mm74793_Iqgap2 | CACAAGTTAACACTGCGTTG |
| SEQ ID NO: 6570 | mm74794_Iqgap2 | GGTCACATCAGATTACATCC |
| SEQ ID NO: 6571 | mm74795_Iqgap2 | AAACAACAGATGTCTACGAT |
| SEQ ID NO: 6572 | mm74796_Iqgap2 | AGAAACAGAACACATCGGTG |
| SEQ ID NO: 6573 | mm74857_Gal3st3 | TAGACGCCGCAGCAGCACGA |
| SEQ ID NO: 6574 | mm74858_Gal3st3 | ATTGTCGCCTCCAAGGTCGT |
| SEQ ID NO: 6575 | mm74859_Gal3st3 | GCTGAAAAGCGACTCGAACA |
| SEQ ID NO: 6576 | mm74860_Gal3st3 | CCACAGGAAAATTCTGCTGT |
| SEQ ID NO: 6577 | mm74909_Defb28 | AGAGCTTATTGTGTCCCGAG |
| SEQ ID NO: 6578 | mm74910_Defb28 | TTTCCCCAAGCCATAAAAGC |
| SEQ ID NO: 6579 | mm74911_Defb28 | GAAATGCAGGCGCATATGCA |
| SEQ ID NO: 6580 | mm74912_Defb28 | CCACAAGGACAGCTAAGGTC |
| SEQ ID NO: 6581 | mm75020_Pilrb2 | AATTCAGCAAGATCAAACGG |

TABLE 1-continued mmSurf sgRNA library sequences

| SEQ ID NO | id_gRNA Target | Sequence |
|---|---|---|
| SEQ ID NO: 6582 | mm75021_Pilrb2 | CTTCCCCTGGAAGTTAGCCA |
| SEQ ID NO: 6583 | mm75022_Pilrb2 | CTCATGTATGAAAGGCATGG |
| SEQ ID NO: 6584 | mm75023_Pilrb2 | CCTTAAAGTTCAGGATTCTG |
| SEQ ID NO: 6585 | mm75028_Cyp2w1 | CTGGTCAATGAGACTCAGCA |
| SEQ ID NO: 6586 | mm75029_Cyp2w1 | AGCTTCTACATAACTCTGCG |
| SEQ ID NO: 6587 | mm75030_Cyp2w1 | CCCAGATGGATTGTGAACAT |
| SEQ ID NO: 6588 | mm75031_Cyp2w1 | TGTGCAACAGCCATCCATGG |
| SEQ ID NO: 6589 | mm76081_Defb23 | ATGTCCTCATCCGGTATGTG |
| SEQ ID NO: 6590 | mm76082_Defb23 | ACCGTGAAAAGATGCTTAGT |
| SEQ ID NO: 6591 | mm76083_Defb23 | AACGAAAAGAATTCCACAG |
| SEQ ID NO: 6592 | mm76084_Defb23 | CTGAGACTGAAGCATGAGAC |
| SEQ ID NO: 6593 | mm76137_Cd101 | GAGATGGGTGTGTTGCACGG |
| SEQ ID NO: 6594 | mm76138_Cd101 | AGACCACCGGAAATCCTGCG |
| SEQ ID NO: 6595 | mm76139_Cd101 | TGCCGAGCAGCGTACTGTGT |
| SEQ ID NO: 6596 | mm76140_Cd101 | GGTGTATCGGTGTACAGTGG |
| SEQ ID NO: 6597 | mm76373_Defb26 | CAGAGTCCGATGTCAAGAAG |
| SEQ ID NO: 6598 | mm76374_Defb26 | TTGCTAACTCAGGGGAACAA |
| SEQ ID NO: 6599 | mm76375_Defb26 | CGGGTCGCTGATGAATTCAC |
| SEQ ID NO: 6600 | mm76376_Defb26 | ACTCTTGTTACAGTGTGTAT |
| SEQ ID NO: 6601 | mm76377_Defb43 | CAGAGGAACTATGGATAACA |
| SEQ ID NO: 6602 | mm76378_Defb43 | TTGAACAGTCCTGATTCTCA |
| SEQ ID NO: 6603 | mm76379_Defb43 | TTGTTATCCATAGTTCCTCT |
| SEQ ID NO: 6604 | mm76380_Defb43 | CAAGGTGAGGACCCCCAGGA |
| SEQ ID NO: 6605 | mm76381_Defb25 | AAAGTGGATTCTGCTCATTG |
| SEQ ID NO: 6606 | mm76382_Defb25 | TACCTGGTGGTACATGACTC |
| SEQ ID NO: 6607 | mm76383_Defb25 | CACACACAAGGGTTACCTGG |
| SEQ ID NO: 6608 | mm76384_Defb25 | ATCCGGACACAGGTGCATGA |
| SEQ ID NO: 6609 | mm76401_Tctn1 | CCCACAGCCCACTAAATACG |
| SEQ ID NO: 6610 | mm76402_Tctn1 | GTACCCACCGTCCGTGACCG |
| SEQ ID NO: 6611 | mm76403_Tctn1 | ATGAGTTTAAAGTCACGGTG |
| SEQ ID NO: 6612 | mm76404_Tctn1 | GAGACCGATACATTACAGAC |
| SEQ ID NO: 6613 | mm77059_Fcrl6 | GCTGTAAAGTTGGATTCTTG |
| SEQ ID NO: 6614 | mm77060_Fcrl6 | GAATGAGTAAAGATTGGAA |
| SEQ ID NO: 6615 | mm77061_Fcrl6 | AGAAATCCTAGGGAAACCCC |
| SEQ ID NO: 6616 | mm77062_Fcrl6 | ACAACCATGTCATTCAAGAC |
| SEQ ID NO: 6617 | mm77174_Btnl1 | CAGCTCGCATGCACATCCGA |
| SEQ ID NO: 6618 | mm77175_Btnl1 | GTGCAGATGCCGGAATACAG |
| SEQ ID NO: 6619 | mm77176_Btnl1 | AGAAAACCAAGACACTTCTG |

TABLE 1-continued mmSurf sgRNA library sequences

| SEQ ID NO | id_gRNA Target | Sequence |
|---|---|---|
| SEQ ID NO: 6620 | mm77177_Btnl1 | AGGGGCAGAGCCTAAACCTG |
| SEQ ID NO: 6621 | mm77704_Ccl21b | GCTTCCGGGGTAAGAACCTG |
| SEQ ID NO: 6622 | mm77705_Ccl21b | GAGCCAGGACCAGGCTAAGG |
| SEQ ID NO: 6623 | mm77706_Ccl21b | ATTCCCTACAGTATTGTCCG |
| SEQ ID NO: 6624 | mm77707_Ccl21b | CTCTGCATCCCCTGGACCCA |
| SEQ ID NO: 6625 | mm77945_Tigit | CCTATCATACGTATCCTGGT |
| SEQ ID NO: 6626 | mm77946_Tigit | CAGGCACGATAGATACAAAG |
| SEQ ID NO: 6627 | mm77947_Tigit | TCTCTGACAATGAATGACAC |
| SEQ ID NO: 6628 | mm77948_Tigit | CCATTTATAGTGTTGACCTG |
| SEQ ID NO: 6629 | NTC | AAAAAGTCCGCGATTACGTC |
| SEQ ID NO: 6630 | NTC | AAAACGGCTCGATCGGTGAT |
| SEQ ID NO: 6631 | NTC | AAAACGTAATTATACCGAGC |
| SEQ ID NO: 6632 | NTC | AAAATTGCACCTTCCCGGCC |
| SEQ ID NO: 6633 | NTC | AAACCCCGCGCGGAGCGTC |
| SEQ ID NO: 6634 | NTC | AAACCTAGCGTAGATTCGGC |
| SEQ ID NO: 6635 | NTC | AAACGAGGCTGTTCGTACAC |
| SEQ ID NO: 6636 | NTC | AAACTCATACGTAGCGAATC |
| SEQ ID NO: 6637 | NTC | AAACTCCGTGTCAACCGAT |
| SEQ ID NO: 6638 | NTC | AAAGACGTGCATTCAGCGAG |
| SEQ ID NO: 6639 | NTC | AACATGTTAAGTCGCGTTAT |
| SEQ ID NO: 6640 | NTC | AACCAGCATTTGACCGCGCT |
| SEQ ID NO: 6641 | NTC | AACCCCGGCTGTCATCGCCG |
| SEQ ID NO: 6642 | NTC | AACCCGCCGGAACAATCAGC |
| SEQ ID NO: 6643 | NTC | AACCGGCTGCGCGTTTGCAA |
| SEQ ID NO: 6644 | NTC | AACCGTACTGCGAGGAGCAT |
| SEQ ID NO: 6645 | NTC | AACCTCGTCTCATGTACGAA |
| SEQ ID NO: 6646 | NTC | AACGCCCCGGATTTCGTTGA |
| SEQ ID NO: 6647 | NTC | AACGGCTGCGCCCGCGGCAA |
| SEQ ID NO: 6648 | NTC | AACGGGCGCAATACCCTTTT |
| SEQ ID NO: 6649 | NTC | AACGGTAGCGTACCCGTGAA |
| SEQ ID NO: 6650 | NTC | AACGGTCAAATCCGTGAGGG |
| SEQ ID NO: 6651 | NTC | AACGTCACCAACCTCGATCC |
| SEQ ID NO: 6652 | NTC | AACGTTATAGCTTCGTCTCT |
| SEQ ID NO: 6653 | NTC | AACTAACTCACTACGCACGA |
| SEQ ID NO: 6654 | NTC | AACTCCTCATCGTACGCTAA |
| SEQ ID NO: 6655 | NTC | AACTCGCGTGGGAAGTCCGG |
| SEQ ID NO: 6656 | NTC | AACTTATACGTAATCTGATC |
| SEQ ID NO: 6657 | NTC | AAGACTCCTACGTATCGAGC |

TABLE 1-continued mmSurf sgRNA library sequences

| SEQ ID NO | id_gRNA Target | Sequence |
|---|---|---|
| SEQ ID NO: 6658 | NTC | AAGCACAAGAACGGTCCGCC |
| SEQ ID NO: 6659 | NTC | AAGCAGCGACTACTCGACGC |
| SEQ ID NO: 6660 | NTC | AAGCCTAACGGAGCTCGCGG |
| SEQ ID NO: 6661 | NTC | AAGCCTACTTCACCGGTCGG |
| SEQ ID NO: 6662 | NTC | AAGCGAGCCGCAGACCGTTT |
| SEQ ID NO: 6663 | NTC | AAGCGTACCCCACTCGTTAA |
| SEQ ID NO: 6664 | NTC | AAGCGTGAGATTCACCGCCG |
| SEQ ID NO: 6665 | NTC | AAGGCCTTAACACGTCGACC |
| SEQ ID NO: 6666 | NTC | AAGGCGTAAACGAGTACACG |
| SEQ ID NO: 6667 | NTC | AAGGGTAAGTACAGTATCGT |
| SEQ ID NO: 6668 | NTC | AAGTCCCCTTCGGGAACTCC |
| SEQ ID NO: 6669 | NTC | AAGTCTATGCGGGCTCGTA |
| SEQ ID NO: 6670 | NTC | AATAAGCCTACCCGGCGAGA |
| SEQ ID NO: 6671 | NTC | AATACCGTACCGACTCAGTG |
| SEQ ID NO: 6672 | NTC | AATAGGAACTCCGCACCCGA |
| SEQ ID NO: 6673 | NTC | AATCAACCGTGATAGTCTCG |
| SEQ ID NO: 6674 | NTC | AATCACCGACAACGTAAGAC |
| SEQ ID NO: 6675 | NTC | AATGAAGCACCGATTGCGGA |
| SEQ ID NO: 6676 | NTC | AATGAGCGTCTCTCGATCGC |
| SEQ ID NO: 6677 | NTC | AATGAGCTTCGAGTTCGTCT |
| SEQ ID NO: 6678 | NTC | AATGCTGCGTACGATAACCG |
| SEQ ID NO: 6679 | NTC | AATTCTGAGATTCCGCGGCT |
| SEQ ID NO: 6680 | NTC | AATTGTCTGATCGCGCCATA |
| SEQ ID NO: 6681 | NTC | AATTTTTTCGGAATCTAGCG |
| SEQ ID NO: 6682 | NTC | ACAACAATTACTGGCCGCGA |
| SEQ ID NO: 6683 | NTC | ACAACACGCCGACACGTCTA |
| SEQ ID NO: 6684 | NTC | ACAATTCGGTTTATGCGCGT |
| SEQ ID NO: 6685 | NTC | ACACAAACTGGTCGTAGATG |
| SEQ ID NO: 6686 | NTC | ACACCCGTGTATGCACCGGG |
| SEQ ID NO: 6687 | NTC | ACACGACCGACCGGTGGAAT |
| SEQ ID NO: 6688 | NTC | ACACGTCTTCGGCTATACGC |
| SEQ ID NO: 6689 | NTC | ACAGACCGAATAACCGACGA |
| SEQ ID NO: 6690 | NTC | ACAGAGTCGTGTGCCGAACG |
| SEQ ID NO: 6691 | NTC | ACAGCAGGGGCCGCGAATAA |
| SEQ ID NO: 6692 | NTC | ACAGCGGCCTAATACTTCGC |
| SEQ ID NO: 6693 | NTC | ACCAACGCTACGATCCCGGA |
| SEQ ID NO: 6694 | NTC | ACCAATAACGGGTACAAGTC |
| SEQ ID NO: 6695 | NTC | ACCACCGTGCCGGGGACGCG |

TABLE 1-continued mmSurf sgRNA library sequences

| SEQ ID NO | id_gRNA Target | Sequence |
|---|---|---|
| SEQ ID NO: 6696 | NTC | ACCAGGACTGCCGCGTGAGG |
| SEQ ID NO: 6697 | NTC | ACCAGGCGCGGACCGCACAT |
| SEQ ID NO: 6698 | NTC | ACCATACGGGGTCTTGTCGA |
| SEQ ID NO: 6699 | NTC | ACCATAGTTTCAACCTGCGG |
| SEQ ID NO: 6700 | NTC | ACCATCCGATATTACGAGCA |
| SEQ ID NO: 6701 | NTC | ACCATGATGTCACCGCCGCA |
| SEQ ID NO: 6702 | NTC | ACCCACGTATGTACTCGGGA |
| SEQ ID NO: 6703 | NTC | ACCCAGATTCGCATTCGGAT |
| SEQ ID NO: 6704 | NTC | ACCCATCCCCGCGTCCGAGA |
| SEQ ID NO: 6705 | NTC | ACCCATCGGGTGCGATATGG |
| SEQ ID NO: 6706 | NTC | ACCCGCATATGCCGCCTAAG |
| SEQ ID NO: 6707 | NTC | ACCCTAGCCTCATCGCGACC |
| SEQ ID NO: 6708 | NTC | ACCGCACGTTCTCGCAGAGA |
| SEQ ID NO: 6709 | NTC | ACCGCGCATCATTGACGGTG |
| SEQ ID NO: 6710 | NTC | ACCGGACTGCGATATGCCGT |
| SEQ ID NO: 6711 | NTC | ACCGGATGTGGGCGCCTCTC |
| SEQ ID NO: 6712 | NTC | ACCGGTCGAAGTCTGGGATT |
| SEQ ID NO: 6713 | NTC | ACCGGTTCAGCCGCCGGAAC |
| SEQ ID NO: 6714 | NTC | ACCGTACAAGACTCGCTCCA |
| SEQ ID NO: 6715 | NTC | ACCGTCTCTATTATACGGCA |
| SEQ ID NO: 6716 | NTC | ACCGTCTGATGTTCCCGGCT |
| SEQ ID NO: 6717 | NTC | ACCGTTGTTTCCGTCGAAAC |
| SEQ ID NO: 6718 | NTC | ACCTCGTGCAAATCGGTGGC |
| SEQ ID NO: 6719 | NTC | ACCTTGTGTTCGACGGTAGG |
| SEQ ID NO: 6720 | NTC | ACGACGAGAGATACTTAGGC |
| SEQ ID NO: 6721 | NTC | ACGACGTCCGCTGTGTGTAT |
| SEQ ID NO: 6722 | NTC | ACGAGGAGAAGTCGAGTATT |
| SEQ ID NO: 6723 | NTC | ACGCAAGCGGAACGCGTCTA |
| SEQ ID NO: 6724 | NTC | ACGCACCCATACAGGCGCTT |
| SEQ ID NO: 6725 | NTC | ACGCGAAGTGTCGCAGAGTG |
| SEQ ID NO: 6726 | NTC | ACGCTATAGTGTACGTCTAA |
| SEQ ID NO: 6727 | NTC | ACGCTCTTGGCAGATAATCG |
| SEQ ID NO: 6728 | NTC | ACGCTGTTCGTAACCGCGGG |
| SEQ ID NO: 6729 | NTC | ACGGAACCCGATCGGAACGG |
| SEQ ID NO: 6730 | NTC | ACGGATTGCTGACGCTATCA |
| SEQ ID NO: 6731 | NTC | ACGGGTCAACTTCTTGCCGC |
| SEQ ID NO: 6732 | NTC | ACGGTCCCAACGAGCGCCGG |
| SEQ ID NO: 6733 | NTC | ACGGTCCCTCTCGGGTCAAT |

TABLE 1-continued mmSurf sgRNA library sequences

| SEQ ID NO | id_gRNA Target | Sequence |
|---|---|---|
| SEQ ID NO: 6734 | NTC | ACGGTCGAGCACGGTTATGA |
| SEQ ID NO: 6735 | NTC | ACGTCGATGCTTATCCGTCT |
| SEQ ID NO: 6736 | NTC | ACGTCGGTCTAGAGTTAAGT |
| SEQ ID NO: 6737 | NTC | ACGTGTAAGGCGAACGCCTT |
| SEQ ID NO: 6738 | NTC | ACGTGTTCTCGTACTTAGCT |
| SEQ ID NO: 6739 | NTC | ACGTTGCAGCTCGCGTTTCG |
| SEQ ID NO: 6740 | NTC | ACTAAGGAGTCCCGGTCCGA |
| SEQ ID NO: 6741 | NTC | ACTAGCTCCATAACGTGTAC |
| SEQ ID NO: 6742 | NTC | ACTCACCTCGCACGATCGTA |
| SEQ ID NO: 6743 | NTC | ACTCGACCTAACGTCGATGT |
| SEQ ID NO: 6744 | NTC | ACTCGCGAAACCGTACATGA |
| SEQ ID NO: 6745 | NTC | ACTGCGCGTATAGGACGCAA |
| SEQ ID NO: 6746 | NTC | ACTGTCCCATTGTACGACGG |
| SEQ ID NO: 6747 | NTC | ACTTCCCGCGGTTCCGTTGA |
| SEQ ID NO: 6748 | NTC | ACTTGTATACGACGGCTAGA |
| SEQ ID NO: 6749 | NTC | ACTTTACATCATGTCGTCGT |
| SEQ ID NO: 6750 | NTC | AGAAAGGCACGTGCGACGTC |
| SEQ ID NO: 6751 | NTC | AGAAATCCAGTCCCGCCTAA |
| SEQ ID NO: 6752 | NTC | AGACCTCGTTAGCCGTAGCT |
| SEQ ID NO: 6753 | NTC | AGACGTTGATTTACCGGCCA |
| SEQ ID NO: 6754 | NTC | AGACTCGTGTGCCACGAGGA |
| SEQ ID NO: 6755 | NTC | AGAGGCGGAGCAATACTCGC |
| SEQ ID NO: 6756 | NTC | AGATAGCGCAATCCCGCATG |
| SEQ ID NO: 6757 | NTC | AGATTCTCGCGTAACCAGAG |
| SEQ ID NO: 6758 | NTC | AGCACGCGCACAAGAGCCGC |
| SEQ ID NO: 6759 | NTC | AGCACTAGGATCGCGGCCTT |
| SEQ ID NO: 6760 | NTC | AGCAGTTCGGGTAACGCCCA |
| SEQ ID NO: 6761 | NTC | AGCATGGAGTCAACGTCCGC |
| SEQ ID NO: 6762 | NTC | AGCCGCGCCGCAAAGCTTTT |
| SEQ ID NO: 6763 | NTC | AGCCGGGCTTTCCGTCAAGC |
| SEQ ID NO: 6764 | NTC | AGCCTAGTCGCGCTAATATT |
| SEQ ID NO: 6765 | NTC | AGCGAGTGTCCGTGACGTTC |
| SEQ ID NO: 6766 | NTC | AGCGATGTTCACGCACAGCG |
| SEQ ID NO: 6767 | NTC | AGCGCCATAGGACGCCAAAC |
| SEQ ID NO: 6768 | NTC | AGCGCGTAAGGCGTAGTTAC |
| SEQ ID NO: 6769 | NTC | AGCGTATCTTATGTACCGCT |
| SEQ ID NO: 6770 | NTC | AGCGTCCACGCGTCTATGGA |
| SEQ ID NO: 6771 | NTC | AGCGTGTCGAGAACGGCTTG |

TABLE 1-continued mmSurf sgRNA library sequences

| SEQ ID NO | id_gRNA Target | Sequence |
|---|---|---|
| SEQ ID NO: 6772 | NTC | AGCGTTCGCAGCTGGTCAAC |
| SEQ ID NO: 6773 | NTC | AGCTATCCCACGTTCGCGG |
| SEQ ID NO: 6774 | NTC | AGCTTAGATCGTGCGTCGTA |
| SEQ ID NO: 6775 | NTC | AGGACTATCCGCGGGATTAG |
| SEQ ID NO: 6776 | NTC | AGGCAGCCCGCGTTAGAGAT |
| SEQ ID NO: 6777 | NTC | AGGCCCCGAGACGCGCCACA |
| SEQ ID NO: 6778 | NTC | AGGGCAATCGCGTGCCCAAC |
| SEQ ID NO: 6779 | NTC | AGGGTTAGGCTGACCCGCGA |
| SEQ ID NO: 6780 | NTC | AGGTCCGCTGGCGCAATGGG |
| SEQ ID NO: 6781 | NTC | AGGTCGTGGACCCGCATGTA |
| SEQ ID NO: 6782 | NTC | AGGTGCGTGTCAACCGGTAG |
| SEQ ID NO: 6783 | NTC | AGTACACTACATCGACTTCG |
| SEQ ID NO: 6784 | NTC | AGTACAGCCGACGAGTGCGA |
| SEQ ID NO: 6785 | NTC | AGTAGACGCTATGTTCGCGC |
| SEQ ID NO: 6786 | NTC | AGTAGAGTCGCGAACGCTAC |
| SEQ ID NO: 6787 | NTC | AGTCACTAGGCGCTCTCGCG |
| SEQ ID NO: 6788 | NTC | AGTCAGCTCCGGGGTATACG |
| SEQ ID NO: 6789 | NTC | AGTCATCCTCTATGCGCGTA |
| SEQ ID NO: 6790 | NTC | AGTCCCACGTTTGCCGTCAA |
| SEQ ID NO: 6791 | NTC | AGTCCGGTCGAAATCTGTAT |
| SEQ ID NO: 6792 | NTC | AGTGCCGGGGTGTATACCG |
| SEQ ID NO: 6793 | NTC | AGTGTCACGGCAAAGTCGAG |
| SEQ ID NO: 6794 | NTC | AGTTAAGCGCGTATCTACGT |
| SEQ ID NO: 6795 | NTC | AGTTAAGCTCCAATCGTCTG |
| SEQ ID NO: 6796 | NTC | AGTTTACGTGGTCCGATGTC |
| SEQ ID NO: 6797 | NTC | ATAAAGTCCCAGGTGCGCGC |
| SEQ ID NO: 6798 | NTC | ATAACTTACTCGTTACGACT |
| SEQ ID NO: 6799 | NTC | ATAACTTATGCGCTTCGGGG |
| SEQ ID NO: 6800 | NTC | ATAATGCGCGCGAATACTTA |
| SEQ ID NO: 6801 | NTC | ATACCTCCGCTAGACCGTCT |
| SEQ ID NO: 6802 | NTC | ATACGCATAGATCGGTAAGC |
| SEQ ID NO: 6803 | NTC | ATACGCGTGATGACCTTATG |
| SEQ ID NO: 6804 | NTC | ATAGATGTCTACGCGCCGTT |
| SEQ ID NO: 6805 | NTC | ATAGCCCGGTTTGCCCGTCT |
| SEQ ID NO: 6806 | NTC | ATAGGCGCACGGGCTACTCC |
| SEQ ID NO: 6807 | NTC | ATATCGAATGATGTCCGCAT |
| SEQ ID NO: 6808 | NTC | ATATGAGCCCGACCTCTCGA |
| SEQ ID NO: 6809 | NTC | ATATGCTCGACCCATCGTCC |

TABLE 1-continued mmSurf sgRNA library sequences

| SEQ ID NO | id_gRNA Target | Sequence |
|---|---|---|
| SEQ ID NO: 6810 | NTC | ATATTGTCCCATACGATCGG |
| SEQ ID NO: 6811 | NTC | ATCACACGTTAAACGGGGCG |
| SEQ ID NO: 6812 | NTC | ATCATGCCTTCGCATTAACC |
| SEQ ID NO: 6813 | NTC | ATCCACGCTCCGCGGTACTT |
| SEQ ID NO: 6814 | NTC | ATCCCCCCGACTTAGGGATT |
| SEQ ID NO: 6815 | NTC | ATCCGAGATCTGCGAATTAT |
| SEQ ID NO: 6816 | NTC | ATCCGGGCATAGCGTTTAAA |
| SEQ ID NO: 6817 | NTC | ATCCGTACCAAACACGCTAC |
| SEQ ID NO: 6818 | NTC | ATCGAGCACCGAGTTGTGAT |
| SEQ ID NO: 6819 | NTC | ATCGATATTGATAAACGCGA |
| SEQ ID NO: 6820 | NTC | ATCGCAGGTCTACGCAGAGT |
| SEQ ID NO: 6821 | NTC | ATCGCCTAGCCCAAGCGACG |
| SEQ ID NO: 6822 | NTC | ATCGCGGCGCGTTAAGGCAG |
| SEQ ID NO: 6823 | NTC | ATCGCTAATTTACGAAGGCG |
| SEQ ID NO: 6824 | NTC | ATCGTAAATTACACGTACAG |
| SEQ ID NO: 6825 | NTC | ATCTTAACCAGCGCATCCCG |
| SEQ ID NO: 6826 | NTC | ATGACACTTACGGTACTCGT |
| SEQ ID NO: 6827 | NTC | ATHACCTCTTCGTTCGAGAG |
| SEQ ID NO: 6828 | NTC | ATGATGTGATCCTTCGCCGA |
| SEQ ID NO: 6829 | NTC | ATGCCAATGCCGTTGTTAGC |
| SEQ ID NO: 6830 | NTC | ATGGACCCTTCAGTGCGGTA |
| SEQ ID NO: 6831 | NTC | ATGGGAAAGCCCACGACAAT |
| SEQ ID NO: 6832 | NTC | ATGGTGGCTGTACTCGTAAC |
| SEQ ID NO: 6833 | NTC | ATGTGTATGAAGCCCGTCAT |
| SEQ ID NO: 6834 | NTC | ATGTGTCATAGCGGCGTAGG |
| SEQ ID NO: 6835 | NTC | ATGTTACGTACGTGATCTCC |
| SEQ ID NO: 6836 | NTC | ATGTTGCAGCGCTGTACGCC |
| SEQ ID NO: 6837 | NTC | ATGTTGCAGTTCGGCTCGAT |
| SEQ ID NO: 6838 | NTC | ATTAGGTGACTGGAACACGT |
| SEQ ID NO: 6839 | NTC | ATTATAGCAGCCCCCCGAAT |
| SEQ ID NO: 6840 | NTC | ATTATTCCTCCGGATGACGA |
| SEQ ID NO: 6841 | NTC | ATTCAGTGTACCGGTCAAAT |
| SEQ ID NO: 6842 | NTC | ATTCCGTTTGCAGCGAGACC |
| SEQ ID NO: 6843 | NTC | ATTCGGACCGTTATCTCACC |
| SEQ ID NO: 6844 | NTC | ATTCGTGCATCGCGGGGTTT |
| SEQ ID NO: 6845 | NTC | ATTGTTCGACCGTCTACGGG |
| SEQ ID NO: 6846 | NTC | ATTTGAATGCTCCCGTCGAC |
| SEQ ID NO: 6847 | NTC | ATTTGCCCGTCCATACGCGG |

TABLE 1-continued mmSurf sgRNA library sequences

| SEQ ID NO | id_gRNA Target | Sequence |
|---|---|---|
| SEQ ID NO: 6848 | NTC | CAAACGAGGCCACGTACGTG |
| SEQ ID NO: 6849 | NTC | CAAAGTAACTATCTCGTCGA |
| SEQ ID NO: 6850 | NTC | CAACACGTGCGAGCGAACTG |
| SEQ ID NO: 6851 | NTC | CAACCGTGCGATGCGCGCTA |
| SEQ ID NO: 6852 | NTC | CAACCTGCCTAGCGACCCGC |
| SEQ ID NO: 6853 | NTC | CAACGATCAGGCGTGTTATC |
| SEQ ID NO: 6854 | NTC | CAACGGTCACGCTAGAATAA |
| SEQ ID NO: 6855 | NTC | CAAGAGTTAACCTCGACCGG |
| SEQ ID NO: 6856 | NTC | CAAGGATCGTGCCGTGATTT |
| SEQ ID NO: 6857 | NTC | CAAGGGTGGTCATTGCGAC |
| SEQ ID NO: 6858 | NTC | CAATACACCGTTAACCCTCT |
| SEQ ID NO: 6859 | NTC | CAATATCTAAGCGCTAACGA |
| SEQ ID NO: 6860 | NTC | CAATATGCACGTAGCCTCGT |
| SEQ ID NO: 6861 | NTC | CAATATTCGACCTACGCTCC |
| SEQ ID NO: 6862 | NTC | CAATGGCGTCTGCCGTTCAG |
| SEQ ID NO: 6863 | NTC | CACAACGCCTACCAGCGGAC |
| SEQ ID NO: 6864 | NTC | CACAATACGCGGCAGAGGTC |
| SEQ ID NO: 6865 | NTC | CACACGCCGCGGGCCGTGAG |
| SEQ ID NO: 6866 | NTC | CACCCCGTAGCAACGATAAA |
| SEQ ID NO: 6867 | NTC | CACCCGACTCGGCCGTAAAG |
| SEQ ID NO: 6868 | NTC | CACCGCTGCCCTAGTACCGG |
| SEQ ID NO: 6869 | NTC | CACCTATTCCCCTCCGCAAC |
| SEQ ID NO: 6870 | NTC | CACCTCGCGTCATATCACTA |
| SEQ ID NO: 6871 | NTC | CACCTTTCGAGGTAACACCG |
| SEQ ID NO: 6872 | NTC | CACGAATAACTACAGGTTGC |
| SEQ ID NO: 6873 | NTC | CACGCAGGAGCGGCGACACT |
| SEQ ID NO: 6874 | NTC | CACGCCTTCGTCAACCCTAT |
| SEQ ID NO: 6875 | NTC | CACGGCAGGCATCTCGTCTA |
| SEQ ID NO: 6876 | NTC | CACGGGCAGCGATCTAGTTG |
| SEQ ID NO: 6877 | NTC | CACGTAAGACGCTCCACTTA |
| SEQ ID NO: 6878 | NTC | CACGTATACTTAGGTCAGCG |
| SEQ ID NO: 6879 | NTC | CACTCAGCGGTTGGACGCCC |
| SEQ ID NO: 6880 | NTC | CAGAAACTCTTACCGAGCGC |
| SEQ ID NO: 6881 | NTC | CAGCACCACGCGTCGTGCGG |
| SEQ ID NO: 6882 | NTC | CAGCCACCGCACCGGCGTAA |
| SEQ ID NO: 6883 | NTC | CAGCGACTCTGATCGGCGTA |
| SEQ ID NO: 6884 | NTC | CAGCTCACCCTGCGTACGGT |
| SEQ ID NO: 6885 | NTC | CAGCTGACCGTTAATCGATA |

TABLE 1-continued mmSurf sgRNA library sequences

| SEQ ID NO | id_gRNA Target | Sequence |
|---|---|---|
| SEQ ID NO: 6886 | NTC | CAGGGACGTAGCCGCCGTTA |
| SEQ ID NO: 6887 | NTC | CAGGTTTCCCCTAGTCGAAT |
| SEQ ID NO: 6888 | NTC | CAGTGCCGGTAGCGGCACGG |
| SEQ ID NO: 6889 | NTC | CATACCCGCGCCGTGACTCC |
| SEQ ID NO: 6890 | NTC | CATACCCGGTGTTTCCTAGC |
| SEQ ID NO: 6891 | NTC | CATACTGTTATCGACCCGCA |
| SEQ ID NO: 6892 | NTC | CATAGATCCGCGATTGTACG |
| SEQ ID NO: 6893 | NTC | CATAGCAACGCCCAAACTCG |
| SEQ ID NO: 6894 | NTC | CATATACTCTTGCGCTAGAC |
| SEQ ID NO: 6895 | NTC | CATATGCCTATAACCGGCGG |
| SEQ ID NO: 6896 | NTC | CATATGCTCGACGGTATAAA |
| SEQ ID NO: 6897 | NTC | CATCAGCCCATTATGACTCG |
| SEQ ID NO: 6898 | NTC | CATCCCCGACTACGACTAC |
| SEQ ID NO: 6899 | NTC | CATCGAGGGTAAACGCCATT |
| SEQ ID NO: 6900 | NTC | CATCGCCGACGATCCTCTGG |
| SEQ ID NO: 6901 | NTC | CATCGGCTATGTCGGGGACA |
| SEQ ID NO: 6902 | NTC | CATCGGTAGTCACTACGCCC |
| SEQ ID NO: 6903 | NTC | CATCGTAACACACGTACGAG |
| SEQ ID NO: 6904 | NTC | CATCTATGAGACGTGCGTAC |
| SEQ ID NO: 6905 | NTC | CATGCCCGTCTGCGCCGCAT |
| SEQ ID NO: 6906 | NTC | CATGGGACCCCCCCTCACGT |
| SEQ ID NO: 6907 | NTC | CATTACGTGTCGAGCTCCGG |
| SEQ ID NO: 6908 | NTC | CATTCGGTCCGTTCATCTCG |
| SEQ ID NO: 6909 | NTC | CATTCTCTGACGAATGCGCC |
| SEQ ID NO: 6910 | NTC | CATTGTAGACTCGTACGGAT |
| SEQ ID NO: 6911 | NTC | CATTTCCGGGGTCCGATGCA |
| SEQ ID NO: 6912 | NTC | CCAACATCGGGGCGCATAAT |
| SEQ ID NO: 6913 | NTC | CCAACCCGGCATCGTCCGCT |
| SEQ ID NO: 6914 | NTC | CCAACCTAAGGCAATACGGT |
| SEQ ID NO: 6915 | NTC | CCAAGGCGCACGCTACGTGG |
| SEQ ID NO: 6916 | NTC | CCAGCGGACGGCGAACTCCA |
| SEQ ID NO: 6917 | NTC | CCAGCTAACGTTTTAGTACG |
| SEQ ID NO: 6918 | NTC | CCATCGGTTCGACTTACCGC |
| SEQ ID NO: 6919 | NTC | CCATTAGTACGAACATTGCG |
| SEQ ID NO: 6920 | NTC | CCCACTTAATAACGCCGCTT |
| SEQ ID NO: 6921 | NTC | CCCATCATTCGCGCTGACGT |
| SEQ ID NO: 6922 | NTC | CCCATTCAACACCGTTTGTA |
| SEQ ID NO: 6923 | NTC | CCCCTATAGGCGCGCTAAGG |

TABLE 1-continued mmSurf sgRNA library sequences

| SEQ ID NO | id_gRNA Target | Sequence |
|---|---|---|
| SEQ ID NO: 6924 | NTC | CCCCTTCGATATCCGATGAC |
| SEQ ID NO: 6925 | NTC | CCCGCCTGGCGATTCACGGG |
| SEQ ID NO: 6926 | NTC | CCCGGCAGACTAACTAGCGC |
| SEQ ID NO: 6927 | NTC | CCCGGGTACACCAATAGCCA |
| SEQ ID NO: 6928 | NTC | CCCGGTCGGGGATACTAACT |
| SEQ ID NO: 6929 | NTC | CCCGTAGGGGTCGTGGTTTT |
| SEQ ID NO: 6930 | NTC | CCCTAAACCATAGTTTCGCC |
| SEQ ID NO: 6931 | NTC | CCCTAGCTCGGTTAGAGAAT |
| SEQ ID NO: 6932 | NTC | CCCTATATGCGAGATCCATA |
| SEQ ID NO: 6933 | NTC | CCCTCGGTTGAGCAGCGCGA |
| SEQ ID NO: 6934 | NTC | CCCTGATGTGCTATACGCGC |
| SEQ ID NO: 6935 | NTC | CCCTTAAAGTGACGGACGAA |
| SEQ ID NO: 6936 | NTC | CCGACCGTGTGAGAGTACGT |
| SEQ ID NO: 6937 | NTC | CCGACTGCCGAGCTAGGCGT |
| SEQ ID NO: 6938 | NTC | CCGAGAGGTACTCCAATTCG |
| SEQ ID NO: 6939 | NTC | CCGAGATGGCTCGGATAGAC |
| SEQ ID NO: 6940 | NTC | CCGAGCACCCTATTTATCTA |
| SEQ ID NO: 6941 | NTC | CCGAGCCGAATTGGGCGTGT |
| SEQ ID NO: 6942 | NTC | CCGATACCATTGTCACCAAT |
| SEQ ID NO: 6943 | NTC | CCGCACCGCAGTCATGGTAA |
| SEQ ID NO: 6944 | NTC | CCGCCCCTGCGAACTGCGTT |
| SEQ ID NO: 6945 | NTC | CCGCCCGGGTGTGAGTTGAG |
| SEQ ID NO: 6946 | NTC | CCGCGCATTAACGATCAGTA |
| SEQ ID NO: 6947 | NTC | CCGCGCCGTTAGGGAACGAG |
| SEQ ID NO: 6948 | NTC | CCGCGTGACGCAATCCCTTG |
| SEQ ID NO: 6949 | NTC | CCGCTTGGGCGCTATTAATT |
| SEQ ID NO: 6950 | NTC | CCGGACTTGTTATACTTGAT |
| SEQ ID NO: 6951 | NTC | CCGGAGCGCGTTGCAGTTCT |
| SEQ ID NO: 6952 | NTC | CCGGATCGGCTACGCTACGG |
| SEQ ID NO: 6953 | NTC | CCGGCGCTGCGGTCGGCTTG |
| SEQ ID NO: 6954 | NTC | CCGGCTTGAATACCGTGCGG |
| SEQ ID NO: 6955 | NTC | CCGGGCGCCGTATCCCCTAC |
| SEQ ID NO: 6956 | NTC | CCGGTTTATAAATTACGTGG |
| SEQ ID NO: 6957 | NTC | CCGTATACGTATCTATGCCG |
| SEQ ID NO: 6958 | NTC | CCGTCGAGCAATCCCGCCAA |
| SEQ ID NO: 6959 | NTC | CCGTGATTTCGGTAGCGTAC |
| SEQ ID NO: 6960 | NTC | CCGTTCAATTATGCTGGCGT |
| SEQ ID NO: 6961 | NTC | CCGTTCTGACGACGCTAAAG |

TABLE 1-continued mmSurf sgRNA library sequences

| SEQ ID NO | id_gRNA Target | Sequence |
|---|---|---|
| SEQ ID NO: 6962 | NTC | CCGTTTCGCCTATTGGTGCG |
| SEQ ID NO: 6963 | NTC | CCTAACTCGAAGTCTCGTCA |
| SEQ ID NO: 6964 | NTC | CCTACTAACGACGAGTCAAA |
| SEQ ID NO: 6965 | NTC | CCTATTAGTCCGGTTTAGTC |
| SEQ ID NO: 6966 | NTC | CCTCAAATAGCGAACGTCAA |
| SEQ ID NO: 6967 | NTC | CCTCCAGTAGCGTCATTAAC |
| SEQ ID NO: 6968 | NTC | CCTCCTTCAGTTCGATCTGG |
| SEQ ID NO: 6969 | NTC | CCTGCTATTCTCGCATGCGA |
| SEQ ID NO: 6970 | NTC | CCTTACGGCGGAGAACGAGT |
| SEQ ID NO: 6971 | NTC | CCTTAGACCGGGTGTACCTC |
| SEQ ID NO: 6972 | NTC | CCTTCGGATTCGTAGGCTGG |
| SEQ ID NO: 6973 | NTC | CCTTGTGGCGTGCCAAACGA |
| SEQ ID NO: 6974 | NTC | CCTTTGATGGGCGCGTACTC |
| SEQ ID NO: 6975 | NTC | CGAAACCATACCTCCTTCGA |
| SEQ ID NO: 6976 | NTC | CGAAAGGCCCGACTGCGTGG |
| SEQ ID NO: 6977 | NTC | CGAACTTCTACCGTTGTGCG |
| SEQ ID NO: 6978 | NTC | CGAAGTACACGGTTCTCTCG |
| SEQ ID NO: 6979 | NTC | CGAATCGGGAAGGCGCGTGT |
| SEQ ID NO: 6980 | NTC | CGAATGCACAGGCTCGCGGT |
| SEQ ID NO: 6981 | NTC | CGAATGCGCCGGAGAATATT |
| SEQ ID NO: 6982 | NTC | CGACACGATGGTCATACTAC |
| SEQ ID NO: 6983 | NTC | CGACACTTGGGCTGACGCGC |
| SEQ ID NO: 6984 | NTC | CGACGACCCATTTCGGTTAT |
| SEQ ID NO: 6985 | NTC | CGACGACCTTGGATTGGCAG |
| SEQ ID NO: 6986 | NTC | CGACGGTTGTGCTGAGGCTT |
| SEQ ID NO: 6987 | NTC | CGACTATTGCCGTCCATCTC |
| SEQ ID NO: 6988 | NTC | CGACTCCGGGAATATCCGTT |
| SEQ ID NO: 6989 | NTC | CGACTCGCTTAACCGTGCAG |
| SEQ ID NO: 6990 | NTC | CGAGACGAATCCATCATGCG |
| SEQ ID NO: 6991 | NTC | CGAGAGAATCGTCCGTCATA |
| SEQ ID NO: 6992 | NTC | CGAGCCTCGTCTTTCATGGG |
| SEQ ID NO: 6993 | NTC | CGAGCTCGGCAAATTTGATT |
| SEQ ID NO: 6994 | NTC | CGAGGATGTACATACGTAAA |
| SEQ ID NO: 6995 | NTC | CGAGGCTTAACGCCAGATTC |
| SEQ ID NO: 6996 | NTC | CGAGTAATTATTTGCGGTCG |
| SEQ ID NO: 6997 | NTC | CGAGTATCAGCATGTCGACG |
| SEQ ID NO: 6998 | NTC | CGATACGCTATAGAATAGTC |
| SEQ ID NO: 6999 | NTC | CGATGTCGAAAGTCGGTCAA |

TABLE 1-continued mmSurf sgRNA library sequences

| SEQ ID NO | id_gRNA Target | Sequence |
|---|---|---|
| SEQ ID NO: 7000 | NTC | CGATTGACGTTGGGCTCTCA |
| SEQ ID NO: 7001 | NTC | CGCACTTCTAGTAGCTGTCG |
| SEQ ID NO: 7002 | NTC | CGCAGAGTTCAAATCCGCGC |
| SEQ ID NO: 7003 | NTC | CGCATAGTGTACCGTTGCGC |
| SEQ ID NO: 7004 | NTC | CGCCAATGGTGGCCGACTCG |
| SEQ ID NO: 7005 | NTC | CGCCAGTATACCACATTCGT |
| SEQ ID NO: 7006 | NTC | CGCCCCTAGTTGTCCCGCCC |
| SEQ ID NO: 7007 | NTC | CGCCGGATGACTGGTGGATA |
| SEQ ID NO: 7008 | NTC | CGCCTAGTATCTTCGGGGAT |
| SEQ ID NO: 7009 | NTC | CGCGACGTACGGCTGGAGCA |
| SEQ ID NO: 7010 | NTC | CGCGCCGAGGGCCTCGTTAC |
| SEQ ID NO: 7011 | NTC | CGCGCCTACCCTTTTACCGC |
| SEQ ID NO: 7012 | NTC | CGCGCGACTGCAGCTAATCT |
| SEQ ID NO: 7013 | NTC | CGCGCGGATATTTAAACTTC |
| SEQ ID NO: 7014 | NTC | CGCGCGGATCTTCCGTACAA |
| SEQ ID NO: 7015 | NTC | CGCGTATATGTCACACGGCA |
| SEQ ID NO: 7016 | NTC | CGCTACAGTAATCGCAACGA |
| SEQ ID NO: 7017 | NTC | CGCTCCGTATCCTCTCATAA |
| SEQ ID NO: 7018 | NTC | CGCTCGGTAAGGTCGATTGG |
| SEQ ID NO: 7019 | NTC | CGCTCGGTGACGTATACACG |
| SEQ ID NO: 7020 | NTC | CGCTTCATTGCCCGAACGCT |
| SEQ ID NO: 7021 | NTC | CGCTTCGTCTCTCGCAAACA |
| SEQ ID NO: 7022 | NTC | CGGAATACGCCAAAACCTAT |
| SEQ ID NO: 7023 | NTC | CGGACTTACCGCAGATTATA |
| SEQ ID NO: 7024 | NTC | CGGATCCGGTACGGTCAGTT |
| SEQ ID NO: 7025 | NTC | CGGATCCTCCCGTACTATCC |
| SEQ ID NO: 7026 | NTC | CGGCAAGCGCATTCCTATGG |
| SEQ ID NO: 7027 | NTC | CGGCAATGTGTGGCGACCGC |
| SEQ ID NO: 7028 | NTC | CGGCCGTAGTGACGAATGGA |
| SEQ ID NO: 7029 | NTC | CGGCGATAACAGCGACATCG |
| SEQ ID NO: 7030 | NTC | CGGGCAATATGATCGTAGGC |
| SEQ ID NO: 7031 | NTC | CGGGCACTAACCCGATACAC |
| SEQ ID NO: 7032 | NTC | CGGGCGGTAAGAGCTCTACG |
| SEQ ID NO: 7033 | NTC | CGGGCGTCACCTGCTAGTAA |
| SEQ ID NO: 7034 | NTC | CGGGGCGTACATGTGTGGCC |
| SEQ ID NO: 7035 | NTC | CGGGTTATAGATAGTCGTCG |
| SEQ ID NO: 7036 | NTC | CGGTAAGATGGTTATACCGT |
| SEQ ID NO: 7037 | NTC | CGGTAAGGTCGGTCTCCATC |

TABLE 1-continued mmSurf sgRNA library sequences

| SEQ ID NO | id_gRNA Target | Sequence |
|---|---|---|
| SEQ ID NO: 7038 | NTC | CGGTACCACGCCCCACCTCG |
| SEQ ID NO: 7039 | NTC | CGGTCAGTCGTCTTCCCGGA |
| SEQ ID NO: 7040 | NTC | CGGTCGATTGTGGAGTAATG |
| SEQ ID NO: 7041 | NTC | CGGTCGTGACAGACCTGGTG |
| SEQ ID NO: 7042 | NTC | CGGTGAGGATCCCTCTTGCG |
| SEQ ID NO: 7043 | NTC | CGTAAACCATAACGTTGGTC |
| SEQ ID NO: 7044 | NTC | CGTAACCGGAGATAATATTA |
| SEQ ID NO: 7045 | NTC | CGTACCGACAGTAGTCCAAG |
| SEQ ID NO: 7046 | NTC | CGTACGGGCGCGCCGTCCAT |
| SEQ ID NO: 7047 | NTC | CGTAGATGCCTGCTCGAGCA |
| SEQ ID NO: 7048 | NTC | CGTCAATGTGTCCGGACGGT |
| SEQ ID NO: 7049 | NTC | CGTCACCGCTAGTAATGATG |
| SEQ ID NO: 7050 | NTC | CGTCATGGCAAGATCGATAA |
| SEQ ID NO: 7051 | NTC | CGTCCTCGCAGCGTAGACTG |
| SEQ ID NO: 7052 | NTC | CGTCGAAGATACGCAGGCTG |
| SEQ ID NO: 7053 | NTC | CGTCGATCCCTCTATACTGG |
| SEQ ID NO: 7054 | NTC | CGTCGCATGTTGTTGCTCAT |
| SEQ ID NO: 7055 | NTC | CGTGAATCGACCCTCAATAA |
| SEQ ID NO: 7056 | NTC | CGTGATTCCTAAGCCCCCGC |
| SEQ ID NO: 7057 | NTC | CGTGCGTTCGTAATAAAAGG |
| SEQ ID NO: 7058 | NTC | CGTGTAGTCGGGTCGCATGT |
| SEQ ID NO: 7059 | NTC | CGTGTGTTTACAGCCCTTAC |
| SEQ ID NO: 7060 | NTC | CGTGTTTGGCGGCCAACTTT |
| SEQ ID NO: 7061 | NTC | CGTGTTTTACCTCGCTTCGA |
| SEQ ID NO: 7062 | NTC | CGTTAATAAACGCGGTTTCA |
| SEQ ID NO: 7063 | NTC | CGTTAATCCACCGTATGGGC |
| SEQ ID NO: 7064 | NTC | CGTTACGTTTCTTGCCAGGA |
| SEQ ID NO: 7065 | NTC | CGTTAGACCGAATCTCCGGG |
| SEQ ID NO: 7066 | NTC | CGTTATATCTACACTTTGCG |
| SEQ ID NO: 7067 | NTC | CGTTATTGTACACCACGCTC |
| SEQ ID NO: 7068 | NTC | CGTTGCGAATCCACCCTATT |
| SEQ ID NO: 7069 | NTC | CGTTGTTTGGAGCCCGTCCA |
| SEQ ID NO: 7070 | NTC | CTAACAGCGCCGTTATCTAC |
| SEQ ID NO: 7071 | NTC | CTAACGTGGTAGCACTACAA |
| SEQ ID NO: 7072 | NTC | CTAAGTCGACTGTTTCGACC |
| SEQ ID NO: 7073 | NTC | CTAATACACCCGGACGGTAC |
| SEQ ID NO: 7074 | NTC | CTAATACACTCCTTCTCCGC |
| SEQ ID NO: 7075 | NTC | CTAATTCCAATATCCGTCTG |

TABLE 1-continued mmSurf sgRNA library sequences

| SEQ ID NO | id_gRNA Target | Sequence |
|---|---|---|
| SEQ ID NO: 7076 | NTC | CTACCCCGCTGTGCAACGT |
| SEQ ID NO: 7077 | NTC | CTACCCGTCTATTACGATCT |
| SEQ ID NO: 7078 | NTC | CTACCGGTCACGTTGTGACC |
| SEQ ID NO: 7079 | NTC | CTACGAGATTCGGCTAAGCT |
| SEQ ID NO: 7080 | NTC | CTACGAGGGCCGCGAGCGGT |
| SEQ ID NO: 7081 | NTC | CTACGGATAGGCGCGGGTGA |
| SEQ ID NO: 7082 | NTC | CTACTTGTGACGACCTCGCG |
| SEQ ID NO: 7083 | NTC | CTATCGGCCCGCAGTGATGG |
| SEQ ID NO: 7084 | NTC | CTATTGGGAGCGGCCTCTCG |
| SEQ ID NO: 7085 | NTC | CTCAAACCTCCGTTACCCCG |
| SEQ ID NO: 7086 | NTC | CTCATGTACGCCTTCGCTAC |
| SEQ ID NO: 7087 | NTC | CTCCCATCCCCGTAGCGGCC |
| SEQ ID NO: 7088 | NTC | CTCCGACGACTACGCAAGGA |
| SEQ ID NO: 7089 | NTC | CTCCGGACGTGCATCCGAGA |
| SEQ ID NO: 7090 | NTC | CTCCTCGAGGCTGGCTACGT |
| SEQ ID NO: 7091 | NTC | CTCGACCCAGTAGTAGACGG |
| SEQ ID NO: 7092 | NTC | CTCGATGCCACGGAAGGCGG |
| SEQ ID NO: 7093 | NTC | CTCGGACGGCATACGACAAT |
| SEQ ID NO: 7094 | NTC | CTCGGAGATTCGTTAGAAGA |
| SEQ ID NO: 7095 | NTC | CTCGGATGGTGTGTTGAACC |
| SEQ ID NO: 7096 | NTC | CTCGGCTTTACGATCGATCA |
| SEQ ID NO: 7097 | NTC | CTCGGGCTATTCAGCGATAG |
| SEQ ID NO: 7098 | NTC | CTCGTATAGTATTGCGTGGT |
| SEQ ID NO: 7099 | NTC | CTCGTATCTTTTCCCACGGC |
| SEQ ID NO: 7100 | NTC | CTCGTCGGCTTTCGTGCTGC |
| SEQ ID NO: 7101 | NTC | CTCGTGAAACAAGATCCGAC |
| SEQ ID NO: 7102 | NTC | CTCGTGAACCTGTTCGCGCA |
| SEQ ID NO: 7103 | NTC | CTCGTGTCACTCCTCGGTTC |
| SEQ ID NO: 7104 | NTC | CTCTAATAAACCGCACAAGC |
| SEQ ID NO: 7105 | NTC | CTCTCTGCGAGTCGATGATT |
| SEQ ID NO: 7106 | NTC | CTGATCGGTGCATATCTCGG |
| SEQ ID NO: 7107 | NTC | CTGCACGGCACGACATCCAA |
| SEQ ID NO: 7108 | NTC | CTGCGTGTAACGTGTTGGGA |
| SEQ ID NO: 7109 | NTC | CTGCTTGAACGCCTAGACGG |
| SEQ ID NO: 7110 | NTC | CTGGGGCCGCTGAACCGCCG |
| SEQ ID NO: 7111 | NTC | CTGTCTTCAACGTCTGGCCG |
| SEQ ID NO: 7112 | NTC | CTTAAGTTCGCGACGGAATG |
| SEQ ID NO: 7113 | NTC | CTTATCCATAATAGGCGGCG |

TABLE 1-continued mmSurf sgRNA library sequences

| SEQ ID NO | id_gRNA Target | Sequence |
| --- | --- | --- |
| SEQ ID NO: 7114 | NTC | CTTATCGATTTGGGTTCAAC |
| SEQ ID NO: 7115 | NTC | CTTCACGCCTTGGACCGATA |
| SEQ ID NO: 7116 | NTC | CTTGAAAAAGGGGCGACTAT |
| SEQ ID NO: 7117 | NTC | CTTGACACCTCGTCCGCATC |
| SEQ ID NO: 7118 | NTC | CTTTAGTCACGATATACGTC |
| SEQ ID NO: 7119 | NTC | CTTTATACCGCGCGTCGGCA |
| SEQ ID NO: 7120 | NTC | CTTTATTCCGTTGCATGTCG |
| SEQ ID NO: 7121 | NTC | CTTTGGCGTCGAGAAGCGCA |
| SEQ ID NO: 7122 | NTC | GAACCACGAGCGAGCGTATA |
| SEQ ID NO: 7123 | NTC | GAACCAGTATCTAACCCGAC |
| SEQ ID NO: 7124 | NTC | GAACCCGGGAAACACGTCCG |
| SEQ ID NO: 7125 | NTC | GAACCGGCGTGCGTTAGCGG |
| SEQ ID NO: 7126 | NTC | GAACCTTCGCGCAACTTAAC |
| SEQ ID NO: 7127 | NTC | GAACGTAACGGCATGCATCA |
| SEQ ID NO: 7128 | NTC | GAACTCGTTAGGCCGTGAAG |
| SEQ ID NO: 7129 | NTC | GAATTGAGCCGCAACTCGGC |
| SEQ ID NO: 7130 | NTC | GACAATCGACACGCCGCTTC |
| SEQ ID NO: 7131 | NTC | GACAGCCGGTTGACCGGGTC |
| SEQ ID NO: 7132 | NTC | GACAGTTGACGCGACGGAGA |
| SEQ ID NO: 7133 | NTC | GACAGTTGGATAACCGTGTC |
| SEQ ID NO: 7134 | NTC | GACCAACCTTACGGTAACTC |
| SEQ ID NO: 7135 | NTC | GACCACTATGTACTTATCGC |
| SEQ ID NO: 7136 | NTC | GACCATACGCCTCGTATGCC |
| SEQ ID NO: 7137 | NTC | GACCGACGGTATACCCTACT |
| SEQ ID NO: 7138 | NTC | GACCGGCCAACGGTAGCGGC |
| SEQ ID NO: 7139 | NTC | GACCGGTGTGTTTACGCGTG |
| SEQ ID NO: 7140 | NTC | GACCGTCGGGATCCTTAATT |
| SEQ ID NO: 7141 | NTC | GACCTCGCAATTGAGCGCTC |
| SEQ ID NO: 7142 | NTC | GACGAAAGGTCCTACGAAGT |
| SEQ ID NO: 7143 | NTC | GACGGTCCCCCCTATGAAAT |
| SEQ ID NO: 7144 | NTC | GACGTATTGGATTCGCAACC |
| SEQ ID NO: 7145 | NTC | GACGTCTAATTTCTGGCCGT |
| SEQ ID NO: 7146 | NTC | GACTAGCACGAACTGCGGTT |
| SEQ ID NO: 7147 | NTC | GACTCCGGGTACTAAATGTC |
| SEQ ID NO: 7148 | NTC | GACTTCGACGAGAAAACGTT |
| SEQ ID NO: 7149 | NTC | GAGACCCATTATGATCCTAG |
| SEQ ID NO: 7150 | NTC | GAGATTAAATTAACGCCGGC |
| SEQ ID NO: 7151 | NTC | GAGATTCGATACTGCGGTCA |

TABLE 1-continued mmSurf sgRNA library sequences

| SEQ ID NO | id_gRNA Target | Sequence |
|---|---|---|
| SEQ ID NO: 7152 | NTC | GAGCCCCAACGCGCGAAGCA |
| SEQ ID NO: 7153 | NTC | GAGCGCCAAGCGTGCGTTGA |
| SEQ ID NO: 7154 | NTC | GAGCGCGGGCCAGCGAACGT |
| SEQ ID NO: 7155 | NTC | GAGCGTCCCGTGATTTAAAG |
| SEQ ID NO: 7156 | NTC | GAGCTAATCTGTAGACGTCG |
| SEQ ID NO: 7157 | NTC | GAGGACCTAGGTTCCCGGAT |
| SEQ ID NO: 7158 | NTC | GAGGCGGGCTCTTCTATCGT |
| SEQ ID NO: 7159 | NTC | GAGGCGTACTTCGGCTCTAA |
| SEQ ID NO: 7160 | NTC | GAGTCGAGTTAATAACGCTC |
| SEQ ID NO: 7161 | NTC | GATAAGACTCCGCGAGCTTC |
| SEQ ID NO: 7162 | NTC | GATACGTGAGGTTGCCGGTG |
| SEQ ID NO: 7163 | NTC | GATAGAACAACAGCGGTGCA |
| SEQ ID NO: 7164 | NTC | GATATTTACCGGCGATAAGA |
| SEQ ID NO: 7165 | NTC | GATCACTCCCGAAAGTAGTG |
| SEQ ID NO: 7166 | NTC | GATCCCCTACGCTTCAACCT |
| SEQ ID NO: 7167 | NTC | GATCGAGTGACACCCACCCG |
| SEQ ID NO: 7168 | NTC | GATCTTACCACTCGTCGTAG |
| SEQ ID NO: 7169 | NTC | GATGCGGACCCACGTTAAGC |
| SEQ ID NO: 7170 | NTC | GATGCGGGTGGAAAACGTTA |
| SEQ ID NO: 7171 | NTC | GATGGCCAGTAACGGCGTCA |
| SEQ ID NO: 7172 | NTC | GATTACGGGGTTCCGTAACT |
| SEQ ID NO: 7173 | NTC | GATTCATTATCGGCATACGG |
| SEQ ID NO: 7174 | NTC | GATTCCGTATAGTAATCGAG |
| SEQ ID NO: 7175 | NTC | GATTGAGAAGCCGCGGTATC |
| SEQ ID NO: 7176 | NTC | GATTGGACGGTCGCAGGATA |
| SEQ ID NO: 7177 | NTC | GATTTCTCGTATCGGATAAC |
| SEQ ID NO: 7178 | NTC | GCAAAAAGCGGACACGCGAC |
| SEQ ID NO: 7179 | NTC | GCAAATAGGTCGGAGCGTGT |
| SEQ ID NO: 7180 | NTC | GCAACCCACGGACGGCACCG |
| SEQ ID NO: 7181 | NTC | GCAACGGACAGTCATCGAAC |
| SEQ ID NO: 7182 | NTC | GCAATAGTCGCACGGGTGAT |
| SEQ ID NO: 7183 | NTC | GCAATTCTGCAACGCACGTC |
| SEQ ID NO: 7184 | NTC | GCACCTCTAGCGCGCTCGGC |
| SEQ ID NO: 7185 | NTC | GCACGAACCCGTTCGTATGG |
| SEQ ID NO: 7186 | NTC | GCAGAGCGTAATCGGCATCG |
| SEQ ID NO: 7187 | NTC | GCAGGGTTATTCCGCTTCTA |
| SEQ ID NO: 7188 | NTC | GCAGGTAGGCTCGATACTTG |
| SEQ ID NO: 7189 | NTC | GCATAACGGCCGAGCACCAC |

TABLE 1-continued mmSurf sgRNA library sequences

| SEQ ID NO | id_gRNA Target | Sequence |
|---|---|---|
| SEQ ID NO: 7190 | NTC | GCATGCGCTCGCGTGGACTG |
| SEQ ID NO: 7191 | NTC | GCATTAAGACGCCCACATAT |
| SEQ ID NO: 7192 | NTC | GCATTCCCGCTTACGTAATT |
| SEQ ID NO: 7193 | NTC | GCATTCTTGAGCTCCGCGCC |
| SEQ ID NO: 7194 | NTC | GCATTGGTGCTCGCGCGTTC |
| SEQ ID NO: 7195 | NTC | GCCACGACCTGCGAATAATT |
| SEQ ID NO: 7196 | NTC | GCCACTCCGCTCGTTCTAGA |
| SEQ ID NO: 7197 | NTC | GCCAGCCTCGGTATAACTCG |
| SEQ ID NO: 7198 | NTC | GCCATAGCCAATCGCTAGTT |
| SEQ ID NO: 7199 | NTC | GCCCATGACGCGTGTTAGTA |
| SEQ ID NO: 7200 | NTC | GCCCGACCTCCACGTAAATC |
| SEQ ID NO: 7201 | NTC | GCCCGAGCGGATTCACCGCG |
| SEQ ID NO: 7202 | NTC | GCCCGATAGAATTACCCATT |
| SEQ ID NO: 7203 | NTC | GCCCGTTGTGAGCGGCATGC |
| SEQ ID NO: 7204 | NTC | GCCCTCGAGCTCACGATGAG |
| SEQ ID NO: 7205 | NTC | GCCGAATCGCGTTATTCCAA |
| SEQ ID NO: 7206 | NTC | GCCGACCAACGATGACCACG |
| SEQ ID NO: 7207 | NTC | GCCGAGAGGCGTAAGCGCGA |
| SEQ ID NO: 7208 | NTC | GCCGCAACGTTAGATGTATA |
| SEQ ID NO: 7209 | NTC | GCCGCGCCATAATATGCCAT |
| SEQ ID NO: 7210 | NTC | GCCGCTCTTGATAACGACGC |
| SEQ ID NO: 7211 | NTC | GCCGTAAGCGGGCCGGTTGA |
| SEQ ID NO: 7212 | NTC | GCCGTTGGAAAACTCCGGCC |
| SEQ ID NO: 7213 | NTC | GCCTATGTGAATCGCGAATT |
| SEQ ID NO: 7214 | NTC | GCCTTCCTCGCAGACCCGAC |
| SEQ ID NO: 7215 | NTC | GCCTTTTCCGCCCGTTCAAG |
| SEQ ID NO: 7216 | NTC | GCGACAAGCGTTGAGTTCGC |
| SEQ ID NO: 7217 | NTC | GCGACGTGTATCGATCACTC |
| SEQ ID NO: 7218 | NTC | GCGAGCGCTATCCCGGTGGA |
| SEQ ID NO: 7219 | NTC | GCGAGGTATTCGGCTCCGCG |
| SEQ ID NO: 7220 | NTC | GCGAGTTATTTCGCTATAGG |
| SEQ ID NO: 7221 | NTC | GCGATCGCCGGTATAGCTTT |
| SEQ ID NO: 7222 | NTC | GCGATTATCAGTAGTCCACG |
| SEQ ID NO: 7223 | NTC | GCGCCTAGGGTTCCGACTCA |
| SEQ ID NO: 7224 | NTC | GCGCGAGGGCACCGACAAGT |
| SEQ ID NO: 7225 | NTC | GCGCGAGTGCCAAACGAGTG |
| SEQ ID NO: 7226 | NTC | GCGCGCGTGGATCACCCGCA |
| SEQ ID NO: 7227 | NTC | GCGCGTACATATAAATAGGT |

TABLE 1-continued mmSurf sgRNA library sequences

| SEQ ID NO | id_gRNA Target | Sequence |
|---|---|---|
| SEQ ID NO: 7228 | NTC | GCGCTACTCCCACCGATGTT |
| SEQ ID NO: 7229 | NTC | GCGCTCGAACAAACATGGTC |
| SEQ ID NO: 7230 | NTC | GCGCTCGTTCGAGACGATCT |
| SEQ ID NO: 7231 | NTC | GCGGATCTGACGGTTACTTA |
| SEQ ID NO: 7232 | NTC | GCGGCCCGTGACCGTTCAAT |
| SEQ ID NO: 7233 | NTC | GCGGGACCCCCGGTATAGTC |
| SEQ ID NO: 7234 | NTC | GCGGTTACCGCGAAAACCAT |
| SEQ ID NO: 7235 | NTC | GCGTACCTATCGATAAACCA |
| SEQ ID NO: 7236 | NTC | GCGTATCTACCCTACCGCCG |
| SEQ ID NO: 7237 | NTC | GCGTGACGCGATCAAACGGT |
| SEQ ID NO: 7238 | NTC | GCGTGACGTCCCACCCTGAG |
| SEQ ID NO: 7239 | NTC | GCGTGAGATTCGTTGCTCGA |
| SEQ ID NO: 7240 | NTC | GCGTGCCATGGGAGGCCGTT |
| SEQ ID NO: 7241 | NTC | GCGTGGAGTTCGTCGCTCTT |
| SEQ ID NO: 7242 | NTC | GCGTGGTACTCACATCGCGA |
| SEQ ID NO: 7243 | NTC | GCTAAAAACAACCGGCGCGG |
| SEQ ID NO: 7244 | NTC | GCTAAACGTATTTTACGGGC |
| SEQ ID NO: 7245 | NTC | GCTAAGATTCATCCGAACAC |
| SEQ ID NO: 7246 | NTC | GCTAATCGGTACTACTCCGG |
| SEQ ID NO: 7247 | NTC | GCTACAGATTTGCGTTCGAG |
| SEQ ID NO: 7248 | NTC | GCTAGCGTTCAGCCCGATGT |
| SEQ ID NO: 7249 | NTC | GCTAGTTCTCCCGGGCGAAA |
| SEQ ID NO: 7250 | NTC | GCTATTCCGCTCGTCAATTT |
| SEQ ID NO: 7251 | NTC | GCTCATACTGATGAACGTCC |
| SEQ ID NO: 7252 | NTC | GCTCCAGGTGCGAGATAGGC |
| SEQ ID NO: 7253 | NTC | GCTCGAAAGTACGCTTCCTT |
| SEQ ID NO: 7254 | NTC | GCTCGCTGATGTGTAATCCG |
| SEQ ID NO: 7255 | NTC | GCTCGGACCTTTTAGACGTC |
| SEQ ID NO: 7256 | NTC | GCTGATTAGACCCGGCGTAA |
| SEQ ID NO: 7257 | NTC | GCTTACCTACTCCGCCCCGC |
| SEQ ID NO: 7258 | NTC | GCTTATCGTCATGCGGGTGA |
| SEQ ID NO: 7259 | NTC | GCTTATCGTTCCGCTACGAT |
| SEQ ID NO: 7260 | NTC | GCTTCATTATTAACCGGCGT |
| SEQ ID NO: 7261 | NTC | GCTTCGACCACGGGTACTGC |
| SEQ ID NO: 7262 | NTC | GCTTCGGAGGCTACGTAGTA |
| SEQ ID NO: 7263 | NTC | GCTTCTACTCGCAACGTATT |
| SEQ ID NO: 7264 | NTC | GCTTGAGGCAACGCGACTGA |
| SEQ ID NO: 7265 | NTC | GCTTGTAATCTAAAGACGCG |

TABLE 1-continued mmSurf sgRNA library sequences

| SEQ ID NO | id_gRNA Target | Sequence |
|---|---|---|
| SEQ ID NO: 7266 | NTC | GCTTTCACGGAGGTTCGACG |
| SEQ ID NO: 7267 | NTC | GGAAACGTTACATTCGACGC |
| SEQ ID NO: 7268 | NTC | GGAAACTCTTGCTCGACACG |
| SEQ ID NO: 7269 | NTC | GGACACTCGCCGACCCCACT |
| SEQ ID NO: 7270 | NTC | GGACCAATGTTACCGTAGGT |
| SEQ ID NO: 7271 | NTC | GGACGGATGGGACGACTAGT |
| SEQ ID NO: 7272 | NTC | GGACGTAGATTAGGGCGTAA |
| SEQ ID NO: 7273 | NTC | GGACTGAAACCGATAGTATC |
| SEQ ID NO: 7274 | NTC | GGAGTCTCACGCAATTAGCG |
| SEQ ID NO: 7275 | NTC | GGAGTTCAAGCGTAACTTCG |
| SEQ ID NO: 7276 | NTC | GGATACATCGGCGCGCTAGT |
| SEQ ID NO: 7277 | NTC | GGATAGCCCGGTTGGTGCGT |
| SEQ ID NO: 7278 | NTC | GGATATTCGCGCGGTCTTCA |
| SEQ ID NO: 7279 | NTC | GGATCGATCCGAGGAACGTG |
| SEQ ID NO: 7280 | NTC | GGATTCGTGCGGGAGATACG |
| SEQ ID NO: 7281 | NTC | GGATTGACGAGACGATATCG |
| SEQ ID NO: 7282 | NTC | GGCAACGCACGCTGGGTTGT |
| SEQ ID NO: 7283 | NTC | GGCACCGCGTTTATTGCACT |
| SEQ ID NO: 7284 | NTC | GGCACCGTTCGGAAACCGAC |
| SEQ ID NO: 7285 | NTC | GGCAGCCTAATCAGTCGAGG |
| SEQ ID NO: 7286 | NTC | GGCCAGTGTGGCCGTTACGC |
| SEQ ID NO: 7287 | NTC | GGCCCAACGAAACTAGCGTG |
| SEQ ID NO: 7288 | NTC | GGCCCGAAGGGTCACAAGCG |
| SEQ ID NO: 7289 | NTC | GGCGCTACTGTAATGACGGT |
| SEQ ID NO: 7290 | NTC | GGCGGGTTAGGCCCCGTTTT |
| SEQ ID NO: 7291 | NTC | GGCGTCGTAACAAGAACTTG |
| SEQ ID NO: 7292 | NTC | GGCTTATAGACGAGACTCGA |
| SEQ ID NO: 7293 | NTC | GGCTTTACGTAAGGAGCGTA |
| SEQ ID NO: 7294 | NTC | GGGACGCTCATCGAGTGACG |
| SEQ ID NO: 7295 | NTC | GGGCAACGTCATCTGGCGAC |
| SEQ ID NO: 7296 | NTC | GGGCCGGCACTCTGTCGGAC |
| SEQ ID NO: 7297 | NTC | GGGCGCGTCATAGACACACG |
| SEQ ID NO: 7298 | NTC | GGGCGGGACGTAATATTATG |
| SEQ ID NO: 7299 | NTC | GGGCTAGTGCGTTGTTACGA |
| SEQ ID NO: 7300 | NTC | GGGGATGGCCTTACGTCGCG |
| SEQ ID NO: 7301 | NTC | GGGGGGTCTAATACCGATTG |
| SEQ ID NO: 7302 | NTC | GGGGTAGGCCTAATTACGGA |
| SEQ ID NO: 7303 | NTC | GGGGTTGGATACGCGATTTA |

TABLE 1-continued mmSurf sgRNA library sequences

| SEQ ID NO | id_gRNA Target | Sequence |
|---|---|---|
| SEQ ID NO: 7304 | NTC | GGGTAGCACCCCGCCGACAC |
| SEQ ID NO: 7305 | NTC | GGGTCGCACCCCAATAGCTG |
| SEQ ID NO: 7306 | NTC | GGGTGCACACGCCGGCCTAT |
| SEQ ID NO: 7307 | NTC | GGTAAAAAGCGTAACGAGTA |
| SEQ ID NO: 7308 | NTC | GGTAACATAGGCGGCGATCT |
| SEQ ID NO: 7309 | NTC | GGTCAAAGCGATGTTAGCCG |
| SEQ ID NO: 7310 | NTC | GGTCGCTCGATTTCATTTAA |
| SEQ ID NO: 7311 | NTC | GGTCTAGATAATCTTACCGA |
| SEQ ID NO: 7312 | NTC | GGTCTCGTAATGTCCTATAT |
| SEQ ID NO: 7313 | NTC | GGTCTGTCCGTTGCGACCAC |
| SEQ ID NO: 7314 | NTC | GGTGCAGTCCGTTTAGTCGG |
| SEQ ID NO: 7315 | NTC | GGTGTGGACCGCTTTTACGC |
| SEQ ID NO: 7316 | NTC | GGTTAAAAATTAAGCGGTCC |
| SEQ ID NO: 7317 | NTC | GTACATGCGGCAAGTCGACT |
| SEQ ID NO: 7318 | NTC | GTACCACTTATCGACCTTGC |
| SEQ ID NO: 7319 | NTC | GTACCATGATAACCGTACTA |
| SEQ ID NO: 7320 | NTC | GTACGCAGGGTGTAGCGACC |
| SEQ ID NO: 7321 | NTC | GTACTGACGTTACGTTCATA |
| SEQ ID NO: 7322 | NTC | GTAGACATATTGCGTAATCG |
| SEQ ID NO: 7323 | NTC | GTAGCTGACCGCTTAACTAA |
| SEQ ID NO: 7324 | NTC | GTAGCTTCATGTCCGGTCGG |
| SEQ ID NO: 7325 | NTC | GTAGGCCGCTGATCGAATAA |
| SEQ ID NO: 7326 | NTC | GTAGTGCGTGTGATGTCGGG |
| SEQ ID NO: 7327 | NTC | GTATCCTCCTTACGGCCCGT |
| SEQ ID NO: 7328 | NTC | GTATCCTCGCAATCGTTAGG |
| SEQ ID NO: 7329 | NTC | GTCAAGCCGAACGCTGCCGG |
| SEQ ID NO: 7330 | NTC | GTCACAAAAAACGAGCGTTA |
| SEQ ID NO: 7331 | NTC | GTCCTAGATCCTATCGGGAG |
| SEQ ID NO: 7332 | NTC | GTCGATTAGATGATGCCCGG |
| SEQ ID NO: 7333 | NTC | GTCGCGTATCCTGACGACAC |
| SEQ ID NO: 7334 | NTC | GTCGCTCGAACTCACGTAGC |
| SEQ ID NO: 7335 | NTC | GTCGGCCGCTTAACCCTTTC |
| SEQ ID NO: 7336 | NTC | GTCGGCTCATCGGAAAATAT |
| SEQ ID NO: 7337 | NTC | GTCGTGGGGCACGATGCGTA |
| SEQ ID NO: 7338 | NTC | GTCGTTAACGACCCGGATTC |
| SEQ ID NO: 7339 | NTC | GTCTAACATCGGCGCACGTG |
| SEQ ID NO: 7340 | NTC | GTGATGGCCACGTCCGAACC |
| SEQ ID NO: 7341 | NTC | GTGCAACGACTGACCCGCGG |

TABLE 1-continued mmSurf sgRNA library sequences

| SEQ ID NO | id_gRNA Target | Sequence |
|---|---|---|
| SEQ ID NO: 7342 | NTC | GTGCCAGCGTCGATTGACGC |
| SEQ ID NO: 7343 | NTC | GTGCCTGATAGTGTGAAGCG |
| SEQ ID NO: 7344 | NTC | GTGCGAATTAACCGTTAGGA |
| SEQ ID NO: 7345 | NTC | GTGCGCGCGTATAGAAAAAA |
| SEQ ID NO: 7346 | NTC | GTGGGCTGACCGTTCTCGAC |
| SEQ ID NO: 7347 | NTC | GTGGTTACGTTAACGACTAC |
| SEQ ID NO: 7348 | NTC | GTGTATGACGAGAAGCGAAG |
| SEQ ID NO: 7349 | NTC | GTGTCTTTCGGTCTTACGAG |
| SEQ ID NO: 7350 | NTC | GTGTGCCTCGACAGCGTAAG |
| SEQ ID NO: 7351 | NTC | GTGTGGTATATCCCCGTTTT |
| SEQ ID NO: 7352 | NTC | GTGTTGTCCGAGAACCCGAC |
| SEQ ID NO: 7353 | NTC | GTTAAGTAGATCGGTGACAT |
| SEQ ID NO: 7354 | NTC | GTTAATATTGTGGCCCGCAC |
| SEQ ID NO: 7355 | NTC | GTTACCCCTTTGGCCGGAAG |
| SEQ ID NO: 7356 | NTC | GTTACCGTGACGATAAGAAT |
| SEQ ID NO: 7357 | NTC | GTTACTTACCTGACCGGCAA |
| SEQ ID NO: 7358 | NTC | GTTATACCACCTACTATGAC |
| SEQ ID NO: 7359 | NTC | GTTATTGCGCCTTGGCCGTA |
| SEQ ID NO: 7360 | NTC | GTTATTTGTCTGTCGAAACG |
| SEQ ID NO: 7361 | NTC | GTTCCGGATATATACGGTTA |
| SEQ ID NO: 7362 | NTC | GTTCGCGGGGCTTCTATCA |
| SEQ ID NO: 7363 | NTC | GTTCGGTTGCAGCTTACACG |
| SEQ ID NO: 7364 | NTC | GTTCTTCAAAGACGGGCGGC |
| SEQ ID NO: 7365 | NTC | GTTGCGGCGACCTAGATATC |
| SEQ ID NO: 7366 | NTC | GTTGCGTCCATTCCGTCGCC |
| SEQ ID NO: 7367 | NTC | GTTGCGTGTGTCCGTACAAA |
| SEQ ID NO: 7368 | NTC | GTTTCAGCGCGAGTTGCGCG |
| SEQ ID NO: 7369 | NTC | GTTTCAGGAACGACGGCGAG |
| SEQ ID NO: 7370 | NTC | GTTTCCCGGGACTGTCGCGT |
| SEQ ID NO: 7371 | NTC | GTTTGCGAGTCAAAGTACGC |
| SEQ ID NO: 7372 | NTC | TAAAAACGCTGGCGGCCTAG |
| SEQ ID NO: 7373 | NTC | TAAAACCGATCACGATACGA |
| SEQ ID NO: 7374 | NTC | TAAAAGTGGTGCGTCGTCGT |
| SEQ ID NO: 7375 | NTC | TAAACGATTCACCGATAACA |
| SEQ ID NO: 7376 | NTC | TAACACGCACTCACGTCCGG |
| SEQ ID NO: 7377 | NTC | TAACAGCTTCCGCGTAATAT |
| SEQ ID NO: 7378 | NTC | TAACCCTTGATCAACCGATA |
| SEQ ID NO: 7379 | NTC | TAACGTTATGTCAAACGCTC |

TABLE 1-continued mmSurf sgRNA library sequences

| SEQ ID NO | id_gRNA Target | Sequence |
|---|---|---|
| SEQ ID NO: 7380 | NTC | TAACTCTAATGCGTTCCAAG |
| SEQ ID NO: 7381 | NTC | TAAGACTGGGTGTCCCGCGT |
| SEQ ID NO: 7382 | NTC | TAAGCGGCGTCATGTCGCCC |
| SEQ ID NO: 7383 | NTC | TAAGTGACACTTCGTATCGT |
| SEQ ID NO: 7384 | NTC | TAATAAACTATGTCCCGCCG |
| SEQ ID NO: 7385 | NTC | TAATGAGTAACGCTCATCGG |
| SEQ ID NO: 7386 | NTC | TAATGCGAATGCGACCTCTC |
| SEQ ID NO: 7387 | NTC | TAATGGAAGATGCGCGATAC |
| SEQ ID NO: 7388 | NTC | TAATGGCACTTACCGGGTCT |
| SEQ ID NO: 7389 | NTC | TAATTCGCAACTCGGATCAT |
| SEQ ID NO: 7390 | NTC | TAATTCTTTAGTACGTGCAA |
| SEQ ID NO: 7391 | NTC | TACACGCCCTAAGCTAGTAA |
| SEQ ID NO: 7392 | NTC | TACAGTTATACGTCGCGGTG |
| SEQ ID NO: 7393 | NTC | TACATCGAACAACCAACCGA |
| SEQ ID NO: 7394 | NTC | TACATGCGGTTGACACGTTC |
| SEQ ID NO: 7395 | NTC | TACCCCTCTGCGATGCCGGT |
| SEQ ID NO: 7396 | NTC | TACCCCTTGAGGGGCGCATA |
| SEQ ID NO: 7397 | NTC | TACGACATCGCATGGTAACG |
| SEQ ID NO: 7398 | NTC | TACGACGAGGACGCATCGAG |
| SEQ ID NO: 7399 | NTC | TACGCTCACTTCTGCGAAGG |
| SEQ ID NO: 7400 | NTC | TACGGACGTCGAATTGAGCA |
| SEQ ID NO: 7401 | NTC | TACGTCTGCGCAAATAGAAT |
| SEQ ID NO: 7402 | NTC | TACTGCGTACCGCAGTAAGC |
| SEQ ID NO: 7403 | NTC | TACTTACCGACCGACAAACG |
| SEQ ID NO: 7404 | NTC | TACTTAGGTCCGCGTAAAGC |
| SEQ ID NO: 7405 | NTC | TAGACGTCCACCGACTCTGA |
| SEQ ID NO: 7406 | NTC | TAGAGCAGATCCCCTCAACG |
| SEQ ID NO: 7407 | NTC | TAGATGGTGCTTCTGTCGCG |
| SEQ ID NO: 7408 | NTC | TAGCCCGTCGAGTACTCCCC |
| SEQ ID NO: 7409 | NTC | TAGCCGAGTTCACGCCAGTA |
| SEQ ID NO: 7410 | NTC | TAGCTGTTTACGCCGACCTG |
| SEQ ID NO: 7411 | NTC | TAGGCCGCTCAGGCCGCACT |
| SEQ ID NO: 7412 | NTC | TAGGCGGACGGTTACATATA |
| SEQ ID NO: 7413 | NTC | TAGGGGTGCGCATTAGACTA |
| SEQ ID NO: 7414 | NTC | TAGGTGGCGCCCAATCGGAC |
| SEQ ID NO: 7415 | NTC | TAGTAAAAAATTCGCCCTCC |
| SEQ ID NO: 7416 | NTC | TAGTAGGCCGGAGCGCATCC |
| SEQ ID NO: 7417 | NTC | TAGTAGGTTGATCGCGTCGC |

TABLE 1-continued mmSurf sgRNA library sequences

| SEQ ID NO | id_gRNA Target | Sequence |
|---|---|---|
| SEQ ID NO: 7418 | NTC | TAGTCAGTCGGCCTCCGTGC |
| SEQ ID NO: 7419 | NTC | TAGTCCTAGTTAGATTCGCG |
| SEQ ID NO: 7420 | NTC | TAGTGCGAACAGTCACGGCG |
| SEQ ID NO: 7421 | NTC | TAGTGTTGTGAGCGTCGTAC |
| SEQ ID NO: 7422 | NTC | TAGTTAACCGTAAAGTGGGC |
| SEQ ID NO: 7423 | NTC | TAGTTATCTGCAACGCATAG |
| SEQ ID NO: 7424 | NTC | TATACTCGCCTGTCACAGCG |
| SEQ ID NO: 7425 | NTC | TATCCCGATCCGGAAACTAG |
| SEQ ID NO: 7426 | NTC | TATCGAACTGCACACGCAAC |
| SEQ ID NO: 7427 | NTC | TATCTAATCGCGGAGTCGTA |
| SEQ ID NO: 7428 | NTC | TATCTCTGGATGCCGTCGGT |
| SEQ ID NO: 7429 | NTC | TATGAAACATCTCGGCGACG |
| SEQ ID NO: 7430 | NTC | TATGAACCTCCGGATCGGTG |
| SEQ ID NO: 7431 | NTC | TATGAACTAGGCGTAAACGG |
| SEQ ID NO: 7432 | NTC | TATGACACACAATCTGCGAC |
| SEQ ID NO: 7433 | NTC | TATGACTGCACGACTCGCTA |
| SEQ ID NO: 7434 | NTC | TATGATCGTATGGCCCTTCC |
| SEQ ID NO: 7435 | NTC | TATGCCATATGCCCGTTTTT |
| SEQ ID NO: 7436 | NTC | TCAAACGCCCGGGCGCCCCA |
| SEQ ID NO: 7437 | NTC | TCAACTATGAACCGCCGTGC |
| SEQ ID NO: 7438 | NTC | TCAACTTAACCTCGAGTCCG |
| SEQ ID NO: 7439 | NTC | TCAATAGTTCTGCGCGAATT |
| SEQ ID NO: 7440 | NTC | TCAATCTGCGGTGACTCGTT |
| SEQ ID NO: 7441 | NTC | TCAATTAGTGGCCGCCAAGC |
| SEQ ID NO: 7442 | NTC | TCACAACCCCCGACTATCGC |
| SEQ ID NO: 7443 | NTC | TCACACGGGATCTCGCCGGT |
| SEQ ID NO: 7444 | NTC | TCACATGACACTCGTTACGA |
| SEQ ID NO: 7445 | NTC | TCACCCGCGTATACGACCTG |
| SEQ ID NO: 7446 | NTC | TCACGCACGACTAAGGGAAT |
| SEQ ID NO: 7447 | NTC | TCACTCAAAGTGCGTAGTCG |
| SEQ ID NO: 7448 | NTC | TCACTTCGGGCATTACGAGC |
| SEQ ID NO: 7449 | NTC | TCACTTTAAGCACCCCGCGC |
| SEQ ID NO: 7450 | NTC | TCAGCAGAATTGGGCCCGTA |
| SEQ ID NO: 7451 | NTC | TCAGCTACGATCGGACCCAA |
| SEQ ID NO: 7452 | NTC | TCAGTCAGTCGGCCCCCTGC |
| SEQ ID NO: 7453 | NTC | TCATATTAGACAATCTCCGC |
| SEQ ID NO: 7454 | NTC | TCATCTACGGTATCGAAAGG |
| SEQ ID NO: 7455 | NTC | TCATGCGCCTCGTAATACCT |

TABLE 1-continued mmSurf sgRNA library sequences

| SEQ ID NO | id_gRNA Target | Sequence |
|---|---|---|
| SEQ ID NO: 7456 | NTC | TCATGTTGCGTCGTCCGTTA |
| SEQ ID NO: 7457 | NTC | TCCCCCGTACGTGTATGTCG |
| SEQ ID NO: 7458 | NTC | TCCCCTTCGTCGGCGCCAGG |
| SEQ ID NO: 7459 | NTC | TCCCGGGAGGTACGGTGTAC |
| SEQ ID NO: 7460 | NTC | TCCGAACAGGCGCGTTTCTC |
| SEQ ID NO: 7461 | NTC | TCCGCGGCAACGTTTGGGTC |
| SEQ ID NO: 7462 | NTC | TCCGTACATCGACCTATTAC |
| SEQ ID NO: 7463 | NTC | TCCGTAGGACGTATATATTC |
| SEQ ID NO: 7464 | NTC | TCCTACACCACCCCGGCCGT |
| SEQ ID NO: 7465 | NTC | TCCTAGGCCTGATTTACCCG |
| SEQ ID NO: 7466 | NTC | TCCTATAATTGAGCGAACGG |
| SEQ ID NO: 7467 | NTC | TCCTCCGATCGACCAGGGTA |
| SEQ ID NO: 7468 | NTC | TCCTGCGCGATGACCGTCGG |
| SEQ ID NO: 7469 | NTC | TCCTGCGTTCCACTCGTACT |
| SEQ ID NO: 7470 | NTC | TCGAGTCTTGACTCAACGCT |
| SEQ ID NO: 7471 | NTC | TCGATCGTCGGCGGAGCGGA |
| SEQ ID NO: 7472 | NTC | TCGCAAAATGCGGATTCCGT |
| SEQ ID NO: 7473 | NTC | TCGCACTCTAGGCCGTTATT |
| SEQ ID NO: 7474 | NTC | TCGCGAATTGCTGCCGAACT |
| SEQ ID NO: 7475 | NTC | TCGCTAAGCCGGGTAATACT |
| SEQ ID NO: 7476 | NTC | TCGCTCATTAGGAGCGCTAT |
| SEQ ID NO: 7477 | NTC | TCGCTCCGCTAGTAGTGGGT |
| SEQ ID NO: 7478 | NTC | TCGCTGAGCAACGAAGCAAC |
| SEQ ID NO: 7479 | NTC | TCGCTTCTGATTGATCCACG |
| SEQ ID NO: 7480 | NTC | TCGGAATTCCGCAGGCCGAG |
| SEQ ID NO: 7481 | NTC | TCGGACTATAGCGTGAACGT |
| SEQ ID NO: 7482 | NTC | TCGGATCGGTACATAAAGTT |
| SEQ ID NO: 7483 | NTC | TCGGATTTTAATCCTTACGC |
| SEQ ID NO: 7484 | NTC | TCGGCGCAGCCTAATGTATA |
| SEQ ID NO: 7485 | NTC | TCGTAAAGTCGCAGCGACGT |
| SEQ ID NO: 7486 | NTC | TCGTAAGTTCGCTATATGCC |
| SEQ ID NO: 7487 | NTC | TCGTACCGCACGTGTAAGCC |
| SEQ ID NO: 7488 | NTC | TCGTGCCGGAATAACCACTA |
| SEQ ID NO: 7489 | NTC | TCGTGCCTAGCTCGGTTGAG |
| SEQ ID NO: 7490 | NTC | TCGTGTCTAGCTATCGAGTG |
| SEQ ID NO: 7491 | NTC | TCGTTACATACCCCGCGGAA |
| SEQ ID NO: 7492 | NTC | TCGTTGTGTCGACATCCGCA |
| SEQ ID NO: 7493 | NTC | TCTACACGCGCGTTCAACCG |

TABLE 1-continued mmSurf sgRNA library sequences

| SEQ ID NO | id_gRNA Target | Sequence |
|---|---|---|
| SEQ ID NO: 7494 | NTC | TCTAGGATACTCTTAACGGG |
| SEQ ID NO: 7495 | NTC | TCTATATCTAGTCTCGGCGC |
| SEQ ID NO: 7496 | NTC | TCTCAGTTCGTAGCGAACGA |
| SEQ ID NO: 7497 | NTC | TCTCCGGGCCGTGTTAGACC |
| SEQ ID NO: 7498 | NTC | TCTCCGTCCGAAACGGCGAC |
| SEQ ID NO: 7499 | NTC | TCTCGAATAAATTTTCTCGC |
| SEQ ID NO: 7500 | NTC | TCTCTTCGCGCCCGCTTTGC |
| SEQ ID NO: 7501 | NTC | TCTGCACCGCGACTTAGCTT |
| SEQ ID NO: 7502 | NTC | TCTGGACGCGAGATGACGGG |
| SEQ ID NO: 7503 | NTC | TCTTCTAGTGCGAGTTCCGC |
| SEQ ID NO: 7504 | NTC | TCTTCTCGAGCGTGCGGGCC |
| SEQ ID NO: 7505 | NTC | TCTTGACTCCGACTTCGGGC |
| SEQ ID NO: 7506 | NTC | TGACAACCGCGGTACCTCTA |
| SEQ ID NO: 7507 | NTC | TGACCCGTCTCTTCGCGCAC |
| SEQ ID NO: 7508 | NTC | TGACCCTCTTAATCTCCGGT |
| SEQ ID NO: 7509 | NTC | TGACGCGCCTCGGACCAACC |
| SEQ ID NO: 7510 | NTC | TGACGCTAAGGCCCGCTAAC |
| SEQ ID NO: 7511 | NTC | TGACTTGACACGTTCGATAT |
| SEQ ID NO: 7512 | NTC | TGAGACCAATGCCGCGGAAT |
| SEQ ID NO: 7513 | NTC | TGAGAGCAAGGCGCATACGC |
| SEQ ID NO: 7514 | NTC | TGAGCCGGTGCGCTCTCGGT |
| SEQ ID NO: 7515 | NTC | TGAGCCTTTGTGGACCGCGG |
| SEQ ID NO: 7516 | NTC | TGAGCGCTTTCCCGATCCGG |
| SEQ ID NO: 7517 | NTC | TGAGGGCTCAATACTTCCGC |
| SEQ ID NO: 7518 | NTC | TGAGGTTACCGCCGGCTTTT |
| SEQ ID NO: 7519 | NTC | TGATAAACGATGCGAACTCG |
| SEQ ID NO: 7520 | NTC | TGATCAACGTCGGTGGACGG |
| SEQ ID NO: 7521 | NTC | TGATCCCCGTCCCGAAGTTA |
| SEQ ID NO: 7522 | NTC | TGATGCCGGTACCCGTAACT |
| SEQ ID NO: 7523 | NTC | TGATGGACGCGATACGTTTA |
| SEQ ID NO: 7524 | NTC | TGATTGGGGTCGTTCGCCA |
| SEQ ID NO: 7525 | NTC | TGCAACGATGGTTACGGTAC |
| SEQ ID NO: 7526 | NTC | TGCACCGGTACGGGCGACTC |
| SEQ ID NO: 7527 | NTC | TGCAGATCGCGAAGCGACTA |
| SEQ ID NO: 7528 | NTC | TGCAGTAGTCGCGGATAGGC |
| SEQ ID NO: 7529 | NTC | TGCCCTGCGTCCGCTACGTC |
| SEQ ID NO: 7530 | NTC | TGCCGACGCGACGCAGCGTA |
| SEQ ID NO: 7531 | NTC | TGCCTACTGTCGTTCCCGCG |

TABLE 1-continued mmSurf sgRNA library sequences

| SEQ ID NO | id_gRNA Target | Sequence |
|---|---|---|
| SEQ ID NO: 7532 | NTC | TGCCTTCAGTCGACCGTTAC |
| SEQ ID NO: 7533 | NTC | TGCGCGTCCTGTTATGACCG |
| SEQ ID NO: 7534 | NTC | TGCGGCAATGTTAACCCTTA |
| SEQ ID NO: 7535 | NTC | TGCGTAAAACTTGCGCTCGA |
| SEQ ID NO: 7536 | NTC | TGCGTCTCAGCTTCGGCTAT |
| SEQ ID NO: 7537 | NTC | TGCTGGCCGATACGTGCTTG |
| SEQ ID NO: 7538 | NTC | TGCTTAGGGCCCTTCGGCGG |
| SEQ ID NO: 7539 | NTC | TGCTTTACCGCGTTGGGTAA |
| SEQ ID NO: 7540 | NTC | TGGATCCGCTTCGCACGGCG |
| SEQ ID NO: 7541 | NTC | TGGCACGGAGTTGCATACGC |
| SEQ ID NO: 7542 | NTC | TGGCCCACAAGGTGCGATAT |
| SEQ ID NO: 7543 | NTC | TGGCGCTCCTGCGCACACGA |
| SEQ ID NO: 7544 | NTC | TGGCTTAATGGACAGCGCGA |
| SEQ ID NO: 7545 | NTC | TGGGCCATAGTGGCGCGTGA |
| SEQ ID NO: 7546 | NTC | TGGGCGGTTCAAAGCGAATT |
| SEQ ID NO: 7547 | NTC | TGGGTCCTAAACGCGGTTCA |
| SEQ ID NO: 7548 | NTC | TGGGTTCCGGCCCCATGTAC |
| SEQ ID NO: 7549 | NTC | TGGTACCACTCGCCGAATCT |
| SEQ ID NO: 7550 | NTC | TGGTTCACCACTCGAGATCG |
| SEQ ID NO: 7551 | NTC | TGGTTCGACCAACATGGTTC |
| SEQ ID NO: 7552 | NTC | TGGTTGGCATGTCGCCAGCG |
| SEQ ID NO: 7553 | NTC | TGTAACGATCTGGGCGGTCT |
| SEQ ID NO: 7554 | NTC | TGTACTCGCATAGCGGGGGC |
| SEQ ID NO: 7555 | NTC | TGTATAGTCATCGCCGTAAT |
| SEQ ID NO: 7556 | NTC | TGTATCCACCGTGACCCGGT |
| SEQ ID NO: 7557 | NTC | TGTCCCGACGATGTGTAAAT |
| SEQ ID NO: 7558 | NTC | TGTCCTACCGAATGAACCGT |
| SEQ ID NO: 7559 | NTC | TGTCGCCGATGGTCAGTCGC |
| SEQ ID NO: 7560 | NTC | TGTCGGACCCATTGTCGAAC |
| SEQ ID NO: 7561 | NTC | TGTCTATGTTTGGCCACGCA |
| SEQ ID NO: 7562 | NTC | TGTCTGCCGCATACGCTATA |
| SEQ ID NO: 7563 | NTC | TGTGCCACGCCGCTGCAACG |
| SEQ ID NO: 7564 | NTC | TGTGCCTACGCCATTCGGCT |
| SEQ ID NO: 7565 | NTC | TGTGTAATTACGTTTCGCGG |
| SEQ ID NO: 7566 | NTC | TGTTAATGCCAACGGGACAT |
| SEQ ID NO: 7567 | NTC | TGTTCGCCCTCTCACGATTG |
| SEQ ID NO: 7568 | NTC | TGTTTATGCGGAACTTCCGC |
| SEQ ID NO: 7569 | NTC | TTAACGTCTGTGCGCACTAC |

TABLE 1-continued mmSurf sgRNA library sequences

| SEQ ID NO | id_gRNA Target | Sequence |
|---|---|---|
| SEQ ID NO: 7570 | NTC | TTAACTGGGGGACCGGACG |
| SEQ ID NO: 7571 | NTC | TTACAGTTCATACCGTCGCC |
| SEQ ID NO: 7572 | NTC | TTACCGTGGTACGTCAGGTT |
| SEQ ID NO: 7573 | NTC | TTACGCAAAGCTGCGATGAG |
| SEQ ID NO: 7574 | NTC | TTACTGATCAGTCGGACGCA |
| SEQ ID NO: 7575 | NTC | TTACTTGGTGCAACAACCGG |
| SEQ ID NO: 7576 | NTC | TTAGCCTTGCCCCGTCATAC |
| SEQ ID NO: 7577 | NTC | TTAGGACGTGCTTCCGAGGG |
| SEQ ID NO: 7578 | NTC | TTAGTTCGACCACTCCTGAT |
| SEQ ID NO: 7579 | NTC | TTATACCGTCACGAGTGCCC |
| SEQ ID NO: 7580 | NTC | TTATCGCACAACCCCGAAAG |
| SEQ ID NO: 7581 | NTC | TTATCGTACTAGTACGTACA |
| SEQ ID NO: 7582 | NTC | TTATGACCTCGATGCGACAT |
| SEQ ID NO: 7583 | NTC | TTATGTGCCTCTCGGCGCAT |
| SEQ ID NO: 7584 | NTC | TTATTGGTTTCAACGGTTGT |
| SEQ ID NO: 7585 | NTC | TTATTTACGCGCTGAACTTG |
| SEQ ID NO: 7586 | NTC | TTCAACGACGGAAGACGCGC |
| SEQ ID NO: 7587 | NTC | TTCAAGTGTTATGGACGCGC |
| SEQ ID NO: 7588 | NTC | TTCAATTGTTCGCCCGAACA |
| SEQ ID NO: 7589 | NTC | TTCATCCTTCGTAGCGCAGC |
| SEQ ID NO: 7590 | NTC | TTCATCGCAGATCGATTTCG |
| SEQ ID NO: 7591 | NTC | TTCCAGTATACCGAATTCGC |
| SEQ ID NO: 7592 | NTC | TTCCCCGCCCGTGCGGTCAT |
| SEQ ID NO: 7593 | NTC | TTCGAAGTCTAACCCGCGGG |
| SEQ ID NO: 7594 | NTC | TTCGACGTGCGGCGTATTGG |
| SEQ ID NO: 7595 | NTC | TTCGACTGCGCACGCCATGA |
| SEQ ID NO: 7596 | NTC | TTCGAGACGGATACGTCTGC |
| SEQ ID NO: 7597 | NTC | TTCGAGATTTTAATAGCGCA |
| SEQ ID NO: 7598 | NTC | TTCGATATAGGGGACGGCGG |
| SEQ ID NO: 7599 | NTC | TTCGCCGGCGACGAAGTGCA |
| SEQ ID NO: 7600 | NTC | TTCGCGAGTAAGGTAGGCAT |
| SEQ ID NO: 7601 | NTC | TTCGGCTCAATGGCGCGAGC |
| SEQ ID NO: 7602 | NTC | TTCGGCTGGTGTGCGTTCAC |
| SEQ ID NO: 7603 | NTC | TTCGTGGCCGAAGGCGCCGC |
| SEQ ID NO: 7604 | NTC | TTCTCCATACCGTAACTCCG |
| SEQ ID NO: 7605 | NTC | TTCTGATTAGATACGTACGA |
| SEQ ID NO: 7606 | NTC | TTGAACACGACACCCGTGCC |
| SEQ ID NO: 7607 | NTC | TTGAAGTAGGGTCGGATTGA |

TABLE 1-continued mmSurf sgRNA library sequences

| SEQ ID NO | id_gRNA Target | Sequence |
|---|---|---|
| SEQ ID NO: 7608 | NTC | TTGAATCCGAGGCGCCGATG |
| SEQ ID NO: 7609 | NTC | TTGAGCGGACCCCCCTACAA |
| SEQ ID NO: 7610 | NTC | TTGATAAACCGCGGCCGAAA |
| SEQ ID NO: 7611 | NTC | TTGCACCCCAGTTCGTTGC |
| SEQ ID NO: 7612 | NTC | TTGCAGCAACGGCGACGGCT |
| SEQ ID NO: 7613 | NTC | TTGCGTGTGCGTTGTTAACG |
| SEQ ID NO: 7614 | NTC | TTGGACGTACACTTTCGTTC |
| SEQ ID NO: 7615 | NTC | TTGGCGGCTCGCTCCTGCGT |
| SEQ ID NO: 7616 | NTC | TTGTCAACTTCGGCCAACGC |
| SEQ ID NO: 7617 | NTC | TTGTCGCTAACTCAGAATAG |
| SEQ ID NO: 7618 | NTC | TTGTTTCAGCCTTGAGCGCG |
| SEQ ID NO: 7619 | NTC | TTTACGTATGCTGTGCGCGA |
| SEQ ID NO: 7620 | NTC | TTTAGTCAGACGAGCCGGAT |
| SEQ ID NO: 7621 | NTC | TTTCAGTTGTCGCGCGACTC |
| SEQ ID NO: 7622 | NTC | TTTCTAATTACCCGATACGT |
| SEQ ID NO: 7623 | NTC | TTTCTAGGGCCGCCGCCCGC |
| SEQ ID NO: 7624 | NTC | TTTGACATTTTCGTCTCGCG |
| SEQ ID NO: 7625 | NTC | TTTTAGTAGGTCAACGCTGT |
| SEQ ID NO: 7626 | NTC | TTTTCGTCGACTAAGTCAAG |
| SEQ ID NO: 7627 | NTC | TTTTGGCGACGCATCGCTGG |
| SEQ ID NO: 7628 | NTC | TTTTTAGACCTAATTCGCGC |

TABLE 2

PCR Primers

SEQ ID NO: 7629
BC_F1 AATGATACGGCGACCACCGAGATCTACACTCTTTCCCTACACGAC
GCTCTTCCGATCTTAAGTAGAGTCTTGTGGAAAGGACGAAACACCG

SEQ ID NO: 7630
BC_F2 AATGATACGGCGACCACCGAGATCTACACTCTTTCCCTACACGAC
GCTCTTCCGATCTATACACGATCTCTTGTGGAAAGGACGAAACACCG

SEQ ID NO: 7631
BC_F3 AATGATACGGCGACCACCGAGATCTACACTCTTTCCCTACACGAC
GCTCTTCCGATCTGATCGCGCGGTTCTTGTGGAAAGGACGAAACACCG

SEQ ID NO: 7632
BC_F4 AATGATACGGCGACCACCGAGATCTACACTCTTTCCCTACACGAC
GCTCTTCCGATCTCGATCATGATCGTCTTGTGGAAAGGACGAAACACCG

SEQ ID NO: 7633
BC_F5 AATGATACGGCGACCACCGAGATCTACACTCTTTCCCTACACGAC
GCTCTTCCGATCTTCGATCGTTACCATCTTGTGGAAAGGACGAAACACCG

SEQ ID NO: 7634
BC_F6 AATGATACGGCGACCACCGAGATCTACACTCTTTCCCTACACGAC
GCTCTTCCGATCTATCGATTCCTTGGTTCTTGTGGAAAGGACGAAACACCG

TABLE 2-continued

PCR Primers

SEQ ID NO: 7635
BC_F7 AATGATACGGCGACCACCGAGATCTACACTCTTTCCCTACACGAC
GCTCTTCCGATCTGATCGATAACGCATTTCTTGTGGAAAGGACGAAACACCG

SEQ ID NO: 7636
BC_F8 AATGATACGGCGACCACCGAGATCTACACTCTTTCCCTACACGAC
GCTCTTCCGATCTCGATCGATACAGGTATTCTTGTGGAAAGGACGAAACACCG

SEQ ID NO: 7637
BC_F9 AATGATACGGCGACCACCGAGATCTACACTCTTTCCCTACACGAC
GCTCTTCCGATCTACGATCGATAGGTAAGGTCTTGTGGAAAGGACGAAACACCG

SEQ ID NO: 7638
BC_F10 AATGATACGGCGACCACCGAGATCTACACTCTTTCCCTACACGA
CGCTCTTCCGATCTTAACAATGGTCTTGTGGAAAGGACGAAACACCG

SEQ ID NO: 7639
BC_F11 AATGATACGGCGACCACCGAGATCTACACTCTTTCCCTACACGA
CGCTCTTCCGATCTATACTGTATCTCTTGTGGAAAGGACGAAACACCG

TABLE 2-continued

PCR Primers

SEQ ID NO: 7640
BC_F12 AATGATACGGCGACCACCGAGATCTACACTCTTTCCCTACACGA
CGCTCTTCCGATCTGATAGGTCGCATCTTGTGGAAAGGACGAAACACCG

SEQ ID NO: 7641
BC-R1 CAAGCAGAAGACGGCATACGAGATGTAACGCGGTGACTGGAGTTC
AGACGTGTGCTCTTCCGATCTgactcggtgccactttttcaagttg SEQ ID NO: 7642
BC-R2 CAAGCAGAAGACGGCATACGAGATGAAGGTCTGTGACTGGAGTTC
AGACGTGTGCTCTTCCGATCTgactcggtgccactttttcaagttg SEQ ID NO: 7643
BC-R3 CAAGCAGAAGACGGCATACGAGATTTGGAACAGTGACTGGAGTTC
AGACGTGTGCTCTTCCGATCTgactcggtgccactttttcaagttg SEQ ID NO: 7644
BC-R4 CAAGCAGAAGACGGCATACGAGATCCTTAGACGTGACTGGAGTTC
AGACGTGTGCTCTTCCGATCTgactcggtgccactttttcaagttg

TABLE 3

CDR sequences of anti-human MGAT5 antibody clones

| Seq ID No | Well # | Antibody Chain | Sequence |
|---|---|---|---|
| 7645 | A01 | H1 | GFNFSSSSIHWV |
| 7646 | A01 | H2 | LEWVASISSYYSSTYYADS |
| 7647 | A01 | H3 | YYCARTVRGSKKPYFSGWAMDYWGQ |
| 7648 | A01 | L3 | YYCQQWYHYSYPITFG |
| 7649 | A02 | H1 | GFNLYYYSMHWV |
| 7650 | A02 | H2 | LEWVASISSSYGYTYYADS |
| 7651 | A02 | H3 | YYCARTVRGSKKPYFSGWAMDYWGQ |
| 7652 | A02 | L3 | YYCQQSYAYSPFTFGQ |
| 7653 | A03 | H1 | GFNFSSSSIHWV |
| 7654 | A03 | H2 | LEWVASISSSYGYTYYADS |
| 7655 | A03 | H3 | YYCARTVRGSKKPYFSGWAMDYWGQ |
| 7656 | A03 | L3 | YYCQQWYHYSYPITFG |
| 7657 | A04 | H1 | GFNFSSSSIHWV |
| 7658 | A04 | H2 | LEWVASISSYYSSTYYADS |
| 7659 | A04 | H3 | YYCARTVRGSKKPYFSGWAMDYWGQ |
| 7660 | A04 | L3 | YYCQQWYHYSYPITFG |
| 7661 | A05 | H1 | GFNFSSSSIHWV |
| 7662 | A05 | H2 | LEWVASISSYYSSTYYADS |
| 7663 | A05 | H3 | YYCARTVRGSKKPYFSGWAMDYWGQ |
| 7664 | A05 | L3 | YYCQQWYHYSYPITFG |
| 7665 | A06 | H1 | GFNFSSSSIHWV |
| 7666 | A06 | H2 | LEWVASISSYYSSTYYADS |
| 7667 | A06 | H3 | YYCARTVRGSKKPYFSGWAMDYWGQ |
| 7668 | A06 | L3 | YYCQQWYHYSYPITFG |

TABLE 3-continued

CDR sequences of anti-human MGAT5 antibody clones

| Seq ID No | Well # | Antibody Chain | Sequence |
|---|---|---|---|
| 7669 | A07 | H1 | GFNFSSSSIHWV |
| 7670 | A07 | H2 | LEWVASISSSYGYTYYADS |
| 7671 | A07 | H3 | YYCARTVRGSKKPYFSGWAMDYWGQ |
| 7672 | A07 | L3 | YYCQQWAYYSYPITFG |
| 7673 | A08 | H1 | GFNFSSSSIHWV |
| 7674 | A08 | H2 | LEWVASISSYYSSTYYADS |
| 7675 | A08 | H3 | YYCARTVRGSKKPYFSGWAMDYWGQ |
| 7676 | A08 | L3 | YYCQQWYHYSYPITFG |
| 7677 | A09 | H1 | GFNFSSSSIHWV |
| 7678 | A09 | H2 | LEWVASISSYYSSTYYADS |
| 7679 | A09 | H3 | YYCARTVRGSKKPYFSGWAMDYWGQ |
| 7680 | A09 | L3 | YYCQQWYHYSYPITFG |
| 7681 | A10 | H1 | GFNLYYYSMHWV |
| 7682 | A10 | H2 | LEWVASISSSYGYTYYADS |
| 7683 | A10 | H3 | YYCARTVRGSKKPYFSGWAMDYWGQ |
| 7684 | A10 | L3 | YYCQQSYAYSPFTFGQ |
| 7685 | B01 | H1 | GFNFSSSSIHWV |
| 7686 | B01 | H2 | LEWVASISSYYSSTYYADS |
| 7687 | B01 | H3 | YYCARTVRGSKKPYFSGWAMDYWGQ |
| 7688 | B01 | L3 | YYCQQWYHYSYPITFG |
| 7689 | B02 | H1 | GFNFSSSSIHWV |
| 7690 | B02 | H2 | LEWVASISSYYGSTYYADS |
| 7691 | B02 | H3 | YYCARTVRGSKKPYFSGWAMDYWGQ |
| 7692 | B02 | L3 | YYCQQWYHYSYPITFG |
| 7693 | B05 | H1 | GFNFSSSSIHWV |
| 7694 | B05 | H2 | LEWVASISSSYGYTYYADS |
| 7695 | B05 | H3 | YYCARTVRGSKKPYFSGWAMDYWGQ |
| 7696 | B06 | H1 | GFNFSSSSIHWV |
| 7697 | B06 | H2 | LEWVASISSYYSSTYYADS |
| 7698 | B06 | H3 | YYCARTVRGSKKPYFSGWAMDYWGQ |
| 7699 | B07 | H1 | GFNFSSSSIHWV |
| 7700 | B07 | H2 | LEWVASISSYYSSTYYADS |
| 7701 | B07 | H3 | YYCARTVRGSKKPYFSGWAMDYWGQ |
| 7702 | B08 | L3 | YYCQQWYHYSYPITFG |
| 7703 | B09 | H1 | GFNFSSSSIHWV |
| 7704 | B09 | H2 | LEWVASISSYYSSTYYADS |
| 7705 | B09 | H3 | YYCARTVRGSKKPYFSGWAMDYWGQ |

TABLE 3-continued

CDR sequences of anti-human MGAT5 antibody clones

| Seq ID No | Well # | Antibody Chain | Sequence |
|---|---|---|---|
| 7706 | B09 | L3 | YYCQQWYHYSYPITFG |
| 7707 | B10 | H1 | GFNFSSSSIHWV |
| 7708 | B10 | H2 | LEWVASISSYYSSTYYADS |
| 7709 | B10 | H3 | YYCARTVRGSKKPYFSGWAMDYWGQ |
| 7710 | B10 | L3 | YYCQQWYHYSYPITFG |
| 7711 | B11 | H1 | GFNFSSSSIHWV |
| 7712 | B11 | H2 | LEWVASISSYYSSTYYADS |
| 7713 | B11 | H3 | YYCARTVRGSKKPYFSGWAMDYWGQ |
| 7714 | B11 | L3 | YYCQQWYHYSYPITFG |
| 7715 | B12 | H1 | GFNFSSSSIHWV |
| 7716 | B12 | H2 | LEWVASISSYYSSTYYADS |
| 7717 | B12 | H3 | YYCARTVRGSKKPYFSGWAMDYWGQ |
| 7718 | B12 | L3 | YYCQQWYHYSYPITFG |
| 7719 | C01 | H1 | GFNFSSSSIHWV |
| 7720 | C01 | H2 | LEWVASISSSYGYTYYADS |
| 7721 | C01 | H3 | YYCARTVRGSKKPYFSGWAMDYWGQ |
| 7722 | C02 | H1 | GFNFSSSSIHWV |
| 7723 | C02 | H2 | LEWVASISSSYGYTYYADS |
| 7724 | C02 | H3 | YYCARTVRGSKKPYFSGWAMDYWGQ |
| 7725 | C03 | H1 | GFNFSSSSIHWV |
| 7726 | C03 | H2 | LEWVASISSYYSSTYYADS |
| 7727 | C03 | H3 | YYCARTVRGSKKPYFSGWAMDYWGQ |
| 7728 | C03 | L3 | YYCQQWYHYSYPITFG |
| 7729 | C04 | H1 | GFNFSSSSIHWV |
| 7730 | C04 | H2 | LEWVASISSYYSSTYYADS |
| 7731 | C04 | H3 | YYCARTVRGSKKPYFSGWAMDYWGQ |

TABLE 4

CDR sequences of anti-human PDIA3 antibody clones

| Seq ID No | Well # | Antibody CDR | Round | Sequence |
|---|---|---|---|---|
| 7732 | A01 | H1 | R3r | GFNLYSYYMHWV |
| 7733 | A01 | H2 | R3r | LEWVAYIYPYYSYTYYADS |
| 7734 | A01 | H3 | R3r | YYCARYPDSFHSSDYPSYSYYAMDYWGQG |
| 7735 | A01 | L3 | R3r | YYCQQSGAGGYPFTFGQG |
| 7736 | A02 | H1 | R3r | GFNFSSSSIHWV |
| 7737 | A02 | H2 | R3r | LEWVASISSSYGYTYYADS |
| 7738 | A02 | H3 | R3r | YYCARTVRGSKKPYFSGWAMDYWGQG |
| 7739 | A02 | L3 | R3r | YYCQQSSYSLITFGQG |
| 7740 | A03 | H1 | R3r | GFNLYYYYIHWV |
| 7741 | A03 | H2 | R3r | LEWVASIYSYYSYTYYADS |
| 7742 | A03 | H3 | R3r | YYCARSSDASSYGGGGYAIDYWGQG |
| 7743 | A03 | L3 | R3r | YYCQQGFYSSPITFGQG |
| 7744 | A04 | H1 | R3r | GFNFSSSSIHWV |
| 7745 | A04 | H2 | R3r | LEWVASISSSYGYTYYADS |
| 7746 | A04 | H3 | R3r | YYCARTVRGSKKPYFSGWAMDYWGQG |
| 7747 | A04 | L3 | R3r | YYCQQHSHYGSPITFGQG |
| 7748 | A05 | H1 | R3r | GFNLSSSYIHWV |
| 7749 | A05 | H2 | R3r | LEWVASISSSYGYTYYADS |
| 7750 | A05 | H3 | R3r | YYCARSYDDYYGGALDYWGQG |
| 7751 | A05 | L3 | R3r | YYCQQHYHPITFGQG |
| 7752 | A06 | H1 | R3r | GFNLSSSYIHWV |
| 7753 | A06 | H2 | R3r | LEWVAYIYPSYGYTYYADS |
| 7754 | A06 | H3 | R3r | YYCARGFASSGIDYWGQG |
| 7755 | A06 | L3 | R3r | YYCQQASSYYYPFTFGQG |
| 7756 | A07 | H1 | R4 | GFTSLLLLCTG |
| 7757 | A07 | H2 | R4 | LEWVASISSYYGYTSYADS |
| 7758 | A07 | H3 | R4 | YYCARHAHHGSGWDAYYYDYSAMDYWGQG |
| 7759 | A07 | L3 | R4 | YYCQQSYSYYDALITFGQG |
| 7760 | A08 | H1 | R4 | GFNFSSSSIHWV |
| 7761 | A08 | H2 | R4 | LEWVASISSSYGYTYYADS |
| 7762 | A08 | H3 | R4 | YYCARTVRGSKKPYFSGWAMDYWGQG |
| 7763 | A08 | L3 | R4 | YYCQQYYPSSLFTFGQG |
| 7764 | A09 | H1 | R4 | GFNLYYSYMHWV |
| 7765 | A09 | H2 | R4 | LEWVTSIYPSYGYTYYADS |
| 7766 | A09 | H3 | R4 | YYCARGYPFSDSFYWAGYALDYWGQG |
| 7767 | A09 | L3 | R4 | YYCQQYFHYYLITFGQG |
| 7768 | A10 | H1 | R4 | GFNLSSSYYIHWV |
| 7769 | A10 | H2 | R4 | LEWVASISSYSGSTYYADS |
| 7770 | A10 | H3 | R4 | YYCARAGSYWSYAFDYWGQG |
| 7771 | A10 | L3 | R4 | YYCQQSYGPITFGQG |
| 7772 | A11 | H1 | R4 | GFNFSSSSIHWV |

TABLE 4-continued

CDR sequences of anti-human PDIA3 antibody clones

| Seq ID No | Well # | Antibody CDR | Round | Sequence |
|---|---|---|---|---|
| 7773 | A11 | H2 | R4 | LEWVASISSSYGYTYYADS |
| 7774 | A11 | H3 | R4 | YYCARTVRGSKKPYFSGWAMDYWGQG |
| 7775 | A11 | L3 | R4 | YYCQQSSYSLITFGQG |
| 7776 | A12 | H1 | R4 | GFNLSSSYIHWV |
| 7777 | A12 | H2 | R4 | LEWVASIYSYYGSTYYADS |
| 7778 | A12 | H3 | R4 | YYCARPSFSYYAMDYWGQG |
| 7779 | A12 | L3 | R4 | YYCQQGFFFAPITFGQG |
| 7780 | B01 | H1 | R4r | GFNLYSYSMHWV |
| 7781 | B01 | H2 | R4r | LEWVAYIYSYSGYTYYADS |
| 7782 | B01 | H3 | R4r | YYCARASYYGLDYWGQG |
| 7783 | B01 | L3 | R4r | YYCQQSAYGYGHPITFGQG |
| 7784 | B02 | H1 | R4r | GFNLYYYSMHWV |
| 7785 | B02 | H2 | R4r | LEWVAYIYSSYSSYTYYADS |
| 7786 | B02 | H3 | R4r | YYCARWSYPGGDGGMDYWGQG |
| 7787 | B02 | L3 | R4r | YYCQQSSDAYSLITLDR |
| 7788 | B03 | H1 | R4r | GFNFSSSSIHWV |
| 7789 | B03 | H2 | R4r | LEWVASISSSYGYTYYADS |
| 7790 | B03 | H3 | R4r | YYCARTVRGSKKPYFSGWAMDYWGQG |
| 7791 | B03 | L3 | R4r | YYCQQGAYYGAPITFGQG |
| 7792 | B04 | H1 | R4r | ASTSFFLMHG |
| 7793 | B04 | H2 | R4r | LEWVAYIYSSSSSTSYADS |
| 7794 | B04 | H3 | R4r | YYCARSSSASGYPGFSYFSYDGMDYWGQG |
| 7795 | B04 | L3 | R4r | YYCQQSSYSLITFGQG |
| 7796 | B05 | H1 | R4r | GFNFSSSSIHWV |
| 7797 | B05 | H2 | R4r | LEWVASISSSYGYTYYADS |
| 7798 | B05 | H3 | R4r | YYCARTVRGSKKPYFSGWAMDYWGQG |
| 7799 | B05 | L3 | R4r | YYCQQSSYSLITFGQG |
| 7800 | B06 | H1 | R4r | GFNIYYSYMHWV |
| 7801 | B06 | H2 | R4r | LEWVASIYPYSSYTSYADS |
| 7802 | B06 | H3 | R4r | YYCARFSWFGWYSYAGMDYWGQG |
| 7803 | B06 | L3 | R4r | YYCQQSSYSLITFGQG |
| 7804 | B07 | H1 | R5 | GFNLSSSSMHWV |
| 7805 | B07 | H2 | R5 | LEWVAYIYSYSGYTSYADS |
| 7806 | B07 | H3 | R5 | YYCARTVRGSNKPYFSGWAMDYWGQG |
| 7807 | B07 | L3 | R5 | YYCQQAPAALITFGQG |
| 7808 | B08 | H1 | R5 | GFNLYYSYMHWV |
| 7809 | B08 | H2 | R5 | LEWVAYIYPYYGSTSYADS |
| 7810 | B08 | H3 | R5 | YYCARYSYPYWYYFGSGLDYWGQG |
| 7811 | B08 | L3 | R5 | YYCQQWYLITFGQG |
| 7812 | B09 | H1 | R5 | GFNLYYYMHWV |
| 7813 | B09 | H2 | R5 | LEWVAYISPSYGYTYYADS |
| 7814 | B09 | H3 | R5 | YYCARSSSGYSYGAFYYPSAIDYWGQG |
| 7815 | B09 | L3 | R5 | YYCQQGYDLITFGQG |
| 7816 | B11 | H1 | R5 | GFNIYYSYMHWV |
| 7817 | B11 | H2 | R5 | LEWVASIYSYYSSTSYADS |
| 7818 | B11 | H3 | R5 | YYCARSALDYWGQG |
| 7819 | B11 | L3 | R5 | YYCQQYYYLITFGQG |
| 7820 | B12 | H1 | R3r | GFNFSSSSIHWV |
| 7821 | B12 | H2 | R3r | LEWVASISSSYGYTYYADS |
| 7822 | B12 | H3 | R3r | YYCARHYAGYPGYYGYGIDYWGQG |
| 7823 | B12 | L3 | R3r | YYCQQSSYSLITFGQG |

For the above MGAT5 and PDIA3 antibodies, the sequences comprising L1 and L2 are constant across all clones:

Amino acid sequence SEQ ID NO. 7,824:
IQMTQSPSSLSASVGDRVTITCRASQSVSSAVAWYQQKPGKAPKLLIYSA
SSLYSGVPSRFSGSRSGTDFTLTISSLQPEDFAT Nucleic acid sequence SEQ ID NO. 69,837
ATCCAGATGACCCAGTCCCCGAGCTCCCTGTCCGCCTCTGTGGGCGATAG
GGTCACCATCACCTGCCGTGCCAGTCAGTCCGTGTCCAGCGCTGTAGCCT
GGTATCAACAGAAACCAGGAAAAGCTCCGAAGCTTCTGATTTACTCGGCA
TCCAGCCTCTACTCTGGAGTCCCTTCTCGCTTCTCTGGTAGCCGTTCCGG
GACGGATTTCACTCTGACCATCAGCAGTCTGCAGCCGGAAGACTTCGCAA
CT Based on these antibody clone sequences, mouse IgG1 expression vectors were constructed for the top 3 clones for both human MGAT5 and PDIA3 and termed anti-MGAT5 and anti-PDIA3 monoclonal antibodies (a-MGAT5 and a-PDIA3 mAbs). Each antibody consists of a heavy chain and a light chain. (Table 5).

TABLE 5

Sequence ID NOs for a-MGAT5 and a-PDIA3 mAbs in mIgG1 heavy and light chains. Full sequences are below.

| SEQ ID No | Sequence file | Identity |
|---|---|---|
| 7825 | pLYM10H_pFUSEss-CHIg-mG1 | a-MGAT5 clone 10 heavy chain |
| 7826 | pLYM10L_pFUSE2ss-CLIg-mk | a-MGAT5 clone 10 light chain |
| 7827 | pLYM3H_pFUSEss-CHIg-mG1 | a-MGAT5 clone 3 heavy chain |
| 7828 | pLYM3L_pFUSE2ss-CLIg-mk | a-MGAT5 clone 3 light chain |
| 7829 | pLYM9H_pFUSEss-CHIg-mG1 | a-MGAT5 clone 9 heavy chain |
| 7830 | pLYM9L_pFUSE2ss-CLIg-mk | a-MGAT5 clone 9 light chain |

TABLE 5-continued

Sequence ID NOs for a-MGAT5 and a-PDIA3 mAbs in mIgG1 heavy and light chains. Full sequences are below.

| SEQ ID No | Sequence file | Identity |
|---|---|---|
| 7831 | pLYP17H_pFUSEss-CHIg-mG1 | a-PDIA3 clone 17 heavy chain |
| 7832 | pLYP17L_pFUSE2ss-CLIg-mk | a-PDIA3 clone 17 light chain |
| 7833 | pLYP21H_pFUSEss-CHIg-mG1 | a-PDIA3 clone 21 heavy chain |
| 7834 | pLYP21L_pFUSE2ss-CLIg-mk | a-PDIA3 clone 21 light chain |
| 7835 | pLYP22H_pFUSEss-CHIg-mG1 | a-PDIA3 clone 22 heavy chain |
| 7836 | pLYP22L_pFUSE2ss-CLIg-mk | a-PDIA3 clone 22 light chain |

```
SEQ ID No 7,825:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCACCGGCGAAGGAGGGCCACCATGTACAGGATGCAACTCCTGTCTTGCATTGC

ACTAAGTCTTGCACTTGTCACGAATTCGGAGGTTCAGCTGGTGGAGTCTGGCGGT

GGCCTGGTGCAGCCAGGGGGCTCACTCCGTTTGTCCTGTGCAGCTTCTGGCTTCA

ACCTCTATTATTATTCTATGCACTGGGTGCGTCAGGCCCCGGGTAAGGGCCTGGA

ATGGGTTGCATCTATTTCTTCTTCTTATGGCTATACTTATTATGCCGATAGCGTCA

AGGGCCGTTTCACTATAAGCGCAGACACATCCAAAAACACAGCCTACCTACAAA

TGAACAGCTTAAGAGCTGAGGACACTGCCGTCTATTATTGTGCTCGCACTGTTCG

TGGATCCAAAAAACCGTACTTCTCTGGTTGGGCTATGGACTACTGGGGTCAAGGA

ACCCTGGTCACCGTCTCCTCGAGTGCTAGCAGCGCTAAAACGACACCCCCATCTG

TCTATCCACTGGCCCCTGGATCTGCTGCCCAAACTAACTCCATGGTGACCCTGGG

ATGCCTGGTCAAGGGCTATTTCCCTGAGCCAGTGACAGTGACCTGGAACTCTGGA

TCCCTGTCCAGCGGTGTGCACACCTTCCCAGCTGTCCTGCAGTCTGACCTCTACA

CTCTGAGCAGCTCAGTGACTGTCCCCTCCAGCACCTGGCCCAGCGAGACCGTCAC

CTGCAACGTTGCCCACCCGGCCAGCAGCACCAAGGTGGACAAGAAAATTGTGCC

CAGGGATTGTGGTTGTAAGCCTTGCATATGTACAGTCCCAGAAGTATCATCTGTC

TTCATCTTCCCCCCAAAGCCCAAGGATGTGCTCACCATTACTCTGACTCCTAAGG

TCACGTGTGTTGTGGTAGACATCAGCAAGGATGATCCCGAGGTCCAGTTCAGCTG

GTTTGTAGATGATGTGGAGGTGCACACAGCTCAGACGCAACCCCGGGAGGAGCA

GTTCAACAGCACTTTCCGCTCAGTCAGTGAACTTCCCATCATGCACCAGGACTGG

CTCAATGGCAAGGAGTTCAAATGCAGGGTCAACAGTGCAGCTTTCCCTGCCCCCA

TCGAGAAAACCATCTCCAAAACCAAAGGCAGACCGAAGGCTCCGCAGGTGTACA
```

-continued

```
CCATTCCACCTCCCAAGGAGCAGATGGCCAAGGATAAAGTCAGTCTGACCTGCA
TGATAACAGACTTCTTCCCTGAAGACATTACTGTGGAGTGGCAGTGGAATGGGCA
GCCAGCGGAGAACTACAAGAACACTCAGCCCATCATGGACACAGATGGCTCTTA
CTTCGTCTACAGCAAGCTCAATGTGCAGAAGAGCAACTGGGAGGCAGGAAATAC
TTTCACCTGCTCTGTGTTACATGAGGGCCTGCACAACCACCATACTGAGAAGAGC
CTCTCCCACTCTCCTGGTAAATGATCCCAGTGTCCCTAGCTGGCCAGACATGATA
AGATACATTGATGAGTTTGGACAAACCACAACTAGAATGCAGTGAAAAAAATGC
TTTATTTGTGAAATTTGTGATGCTATTGCTTTATTTGTAACCATTATAAGCTGCAA
TAAACAAGTTAACAACAACAATTGCATTCATTTTATGTTTCAGGTTCAGGGGGAG
GTGTGGGAGGTTTTTTAAAGCAAGTAAAACCTCTACAAATGTGGTATGGAATTAA
TTCTAAAATACAGCATAGCAAAACTTTAACCTCCAAATCAAGCCTCTACTTGAAT
CCTTTTCTGAGGGATGAATAAGGCATAGGCATCAGGGGCTGTTGCCAATGTGCAT
TAGCTGTTTGCAGCCTCACCTTCTTTCATGGAGTTTAAGATATAGTGTATTTTCCC
AAGGTTTGAACTAGCTCTTCATTTCTTTATGTTTTAAATGCACTGACCTCCCACAT
TCCCTTTTTAGTAAAATATTCAGAAATAATTTAAATACATCATTGCAATGAAAAT
AAATGTTTTTATTAGGCAGAATCCAGATGCTCAAGGCCCTTCATAATATCCCCC
AGTTTAGTAGTTGGACTTAGGGAACAAAGGAACCTTTAATAGAAATTGGACAGC
AAGAAAGCGAGCTTCTAGCTTATCCTCAGTCCTGCTCCTCTGCCACAAAGTGCAC
GCAGTTGCCGGCCGGGTCGCGCAGGGCGAACTCCCGCCCCCACGGCTGCTCGCC
GATCTCGGTCATGGCCGGCCCGGAGGCGTCCCGGAAGTTCGTGGACACGACCTC
CGACCACTCGGCGTACAGCTCGTCCAGGCCGCGCACCCACACCCAGGCCAGGGT
GTTGTCCGGCACCACCTGGTCCTGGACCGCGCTGATGAACAGGGTCACGTCGTCC
CGGACCACACCGGCGAAGTCGTCCTCCACGAAGTCCCGGGAGAACCCGAGCCGG
TCGGTCCAGAACTCGACCGCTCCGGCGACGTCGCGCGCGGTGAGCACCGGAACG
GCACTGGTCAACTTGGCCATGATGGCTCCTCctgtcaggagaggaaagagaaga
aggttagtacaattgCTATAGTGAGTTGTATTATACTATGCAGATATACTATG
CCAATGATTAATTGTCAAACTAGGGCTGCAgggttcatagtgccacttttcct
gcactgccccatctcctgcccacccttcccaggcatagacagtcagtgactt
acCAAACTCACAGGAGGGAGAAGGCAGAAGCTTGAGACAGACCCGCGGGAC
CGCCGAACTGCGAGGGGACGTGGCTAGGGCGGCTTCTTTTATGGTGCGCCGGCC
CTCGGAGGCAGGGCGCTCGGGGAGGCCTAGCGGCCAATCTGCGGTGGCAGGAGG
CGGGGCCGAAGGCCGTGCCTGACCAATCCGGAGCACATAGGAGTCTCAGCCCCC
CGCCCCAAAGCAAGGGGAAGTCACGCGCCTGTAGCGCCAGCGTGTTGTGAAATG
GGGGCTTGGGGGGGTTGGGGCCCTGACTAGTCAAAACAAACTCCCATTGACGTC
AATGGGGTGGAGACTTGGAAATCCCCGTGAGTCAAACCGCTATCCACGCCCATT
GATGTACTGCCAAAACCGCATCATCATGGTAATAGCGATGACTAATACGTAGAT
GTACTGCCAAGTAGGAAAGTCCCATAAGGTCATGTACTGGGCATAATGCCAGGC
GGGCCATTTACCGTCATTGACGTCAATAGGGGGCGTACTTGGCATATGATACACT
TGATGTACTGCCAAGTGGGCAGTTTACCGTAAATACTCCACCCATTGACGTCAAT
GGAAAGTCCCTATTGGCGTTACTATGGGAACATACGTCATTATTGACGTCAATGG
GCGGGGGTCGTTGGGCGGTCAGCCAGGCGGGCCATTTACCGTAAGTTATGTAAC
```

```
GCCTGCAGGTTAATTAAGAACATGTGAGCAAAAGGCCAGCAAAAGGCCAGGAAC

CGTAAAAAGGCCGCGTTGCTGGCGTTTTTCCATAGGCTCCGCCCCCCTGACGAGC

ATCACAAAAATCGACGCTCAAGTCAGAGGTGGCGAAACCCGACAGGACTATAAA

GATACCAGGCGTTTCCCCCTGGAAGCTCCCTCGTGCGCTCTCCTGTTCCGACCCT

GCCGCTTACCGGATACCTGTCCGCCTTTCTCCCTTCGGGAAGCGTGGCGCTTTCTC

ATAGCTCACGCTGTAGGTATCTCAGTTCGGTGTAGGTCGTTCGCTCCAAGCTGGG

CTGTGTGCACGAACCCCCCGTTCAGCCCGACCGCTGCGCCTTATCCGGTAACTAT

CGTCTTGAGTCCAACCCGGTAAGACACGACTTATCGCCACTGGCAGCAGCCACTG

GTAACAGGATTAGCAGAGCGAGGTATGTAGGCGGTGCTACAGAGTTCTTGAAGT

GGTGGCCTAACTACGGCTACACTAGAAGAACAGTATTTGGTATCTGCGCTCTGCT

GAAGCCAGTTACCTTCGGAAAAAGAGTTGGTAGCTCTTGATCCGGCAAACAAAC

CACCGCTGGTAGCGGTGGTTTTTTTGTTTGCAAGCAGCAGATTACGCGCAGAAAA

AAAGGATCTCAAGAAGATCCTTTGATCTTTTCTACGGGGTCTGACGCTCAGTGGA

ACGAAAACTCACGTTAAGGGATTTTGGTCATGGCTAGTTAATTAACATTTAAATC

AGCGGCCGCAATAAAATATCTTTATTTTCATTACATCTGTGTGTTGGTTTTTTGTG

TGAATCGTAACTAACATACGCTCTCCATCAAAACAAAACGAAACAAAACAAACT

AGCAAAATAGGCTGTCCCCAGTGCAAGTGCAGGTGCCAGAACATTTCTCTATCGA

A

SEQ ID No 7,826:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG

TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAATCTTACGCTTACTCTCCGTTCACGTTCGGACAGGGTACCAAGGTGGAGAT

CAAACGACTCGAGATCAAACGGGCAGATGCTGCACCAACTGTATCCATCTTCCC

ACCATCCAGTGAGCAGTTAACATCTGGAGGTGCCTCAGTCGTGTGCTTCTTGAAC

AACTTCTACCCCAAAGACATCAATGTCAAGTGGAAGATTGATGGCAGTGAACGA

CAAAATGGCGTCCTGAACAGTTGGACTGATCAGGACAGCAAAGACAGCACCTAC

AGCATGAGCAGCACCCTCACGTTGACCAAGGACGAGTATGAACGACATAACAGC
```

```
TATACCTGTGAGGCCACTCACAAGACATCAACTTCACCCATTGTCAAGAGCTTCA

ACAGGAATGAGTGTTAGAGACAAAGGTCCTGAGAGCTAGCTGGCCAGACATGAT

AAGATACATTGATGAGTTTGGACAAACCACAACTAGAATGCAGTGAAAAAAATG

CTTTATTTGTGAAATTTGTGATGCTATTGCTTTATTTGTAACCATTATAAGCTGCA

ATAAACAAGTTAACAACAACAATTGCATTCATTTTATGTTTCAGGTTCAGGGGGA

GGTGTGGGAGGTTTTTTAAAGCAAGTAAAACCTCTACAAATGTGGTATGGAATTA

ATTCTAAAATACAGCATAGCAAAACTTTAACCTCCAAATCAAGCCTCTACTTGAA

TCCTTTTCTGAGGGATGAATAAGGCATAGGCATCAGGGGCTGTTGCCAATGTGCA

TTAGCTGTTTGCAGCCTCACCTTCTTTCATGGAGTTTAAGATATAGTGTATTTTCC

CAAGGTTTGAACTAGCTCTTCATTTCTTTATGTTTTAAATGCACTGACCTCCCACA

TTCCCTTTTAGTAAAATATTCAGAAATAATTTAAATACATCATTGCAATGAAAA

TAAATGTTTTTTATTAGGCAGAATCCAGATGCTCAAGGCCCTTCATAATATCCCC

CAGTTTAGTAGTTGGACTTAGGGAACAAAGGAACCTTTAATAGAAATTGGACAG

CAAGAAAGCGAGCTTCTAGCTTTAGTTCCTGGTGTACTTGAGGGGGATGAGTTCC

TCAATGGTGGTTTTGACCAGCTTGCCATTCATCTCAATGAGCACAAAGCAGTCAG

GAGCATAGTCAGAGATGAGCTCTCTGCACATGCCACAGGGGCTGACCACCCTGA

TGGATCTGTCCACCTCATCAGAGTAGGGGTGCCTGACAGCCACAATGGTGTCAAA

GTCCTTCTGCCCGTTGCTCACAGCAGACCCAATGGCAATGGCTTCAGCACAGACA

GTGACCCTGCCAATGTAGGCCTCAATGTGGACAGCAGAGATGATCTCCCCAGTCT

TGGTCCTGATGGCCGCCCCGACATGGTGCTTGTTGTCCTCATAGAGCATGGTGAT

CTTCTCAGTGGCGACCTCCACCAGCTCCAGATCCTGCTGAGAGATGTTGAAGGTC

TTCATGATGGCTCCTCctgtcaggagaggaaagagaagaaggttagtacaatt gCTATAGTGAGTTGTATTATACTATGCTTATGATTAATTGTCAAACTAGGGCT GCAgggttcatagtgccacttttcctgcactgccccatctectgcccaccatt tcccaggcatagacagtcagtgacttacCAAACTCACAGGAGGGAGAAGGCAG

AAGCTTGAGACAGACCCGCGGGACCGCCGAACTGCGAGGGGACGTGGCTA

GGGCGGCTTCTTTTATGGTGCGCCGGCCCTCGGAGGCAGGGCGCTCGGGGAGGC

CTAGCGGCCAATCTGCGGTGGCAGGAGGCGGGGCCGAAGGCCGTGCCTGACCAA

TCCGGAGCACATAGGAGTCTCAGCCCCCCGCCCCAAAGCAAGGGGAAGTCACGC

GCCTGTAGCGCCAGCGTGTTGTGAAATGGGGGCTTGGGGGGGTTGGGGCCCTGA

CTAGTCAAAACAAACTCCCATTGACGTCAATGGGGTGGAGACTTGGAAATCCCC

GTGAGTCAAACCGCTATCCACGCCCATTGATGTACTGCCAAAACCGCATCATCAT

GGTAATAGCGATGACTAATACGTAGATGTACTGCCAAGTAGGAAAGTCCCATAA

GGTCATGTACTGGGCATAATGCCAGGCGGGCCATTTACCGTCATTGACGTCAATA

GGGGGCGTACTTGGCATATGATACACTTGATGTACTGCCAAGTGGGCAGTTTACC

GTAAATACTCCACCCATTGACGTCAATGGAAAGTCCCTATTGGCGTTACTATGGG

AACATACGTCATTATTGACGTCAATGGGCGGGGTCGTTGGGCGGTCAGCCAGG

CGGGCCATTTACCGTAAGTTATGTAACGCCTGCAGGTTAATTAAGAACATGTGAG

CAAAAGGCCAGCAAAAGGCCAGGAACCGTAAAAAGGCCGCGTTGCTGGCGTTTT

TCCATAGGCTCCGCCCCCCTGACGAGCATCACAAAAATCGACGCTCAAGTCAGA
```

-continued

GGTGGCGAAACCCGACAGGACTATAAAGATACCAGGCGTTTCCCCCTGGAAGCT

CCCTCGTGCGCTCTCCTGTTCCGACCCTGCCGCTTACCGGATACCTGTCCGCCTTT

CTCCCTTCGGGAAGCGTGGCGCTTTCTCATAGCTCACGCTGTAGGTATCTCAGTTC

GGTGTAGGTCGTTCGCTCCAAGCTGGGCTGTGTGCACGAACCCCCCGTTCAGCCC

GACCGCTGCGCCTTATCCGGTAACTATCGTCTTGAGTCCAACCCGGTAAGACACG

ACTTATCGCCACTGGCAGCAGCCACTGGTAACAGGATTAGCAGAGCGAGGTATG

TAGGCGGTGCTACAGAGTTCTTGAAGTGGTGGCCTAACTACGGCTACACTAGAA

GAACAGTATTTGGTATCTGCGCTCTGCTGAAGCCAGTTACCTTCGGAAAAAGAGT

TGGTAGCTCTTGATCCGGCAAACAAACCACCGCTGGTAGCGGTGGTTTTTTTGTT

TGCAAGCAGCAGATTACGCGCAGAAAAAAAGGATCTCAAGAAGATCCTTTGATC

TTTTCTACGGGGTCTGACGCTCAGTGGAACGAAAACTCACGTTAAGGGATTTTGG

TCATGGCTAGTTAATTAACATTTAAATCAGCGGCCGCAATAAAATATCTTTATTTT

CATTACATCTGTGTGTTGGTTTTTTGTGTGAATCGTAACTAACATACGCTCTCCAT

CAAAACAAAACGAAACAAAACAAACTAGCAAAATAGGCTGTCCCCAGTGCAAGT

GCAGGTGCCAGAACATTTCTCTATCGAA

SEQ ID NO 7,827:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG

TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAATCTTACGCTTACTCTCCGTTCACGTTCGGACAGGGTACCAAGGTGGAGAT

CAAACGACTCGAGATCAAACGGGCAGATGCTGCACCAACTGTATCCATCTTCCC

ACCATCCAGTGAGCAGTTAACATCTGGAGGTGCCTCAGTCGTGTGCTTCTTGAAC

AACTTCTACCCCAAAGACATCAATGTCAAGTGGAAGATTGATGGCAGTGAACGA

CAAAATGGCGTCCTGAACAGTTGGACTGATCAGGACAGCAAAGACAGCACCTAC

AGCATGAGCAGCACCCTCACGTTGACCAAGGACGAGTATGAACGACATAACAGC

TATACCTGTGAGGCCACTCACAAGACATCAACTTCACCCATTGTCAAGAGCTTCA

ACAGGAATGAGTGTTAGAGACAAAGGTCCTGAGAGCTAGCTGGCCAGACATGAT

AAGATACATTGATGAGTTTGGACAAACCACAACTAGAATGCAGTGAAAAAAATG

-continued
CTTTATTTGTGAAATTTGTGATGCTATTGCTTTATTTGTAACCATTATAAGCTGCA
ATAAACAAGTTAACAACAACAATTGCATTCATTTTATGTTTCAGGTTCAGGGGGA
GGTGTGGGAGGTTTTTTAAAGCAAGTAAAACCTCTACAAATGTGGTATGGAATTA
ATTCTAAAATACAGCATAGCAAAACTTTAACCTCCAAATCAAGCCTCTACTTGAA
TCCTTTTCTGAGGGATGAATAAGGCATAGGCATCAGGGGCTGTTGCCAATGTGCA
TTAGCTGTTTGCAGCCTCACCTTCTTTCATGGAGTTTAAGATATAGTGTATTTTCC
CAAGGTTTGAACTAGCTCTTCATTTCTTTATGTTTTAAATGCACTGACCTCCCACA
TTCCCTTTTTAGTAAAATATTCAGAAATAATTTAAATACATCATTGCAATGAAAA
TAAATGTTTTTTATTAGGCAGAATCCAGATGCTCAAGGCCCTTCATAATATCCCC
CAGTTTAGTAGTTGGACTTAGGGAACAAAGGAACCTTTAATAGAAATTGGACAG
CAAGAAAGCGAGCTTCTAGCTTTAGTTCCTGGTGTACTTGAGGGGGATGAGTTCC
TCAATGGTGGTTTTGACCAGCTTGCCATTCATCTCAATGAGCACAAAGCAGTCAG
GAGCATAGTCAGAGATGAGCTCTCTGCACATGCCACAGGGGCTGACCACCCTGA
TGGATCTGTCCACCTCATCAGAGTAGGGGTGCCTGACAGCCACAATGGTGTCAAA
GTCCTTCTGCCCGTTGCTCACAGCAGACCCAATGGCAATGGCTTCAGCACAGACA
GTGACCCTGCCAATGTAGGCCTCAATGTGGACAGCAGAGATGATCTCCCCAGTCT
TGGTCCTGATGGCCGCCCCGACATGGTGCTTGTTGTCCTCATAGAGCATGGTGAT
CTTCTCAGTGGCGACCTCCACCAGCTCCAGATCCTGCTGAGAGATGTTGAAGGTC
TTCATGATGGCTCCTCctgtcaggagaggaaagagaagaaggttagtacaattg
CTATAGTGAGTTGTATTATACTATGCTTATGATTAATTGTCAAACTAGGGCTGC
Agggttcatagtgccacttttcctgcactgccccatctectgcccaccattccc
aggcatagacagtcagtgacttacCAAACTCACAGGAGGGAGAAGG
CAGAAGCTTGAGACAGACCCGCGGGACCGCCGAACTGCGAGGGGACGTGGCTA
GGGCGGCTTCTTTTATGGTGCGCCGGCCCTCGGAGGCAGGGCGCTCGGGGAGGC
CTAGCGGCCAATCTGCGGTGGCAGGAGGCGGGGCCGAAGGCCGTGCCTGACCAA
TCCGGAGCACATAGGAGTCTCAGCCCCCCGCCCCAAAGCAAGGGGAAGTCACGC
GCCTGTAGCGCCAGCGTGTTGTGAAATGGGGGCTTGGGGGGGTTGGGGCCCTGA
CTAGTCAAAACAAACTCCCATTGACGTCAATGGGGTGGAGACTTGGAAATCCCC
GTGAGTCAAACCGCTATCCACGCCCATTGATGTACTGCCAAAACCGCATCATCAT
GGTAATAGCGATGACTAATACGTAGATGTACTGCCAAGTAGGAAAGTCCCATAA
GGTCATGTACTGGGCATAATGCCAGGCGGGCCATTTACCGTCATTGACGTCAATA
GGGGGCGTACTTGGCATATGATACACTTGATGTACTGCCAAGTGGGCAGTTTACC
GTAAATACTCCACCCATTGACGTCAATGGAAAGTCCCTATTGGCGTTACTATGGG
AACATACGTCATTATTGACGTCAATGGGCGGGGTCGTTGGGCGGTCAGCCAGG
CGGGCCATTTACCGTAAGTTATGTAACGCCTGCAGGTTAATTAAGAACATGTGAG
CAAAAGGCCAGCAAAAGGCCAGGAACCGTAAAAAGGCCGCGTTGCTGGCGTTTT
TCCATAGGCTCCGCCCCCCTGACGAGCATCACAAAAATCGACGCTCAAGTCAGA
GGTGGCGAAACCCGACAGGACTATAAAGATACCAGGCGTTTCCCCCTGGAAGCT
CCCTCGTGCGCTCTCCTGTTCCGACCCTGCCGCTTACCGGATACCTGTCCGCCTTT
CTCCCTTCGGGAAGCGTGGCGCTTTCTCATAGCTCACGCTGTAGGTATCTCAGTTC
GGTGTAGGTCGTTCGCTCCAAGCTGGGCTGTGTGCACGAACCCCCCGTTCAGCCC -continued

```
GACCGCTGCGCCTTATCCGGTAACTATCGTCTTGAGTCCAACCCGGTAAGACACG

ACTTATCGCCACTGGCAGCAGCCACTGGTAACAGGATTAGCAGAGCGAGGTATG

TAGGCGGTGCTACAGAGTTCTTGAAGTGGTGGCCTAACTACGGCTACACTAGAA

GAACAGTATTTGGTATCTGCGCTCTGCTGAAGCCAGTTACCTTCGGAAAAAGAGT

TGGTAGCTCTTGATCCGGCAAACAAACCACCGCTGGTAGCGGTGGTTTTTTTGTT

TGCAAGCAGCAGATTACGCGCAGAAAAAAAGGATCTCAAGAAGATCCTTTGATC

TTTTCTACGGGGTCTGACGCTCAGTGGAACGAAAACTCACGTTAAGGGATTTTGG

TCATGGCTAGTTAATTAACATTTAAATCAGCGGCCGCAATAAAATATCTTTATTTT

CATTACATCTGTGTGTTGGTTTTTTGTGTGAATCGTAACTAACATACGCTCTCCAT

CAAAACAAAACGAAACAAAACAAACTAGCAAAATAGGCTGTCCCCAGTGCAAGT

GCAGGTGCCAGAACATTTCTCTATCGAA

SEQ ID NO 7,828:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG

TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAATGGTACCATTACTCTTACCCGATCACGTTCGGACAGGGTACCAAGGTGGA

GATCAAACGACTCGAGATCAAACGGGCAGATGCTGCACCAACTGTATCCATCTTC

CCACCATCCAGTGAGCAGTTAACATCTGGAGGTGCCTCAGTCGTGTGCTTCTTGA

ACAACTTCTACCCCAAAGACATCAATGTCAAGTGGAAGATTGATGGCAGTGAAC

GACAAAATGGCGTCCTGAACAGTTGGACTGATCAGGACAGCAAAGACAGCACCT

ACAGCATGAGCAGCACCCTCACGTTGACCAAGGACGAGTATGAACGACATAACA

GCTATACCTGTGAGGCCACTCACAAGACATCAACTTCACCCATTGTCAAGAGCTT

CAACAGGAATGAGTGTTAGAGACAAAGGTCCTGAGAGCTAGCTGGCCAGACATG

ATAAGATACATTGATGAGTTTGGACAAACCACAACTAGAATGCAGTGAAAAAAA

TGCTTTATTTGTGAAATTTGTGATGCTATTGCTTTATTTGTAACCATTATAAGCTG

CAATAAACAAGTTAACAACAACAATTGCATTCATTTTATGTTTCAGGTTCAGGGG

GAGGTGTGGGAGGTTTTTTAAAGCAAGTAAAACCTCTACAAATGTGGTATGGAA

TTAATTCTAAAATACAGCATAGCAAAACTTTAACCTCCAAATCAAGCCTCTACTT
```

-continued

```
GAATCCTTTTCTGAGGGATGAATAAGGCATAGGCATCAGGGGCTGTTGCCAATGT

GCATTAGCTGTTTGCAGCCTCACCTTCTTTCATGGAGTTTAAGATATAGTGTATTT

TCCCAAGGTTTGAACTAGCTCTTCATTTCTTTATGTTTTAAATGCACTGACCTCCC

ACATTCCCTTTTTAGTAAAATATTCAGAAATAATTTAAATACATCATTGCAATGA

AAATAAATGTTTTTTATTAGGCAGAATCCAGATGCTCAAGGCCCTTCATAATATC

CCCCAGTTTAGTAGTTGGACTTAGGGAACAAAGGAACCTTTAATAGAAATTGGA

CAGCAAGAAAGCGAGCTTCTAGCTTTAGTTCCTGGTGTACTTGAGGGGATGAGT

TCCTCAATGGTGGTTTTGACCAGCTTGCCATTCATCTCAATGAGCACAAAGCAGT

CAGGAGCATAGTCAGAGATGAGCTCTCTGCACATGCCACAGGGGCTGACCACCC

TGATGGATCTGTCCACCTCATCAGAGTAGGGGTGCCTGACAGCCACAATGGTGTC

AAAGTCCTTCTGCCCGTTGCTCACAGCAGACCCAATGGCAATGGCTTCAGCACAG

ACAGTGACCCTGCCAATGTAGGCCTCAATGTGGACAGCAGAGATGATCTCCCCA

GTCTTGGTCCTGATGGCCGCCCCGACATGGTGCTTGTTGTCCTCATAGAGCATGG

TGATCTTCTCAGTGGCGACCTCCACCAGCTCCAGATCCTGCTGAGAGATGTTGAA

GGTCTTCATGATGGCTCCTCctgtcaggagaggaaagagaagaaggttagtaca attgCTATAGTGAGTTGTATTATACTATGCTTATGATTAATTGTCAAACTAGGG CTGCAgggttcatagtgccacttttcctgcactgccccatctcctgcccaccct ttcccaggcatagacagtcagtgacttacCAAACTCACAGGAGGGAGA

AGGCAGAAGCTTGAGACAGACCCGCGGGACCGCCGAACTGCGAGGGGACGTGG

CTAGGGCGGCTTCTTTTATGGTGCGCCGGCCCTCGGAGGCAGGGCGCTCGGGGA

GGCCTAGCGGCCAATCTGCGGTGGCAGGAGGCGGGGCCGAAGGCCGTGCCTGAC

CAATCCGGAGCACATAGGAGTCTCAGCCCCCCGCCCCAAAGCAAGGGGAAGTCA

CGCGCCTGTAGCGCCAGCGTGTTGTGAAATGGGGGCTTGGGGGGGTTGGGGCCC

TGACTAGTCAAAACAAACTCCCATTGACGTCAATGGGGTGGAGACTTGGAAATC

CCCGTGAGTCAAACCGCTATCCACGCCCATTGATGTACTGCCAAAACCGCATCAT

CATGGTAATAGCGATGACTAATACGTAGATGTACTGCCAAGTAGGAAAGTCCCA

TAAGGTCATGTACTGGGCATAATGCCAGGCGGGCCATTTACCGTCATTGACGTCA

ATAGGGGGCGTACTTGGCATATGATACACTTGATGTACTGCCAAGTGGGCAGTTT

ACCGTAAATACTCCACCCATTGACGTCAATGGAAAGTCCCTATTGGCGTTACTAT

GGGAACATACGTCATTATTGACGTCAATGGGCGGGGTCGTTGGGCGGTCAGCC

AGGCGGGCCATTTACCGTAAGTTATGTAACGCCTGCAGGTTAATTAAGAACATGT

GAGCAAAAGGCCAGCAAAAGGCCAGGAACCGTAAAAAGGCCGCGTTGCTGGCG

TTTTTCCATAGGCTCCGCCCCCCTGACGAGCATCACAAAAATCGACGCTCAAGTC

AGAGGTGGCGAAACCCGACAGGACTATAAAGATACCAGGCGTTTCCCCCTGGAA

GCTCCCTCGTGCGCTCTCCTGTTCCGACCCTGCCGCTTACCGGATACCTGTCCGCC

TTTCTCCCTTCGGGAAGCGTGGCGCTTTCTCATAGCTCACGCTGTAGGTATCTCAG

TTCGGTGTAGGTCGTTCGCTCCAAGCTGGGCTGTGTGCACGAACCCCCCGTTCAG

CCCGACCGCTGCGCCTTATCCGGTAACTATCGTCTTGAGTCCAACCCGGTAAGAC

ACGACTTATCGCCACTGGCAGCAGCCACTGGTAACAGGATTAGCAGAGCGAGGT

ATGTAGGCGGTGCTACAGAGTTCTTGAAGTGGTGGCCTAACTACGGCTACACTAG
```

-continued

AAGAACAGTATTTGGTATCTGCGCTCTGCTGAAGCCAGTTACCTTCGGAAAAAGA

GTTGGTAGCTCTTGATCCGGCAAACAAACCACCGCTGGTAGCGGTGGTTTTTTTG

TTTGCAAGCAGCAGATTACGCGCAGAAAAAAAGGATCTCAAGAAGATCCTTTGA

TCTTTTCTACGGGGTCTGACGCTCAGTGGAACGAAAACTCACGTTAAGGGATTTT

GGTCATGGCTAGTTAATTAACATTTAAATCAGCGGCCGCAATAAAATATCTTTAT

TTTCATTACATCTGTGTGTTGGTTTTTTGTGTGAATCGTAACTAACATACGCTCTC

CATCAAAACAAAACGAAACAAAACAAACTAGCAAAATAGGCTGTCCCCAGTGCA

AGTGCAGGTGCCAGAACATTTCTCTATCGAA

SEQ ID NO 7,829:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCACCGGCGAAGGAGGGCCACCATGTACAGGATGCAACTCCTGTCTTGCATTGC

ACTAAGTCTTGCACTTGTCACGAATTCGGAGGTTCAGCTGGTGGAGTCTGGCGGT

GGCCTGGTGCAGCCAGGGGGCTCACTCCGTTTGTCCTGTGCAGCTTCTGGCTTCA

ACTTTTCTTCTTCTTCTATACACTGGGTGCGTCAGGCCCCGGGTAAGGGCCTGGA

ATGGGTTGCATCTATTTCTTCTTATTATAGCTCTACTTATTATGCCGATAGCGTCA

AGGGCCGTTTCACTATAAGCGCAGACACATCCAAAAACACAGCCTACCTACAAA

TGAACAGCTTAAGAGCTGAGGACACTGCCGTCTATTATTGTGCTCGCACTGTTCG

TGGATCCAAAAAACCGTACTTCTCTGGTTGGGCTATGGACTACTGGGGTCAAGGA

ACCCTGGTCACCGTCTCCTCGAGTGCTAGCAGCGCTAAAACGACACCCCCATCTG

TCTATCCACTGGCCCCTGGATCTGCTGCCCAAACTAACTCCATGGTGACCCTGGG

ATGCCTGGTCAAGGGCTATTTCCCTGAGCCAGTGACAGTGACCTGGAACTCTGGA

TCCCTGTCCAGCGGTGTGCACACCTTCCCAGCTGTCCTGCAGTCTGACCTCTACA

CTCTGAGCAGCTCAGTGACTGTCCCCTCCAGCACCTGGCCCAGCGAGACCGTCAC

CTGCAACGTTGCCCACCCGGCCAGCAGCACCAAGGTGGACAAGAAAATTGTGCC

CAGGGATTGTGGTTGTAAGCCTTGCATATGTACAGTCCCAGAAGTATCATCTGTC

TTCATCTTCCCCCCAAAGCCCAAGGATGTGCTCACCATTACTCTGACTCCTAAGG

TCACGTGTGTTGTGGTAGACATCAGCAAGGATGATCCCGAGGTCCAGTTCAGCTG

GTTTGTAGATGATGTGGAGGTGCACACAGCTCAGACGCAACCCCGGGAGGAGCA

GTTCAACAGCACTTTCCGCTCAGTCAGTGAACTTCCCATCATGCACCAGGACTGG

CTCAATGGCAAGGAGTTCAAATGCAGGGTCAACAGTGCAGCTTTCCCTGCCCCCA

TCGAGAAAACCATCTCCAAAACCAAAGGCAGACCGAAGGCTCCGCAGGTGTACA

CCATTCCACCTCCCAAGGAGCAGATGGCCAAGGATAAAGTCAGTCTGACCTGCA

-continued

```
TGATAACAGACTTCTTCCCTGAAGACATTACTGTGGAGTGGCAGTGGAATGGGCA

GCCAGCGGAGAACTACAAGAACACTCAGCCCATCATGGACACAGATGGCTCTTA

CTTCGTCTACAGCAAGCTCAATGTGCAGAAGAGCAACTGGGAGGCAGGAAATAC

TTTCACCTGCTCTGTGTTACATGAGGGCCTGCACAACCACCATACTGAGAAGAGC

CTCTCCCACTCTCCTGGTAAATGATCCCAGTGTCCCTAGCTGGCCAGACATGATA

AGATACATTGATGAGTTTGGACAAACCACAACTAGAATGCAGTGAAAAAAATGC

TTTATTTGTGAAATTTGTGATGCTATTGCTTTATTTGTAACCATTATAAGCTGCAA

TAAACAAGTTAACAACAACAATTGCATTCATTTTATGTTTCAGGTTCAGGGGGAG

GTGTGGAGGTTTTTTAAAGCAAGTAAAACCTCTACAAATGTGGTATGGAATTAA

TTCTAAAATACAGCATAGCAAAACTTTAACCTCCAAATCAAGCCTCTACTTGAAT

CCTTTTCTGAGGGATGAATAAGGCATAGGCATCAGGGGCTGTTGCCAATGTGCAT

TAGCTGTTTGCAGCCTCACCTTCTTTCATGGAGTTTAAGATATAGTGTATTTTCCC

AAGGTTTGAACTAGCTCTTCATTTCTTTATGTTTTAAATGCACTGACCTCCCACAT

TCCCTTTTTAGTAAAATATTCAGAAATAATTTAAATACATCATTGCAATGAAAAT

AAATGTTTTTATTAGGCAGAATCCAGATGCTCAAGGCCCTTCATAATATCCCCC

AGTTTAGTAGTTGGACTTAGGGAACAAAGGAACCTTTAATAGAAATTGGACAGC

AAGAAAGCGAGCTTCTAGCTTATCCTCAGTCCTGCTCCTCTGCCACAAAGTGCAC

GCAGTTGCCGGCCGGGTCGCGCAGGGCGAACTCCCGCCCCCACGGCTGCTCGCC

GATCTCGGTCATGGCCGGCCCGGAGGCGTCCCGGAAGTTCGTGGACACGACCTC

CGACCACTCGGCGTACAGCTCGTCCAGGCCGCGCACCCACACCCAGGCCAGGGT

GTTGTCCGGCACCACCTGGTCCTGGACCGCGCTGATGAACAGGGTCACGTCGTCC

CGGACCACACCGGCGAAGTCGTCCTCCACGAAGTCCCGGGAGAACCCGAGCCGG

TCGGTCCAGAACTCGACCGCTCCGGCGACGTCGCGCGCGGTGAGCACCGGAACG

GCACTGGTCAACTTGGCCATGATGGCTCCTCctgtcaggagaggaaagagaaga aggttagtacaattgCTATAGTGAGTTGTATTATACTATGCAGATATACTATGC CAATGATTAATTGTCAAACTAGGGCTGCAgggttcatagtgccacttttcctgc actgccccatctcctgcccacccttttcccaggcatagacagtcagtgacttacC

AAACTCACAGGAGGGAGAAGGCAGAAGCTTGAGACAGACCCGCGGGA

CCGCCGAACTGCGAGGGGACGTGGCTAGGGCGGCTTCTTTTATGGTGCGCCGGCC

CTCGGAGGCAGGGCGCTCGGGGAGGCCTAGCGGCCAATCTGCGGTGGCAGGAGG

CGGGGCCGAAGGCCGTGCCTGACCAATCCGGAGCACATAGGAGTCTCAGCCCCC

CGCCCCAAAGCAAGGGGAAGTCACGCGCCTGTAGCGCCAGCGTGTTGTGAAATG

GGGGCTTGGGGGGGTTGGGGCCCTGACTAGTCAAAACAAACTCCCATTGACGTC

AATGGGGTGGAGACTTGGAAATCCCCGTGAGTCAAACCGCTATCCACGCCCATT

GATGTACTGCCAAAACCGCATCATCATGGTAATAGCGATGACTAATACGTAGAT

GTACTGCCAAGTAGGAAAGTCCCATAAGGTCATGTACTGGGCATAATGCCAGGC

GGGCCATTTACCGTCATTGACGTCAATAGGGGGCGTACTTGGCATATGATACACT

TGATGTACTGCCAAGTGGGCAGTTTACCGTAAATACTCCACCCATTGACGTCAAT

GGAAAGTCCCTATTGGCGTTACTATGGGAACATACGTCATTATTGACGTCAATGG

GCGGGGGTCGTTGGGCGGTCAGCCAGGCGGGCCATTTACCGTAAGTTATGTAAC

GCCTGCAGGTTAATTAAGAACATGTGAGCAAAAGGCCAGCAAAAGGCCAGGAAC
```

```
CGTAAAAAGGCCGCGTTGCTGGCGTTTTTCCATAGGCTCCGCCCCCCTGACGAGC
ATCACAAAAATCGACGCTCAAGTCAGAGGTGGCGAAACCCGACAGGACTATAAA
GATACCAGGCGTTTCCCCCTGGAAGCTCCCTCGTGCGCTCTCCTGTTCCGACCCT
GCCGCTTACCGGATACCTGTCCGCCTTTCTCCCTTCGGGAAGCGTGGCGCTTTCTC
ATAGCTCACGCTGTAGGTATCTCAGTTCGGTGTAGGTCGTTCGCTCCAAGCTGGG
CTGTGTGCACGAACCCCCCGTTCAGCCCGACCGCTGCGCCTTATCCGGTAACTAT
CGTCTTGAGTCCAACCCGGTAAGACACGACTTATCGCCACTGGCAGCAGCCACTG
GTAACAGGATTAGCAGAGCGAGGTATGTAGGCGGTGCTACAGAGTTCTTGAAGT
GGTGGCCTAACTACGGCTACACTAGAAGAACAGTATTTGGTATCTGCGCTCTGCT
GAAGCCAGTTACCTTCGGAAAAAGAGTTGGTAGCTCTTGATCCGGCAAACAAAC
CACCGCTGGTAGCGGTGGTTTTTTTGTTTGCAAGCAGCAGATTACGCGCAGAAAA
AAAGGATCTCAAGAAGATCCTTTGATCTTTTCTACGGGGTCTGACGCTCAGTGGA
ACGAAAACTCACGTTAAGGGATTTTGGTCATGGCTAGTTAATTAACATTTAAATC
AGCGGCCGCAATAAAATATCTTTATTTTCATTACATCTGTGTGTTGGTTTTTTGTG
TGAATCGTAACTAACATACGCTCTCCATCAAAACAAAACGAAACAAAACAAACT
AGCAAAATAGGCTGTCCCCAGTGCAAGTGCAGGTGCCAGAACATTTCTCTATCGA
A

SEQ ID NO 7,830:
GGATCTGCGATCGCTCCGGTGCCCGTCAGTGGGCAGAGCGCACATCGCCCACAG
TCCCCGAGAAGTTGGGGGGAGGGGTCGGCAATTGAACGGGTGCCTAGAGAAGGT
GGCGCGGGGTAAACTGGGAAAGTGATGTCGTGTACTGGCTCCGCCTTTTTCCCGA
GGGTGGGGGAGAACCGTATATAAGTGCAGTAGTCGCCGTGAACGTTCTTTTTCGC
AACGGGTTTGCCGCCAGAACACAGCTGAAGCTTCGAGGGGCTCGCATCTCTCCTT
CACGCGCCCGCCGCCCTACCTGAGGCCGCCATCCACGCCGGTTGAGTCGCGTTCT
GCCGCCTCCCGCCTGTGGTGCCTCCTGAACTGCGTCCGCCGTCTAGGTAAGTTTA
AAGCTCAGGTCGAGACCGGGCCTTTGTCCGGCGCTCCCTTGGAGCCTACCTAGAC
TCAGCCGGCTCTCCACGCTTTGCCTGACCCTGCTTGCTCAACTCTACGTCTTTGTT
TCGTTTTCTGTTCTGCGCCGTTACAGATCCAAGCTGTGACCGGCGCCTACCTGAG
ATCAACATGTACAGGATGCAACTCCTGTCTTGCATTGCACTAAGTCTTGCACTTG
TCACGAATTCAGATATCCAGATGACCCAGTCCCCGAGCTCCCTGTCCGCCTCTGT
GGGCGATAGGGTCACCATCACCTGCCGTGCCAGTCAGTCCGTGTCCAGCGCTGTA
GCCTGGTATCAACAGAAACCAGGAAAAGCTCCGAAGCTTCTGATTTACTCGGCAT
CCAGCCTCTACTCTGGAGTCCCTTCTCGCTTCTCTGGTAGCCGTTCCGGGACGGAT
TTCACTCTGACCATCAGCAGTCTGCAGCCGGAAGACTTCGCAACTTATTACTGTC
AGCAATGGTACCATTACTCTTACCCGATCACGTTCGGACAGGGTACCAAGGTGGA
GATCAAACGACTCGAGATCAAACGGGCAGATGCTGCACCAACTGTATCCATCTTC
CCACCATCCAGTGAGCAGTTAACATCTGGAGGTGCCTCAGTCGTGTGCTTCTTGA
ACAACTTCTACCCCAAAGACATCAATGTCAAGTGGAAGATTGATGGCAGTGAAC
GACAAAATGGCGTCCTGAACAGTTGGACTGATCAGGACAGCAAAGACAGCACCT
ACAGCATGAGCAGCACCCTCACGTTGACCAAGGACAGAGTATGAACGCACATAACA
GCTATACCTGTGAGGCCACTCACAAGACATCAACTTCACCCATTGTCAAGAGCTT
```

```
CAACAGGAATGAGTGTTAGAGACAAAGGTCCTGAGAGCTAGCTGGCCAGACATG

ATAAGATACATTGATGAGTTTGGACAAACCACAACTAGAATGCAGTGAAAAAA

TGCTTTATTTGTGAAATTTGTGATGCTATTGCTTTATTTGTAACCATTATAAGCTG

CAATAAACAAGTTAACAACAACAATTGCATTCATTTTATGTTTCAGGTTCAGGGG

GAGGTGTGGGAGGTTTTTTAAAGCAAGTAAAACCTCTACAAATGTGGTATGGAA

TTAATTCTAAAATACAGCATAGCAAAACTTTAACCTCCAAATCAAGCCTCTACTT

GAATCCTTTTCTGAGGGATGAATAAGGCATAGGCATCAGGGGCTGTTGCCAATGT

GCATTAGCTGTTTGCAGCCTCACCTTCTTTCATGGAGTTTAAGATATAGTGTATTT

TCCCAAGGTTTGAACTAGCTCTTCATTTCTTTATGTTTTAAATGCACTGACCTCCC

ACATTCCCTTTTTAGTAAAATATTCAGAAATAATTTAAATACATCATTGCAATGA

AAATAAATGTTTTTTATTAGGCAGAATCCAGATGCTCAAGGCCCTTCATAATATC

CCCCAGTTTAGTAGTTGGACTTAGGGAACAAAGGAACCTTTAATAGAAATTGGA

CAGCAAGAAAGCGAGCTTCTAGCTTTAGTTCCTGGTGTACTTGAGGGGATGAGT

TCCTCAATGGTGGTTTTGACCAGCTTGCCATTCATCTCAATGAGCACAAAGCAGT

CAGGAGCATAGTCAGAGATGAGCTCTCTGCACATGCCACAGGGGCTGACCACCC

TGATGGATCTGTCCACCTCATCAGAGTAGGGGTGCCTGACAGCCACAATGGTGTC

AAAGTCCTTCTGCCCGTTGCTCACAGCAGACCCAATGGCAATGGCTTCAGCACAG

ACAGTGACCCTGCCAATGTAGGCCTCAATGTGGACAGCAGAGATGATCTCCCCA

GTCTTGGTCCTGATGGCCGCCCCGACATGGTGCTTGTTGTCCTCATAGAGCATGG

TGATCTTCTCAGTGGCGACCTCCACCAGCTCCAGATCCTGCTGAGAGATGTTGAA

GGTCTTCATGATGGCTCCTCctgtcaggagaggaaagagaagaaggttagtaca attgCTATAGTGAGTTGTATTATACTATGCTTATGATTAATTGTCAAACTAGGG CTGCAggggttcatagtgccacttttcctgcactgccccatctcctgccaccct ttcccaggcatagacagtcagtgacttacCAAACTCACAGGAGGGAGAAGGCAG

AAGCTTGAGACAGACCCGCGGGACCGCCGAACTGCGAGGGGACGTGG

CTAGGGCGGCTTCTTTTATGGTGCGCCGGCCCTCGGAGGCAGGGCGCTCGGGGA

GGCCTAGCGGCCAATCTGCGGTGGCAGGAGGCGGGGCCGAAGGCCGTGCCTGAC

CAATCCGGAGCACATAGGAGTCTCAGCCCCCCGCCCCAAAGCAAGGGGAAGTCA

CGCGCCTGTAGCGCCAGCGTGTTGTGAAATGGGGGCTTGGGGGGTTGGGGCCC

TGACTAGTCAAAACAAACTCCCATTGACGTCAATGGGGTGGAGACTTGGAAATC

CCCGTGAGTCAAACCGCTATCCACGCCCATTGATGTACTGCCAAAACCGCATCAT

CATGGTAATAGCGATGACTAATACGTAGATGTACTGCCAAGTAGGAAAGTCCCA

TAAGGTCATGTACTGGGCATAATGCCAGGCGGGCCATTTACCGTCATTGACGTCA

ATAGGGGGCGTACTTGGCATATGATACACTTGATGTACTGCCAAGTGGGCAGTTT

ACCGTAAATACTCCACCCATTGACGTCAATGGAAAGTCCCTATTGGCGTTACTAT

GGGAACATACGTCATTATTGACGTCAATGGGCGGGGTCGTTGGGCGGTCAGCC

AGGCGGGCCATTTACCGTAAGTTATGTAACGCCTGCAGGTTAATTAAGAACATGT

GAGCAAAAGGCCAGCAAAAGGCCAGGAACCGTAAAAAGGCCGCGTTGCTGGCG

TTTTTCCATAGGCTCCGCCCCCCTGACGAGCATCACAAAAATCGACGCTCAAGTC

AGAGGTGGCGAAACCCGACAGGACTATAAAGATACCAGGCGTTTCCCCCTGGAA
```

-continued
GCTCCCTCGTGCGCTCTCCTGTTCCGACCCTGCCGCTTACCGGATACCTGTCCGCC

TTTCTCCCTTCGGGAAGCGTGGCGCTTTCTCATAGCTCACGCTGTAGGTATCTCAG

TTCGGTGTAGGTCGTTCGCTCCAAGCTGGGCTGTGTGCACGAACCCCCCGTTCAG

CCCGACCGCTGCGCCTTATCCGGTAACTATCGTCTTGAGTCCAACCCGGTAAGAC

ACGACTTATCGCCACTGGCAGCAGCCACTGGTAACAGGATTAGCAGAGCGAGGT

ATGTAGGCGGTGCTACAGAGTTCTTGAAGTGGTGGCCTAACTACGGCTACACTAG

AAGAACAGTATTTGGTATCTGCGCTCTGCTGAAGCCAGTTACCTTCGGAAAAAGA

GTTGGTAGCTCTTGATCCGGCAAACAAACCACCGCTGGTAGCGGTGGTTTTTTTG

TTTGCAAGCAGCAGATTACGCGCAGAAAAAAAGGATCTCAAGAAGATCCTTTGA

TCTTTTCTACGGGGTCTGACGCTCAGTGGAACGAAAACTCACGTTAAGGGATTTT

GGTCATGGCTAGTTAATTAACATTTAAATCAGCGGCCGCAATAAAATATCTTTAT

TTTCATTACATCTGTGTGTTGGTTTTTTGTGTGAATCGTAACTAACATACGCTCTC

CATCAAAACAAAACGAAACAAAACAAACTAGCAAAATAGGCTGTCCCCAGTGCA

AGTGCAGGTGCCAGAACATTTCTCTATCGAA

SEQ ID NO 7,831:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCACCGGCGAAGGAGGGCCACCATGTACAGGATGCAACTCCTGTCTTGCATTGC

ACTAAGTCTTGCACTTGTCACGAATTCGGAGGTTCAGCTGGTGGAGTCTGGCGGT

GGCCTGGTGCAGCCAGGGGCTCACTCCGTTTGTCCTGTGCAGCTTCTGGCTTCA

ACTTTTCTTCTTCTTCTATACACTGGGTGCGTCAGGCCCCGGGTAAGGGCCTGGA

ATGGGTTGCATCTATTTCTTCTTCTTATGGCTATACTTATTATGCCGATAGCGTCA

AGGGCCGTTTCACTATAAGCGCAGACACATCCAAAAACACAGCCTACCTACAAA

TGAACAGCTTAAGAGCTGAGGACACTGCCGTCTATTATTGTGCTCGCACTGTTCG

TGGATCCAAAAAACCGTACTTCTCTGGTTGGGCTATGGACTACTGGGGTCAAGGA

ACCCTGGTCACCGTCTCCTCGAGTGCTAGCAGCGCTAAAACGACACCCCCATCTG

TCTATCCACTGGCCCCTGGATCTGCTGCCCAAACTAACTCCATGGTGACCCTGGG

ATGCCTGGTCAAGGGCTATTTCCCTGAGCCAGTGACAGTGACCTGGAACTCTGGA

TCCCTGTCCAGCGGTGTGCACACCTTCCCAGCTGTCCTGCAGTCTGACCTCTACA

CTCTGAGCAGCTCAGTGACTGTCCCCTCCAGCACCTGGCCCAGCGAGACCGTCAC

CTGCAACGTTGCCCACCCGGCCAGCAGCACCAAGGTGGACAAGAAAATTGTGCC

CAGGGATTGTGGTTGTAAGCCTTGCATATGTACAGTCCCAGAAGTATCATCTGTC

TTCATCTTCCCCCCAAAGCCCAAGGATGTGCTCACCATTACTCTGACTCCTAAGG

-continued

```
TCACGTGTGTTGTGGTAGACATCAGCAAGGATGATCCCGAGGTCCAGTTCAGCTG

GTTTGTAGATGATGTGGAGGTGCACACAGCTCAGACGCAACCCCGGGAGGAGCA

GTTCAACAGCACTTTCCGCTCAGTCAGTGAACTTCCCATCATGCACCAGGACTGG

CTCAATGGCAAGGAGTTCAAATGCAGGGTCAACAGTGCAGCTTTCCCTGCCCCCA

TCGAGAAAACCATCTCCAAAACCAAAGGCAGACCGAAGGCTCCGCAGGTGTACA

CCATTCCACCTCCCAAGGAGCAGATGGCCAAGGATAAAGTCAGTCTGACCTGCA

TGATAACAGACTTCTTCCCTGAAGACATTACTGTGGAGTGGCAGTGGAATGGGCA

GCCAGCGGAGAACTACAAGAACACTCAGCCCATCATGGACACAGATGGCTCTTA

CTTCGTCTACAGCAAGCTCAATGTGCAGAAGAGCAACTGGGAGGCAGGAAATAC

TTTCACCTGCTCTGTGTTACATGAGGGCCTGCACAACCACCATACTGAAGAGC

CTCTCCCACTCTCCTGGTAAATGATCCCAGTGTCCCTAGCTGGCCAGACATGATA

AGATACATTGATGAGTTTGGACAAACCACAACTAGAATGCAGTGAAAAAAATGC

TTTATTTGTGAAATTTGTGATGCTATTGCTTTATTTGTAACCATTATAAGCTGCAA

TAAACAAGTTAACAACAACAATTGCATTCATTTTATGTTTCAGGTTCAGGGGGAG

GTGTGGGAGGTTTTTTAAAGCAAGTAAAACCTCTACAAATGTGGTATGGAATTAA

TTCTAAAATACAGCATAGCAAAACTTTAACCTCCAAATCAAGCCTCTACTTGAAT

CCTTTTCTGAGGGATGAATAAGGCATAGGCATCAGGGGCTGTTGCCAATGTGCAT

TAGCTGTTTGCAGCCTCACCTTCTTTCATGGAGTTTAAGATATAGTGTATTTTCCC

AAGGTTTGAACTAGCTCTTCATTTCTTTATGTTTTAAATGCACTGACCTCCCACAT

TCCCTTTTTAGTAAAATATTCAGAAATAATTTAAATACATCATTGCAATGAAAAT

AAATGTTTTTATTAGGCAGAATCCAGATGCTCAAGGCCCTTCATAATATCCCCC

AGTTTAGTAGTTGGACTTAGGGAACAAAGGAACCTTTAATAGAAATTGGACAGC

AAGAAAGCGAGCTTCTAGCTTATCCTCAGTCCTGCTCCTCTGCCACAAAGTGCAC

GCAGTTGCCGGCCGGGTCGCGCAGGGCGAACTCCCGCCCCCACGGCTGCTCGCC

GATCTCGGTCATGGCCGGCCCGGAGGCGTCCCGGAAGTTCGTGGACACGACCTC

CGACCACTCGGCGTACAGCTCGTCCAGGCCGCGCACCCACACCCAGGCCAGGGT

GTTGTCCGGCACCACCTGGTCCTGGACCGCGCTGATGAACAGGGTCACGTCGTCC

CGGACCACACCGGCGAAGTCGTCCTCCACGAAGTCCCGGGAGAACCCGAGCCGG

TCGGTCCAGAACTCGACCGCTCCGGCGACGTCGCGCGCGGTGAGCACCGGAACG

GCACTGGTCAACTTGGCCATGATGGCTCCTCctgtcaggagaggaaagagaag aaggttagtacaattgCTATAGTGAGTTGTATTATACTATGCAGATATACTAT GCCAATGATTAATTGTCAAACTAGGGCTGCAgggttcatagtgccacttttcc tgcactgccccatctcctgcccacccttcccaggcatagacagtcagtgact tacCAAACTCACAGGAGGGAGAAGGCAGAAGCTTGAGACAGACCCGCGGGACC

GCCGAACTGCGAGGGGACGTGGCTAGGGCGGCTTCTTTTATGGTGCGCCGGCC

CTCGGAGGCAGGGCGCTCGGGGAGGCCTAGCGGCCAATCTGCGGTGGCAGGAGG

CGGGGCCGAAGGCCGTGCCTGACCAATCCGGAGCACATAGGAGTCTCAGCCCCC

CGCCCCAAAGCAAGGGGAAGTCACGCGCCTGTAGCGCCAGCGTGTTGTGAAATG

GGGGCTTGGGGGGTTGGGGCCCTGACTAGTCAAAACAAACTCCCATTGACGTC

AATGGGGTGGAGACTTGGAAATCCCCGTGAGTCAAACCGCTATCCACGCCCATT

GATGTACTGCCAAAACCGCATCATCATGGTAATAGCGATGACTAATACGTAGAT
```

-continued

```
GTACTGCCAAGTAGGAAAGTCCCATAAGGTCATGTACTGGGCATAATGCCAGGC

GGGCCATTTACCGTCATTGACGTCAATAGGGGGCGTACTTGGCATATGATACACT

TGATGTACTGCCAAGTGGGCAGTTTACCGTAAATACTCCACCCATTGACGTCAAT

GGAAAGTCCCTATTGGCGTTACTATGGGAACATACGTCATTATTGACGTCAATGG

GCGGGGTCGTTGGGCGGTCAGCCAGGCGGGCCATTTACCGTAAGTTATGTAAC

GCCTGCAGGTTAATTAAGAACATGTGAGCAAAAGGCCAGCAAAAGGCCAGGAAC

CGTAAAAAGGCCGCGTTGCTGGCGTTTTCCATAGGCTCCGCCCCCCTGACGAGC

ATCACAAAAATCGACGCTCAAGTCAGAGGTGGCGAAACCCGACAGGACTATAAA

GATACCAGGCGTTTCCCCCTGGAAGCTCCCTCGTGCGCTCTCCTGTTCCGACCCT

GCCGCTTACCGGATACCTGTCCGCCTTTCTCCCTTCGGGAAGCGTGGCGCTTTCTC

ATAGCTCACGCTGTAGGTATCTCAGTTCGGTGTAGGTCGTTCGCTCCAAGCTGGG

CTGTGTGCACGAACCCCCCGTTCAGCCCGACCGCTGCGCCTTATCCGGTAACTAT

CGTCTTGAGTCCAACCCGGTAAGACACGACTTATCGCCACTGGCAGCAGCCACTG

GTAACAGGATTAGCAGAGCGAGGTATGTAGGCGGTGCTACAGAGTTCTTGAAGT

GGTGGCCTAACTACGGCTACACTAGAAGAACAGTATTTGGTATCTGCGCTCTGCT

GAAGCCAGTTACCTTCGGAAAAAGAGTTGGTAGCTCTTGATCCGGCAAACAAAC

CACCGCTGGTAGCGGTGGTTTTTTTGTTTGCAAGCAGCAGATTACGCGCAGAAAA

AAAGGATCTCAAGAAGATCCTTTGATCTTTTCTACGGGGTCTGACGCTCAGTGGA

ACGAAAACTCACGTTAAGGGATTTTGGTCATGGCTAGTTAATTAACATTTAAATC

AGCGGCCGCAATAAAATATCTTTATTTTCATTACATCTGTGTGTTGGTTTTTTGTG

TGAATCGTAACTAACATACGCTCTCCATCAAAACAAAACGAAACAAAACAAACT

AGCAAAATAGGCTGTCCCCAGTGCAAGTGCAGGTGCCAGAACATTTCTCTATCGA

A

SEQ ID NO 7,832:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG

TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAATCTTCTTATTCTCTGATCACGTTCGGACAGGGTACCAAGGTGGAGATCAA
```

-continued

```
ACGACTCGAGATCAAACGGGCAGATGCTGCACCAACTGTATCCATCTTCCCACCA

TCCAGTGAGCAGTTAACATCTGGAGGTGCCTCAGTCGTGTGCTTCTTGAACAACT

TCTACCCCAAAGACATCAATGTCAAGTGGAAGATTGATGGCAGTGAACGACAAA

ATGGCGTCCTGAACAGTTGGACTGATCAGGACAGCAAAGACAGCACCTACAGCA

TGAGCAGCACCCTCACGTTGACCAAGGACGAGTATGAACGACATAACAGCTATA

CCTGTGAGGCCACTCACAAGACATCAACTTCACCCATTGTCAAGAGCTTCAACAG

GAATGAGTGTTAGAGACAAAGGTCCTGAGAGCTAGCTGGCCAGACATGATAAGA

TACATTGATGAGTTTGGACAAACCACAACTAGAATGCAGTGAAAAAAATGCTTT

ATTTGTGAAATTTGTGATGCTATTGCTTTATTTGTAACCATTATAAGCTGCAATAA

ACAAGTTAACAACAACAATTGCATTCATTTTATGTTTCAGGTTCAGGGGAGGTG

TGGGAGGTTTTTTAAAGCAAGTAAAACCTCTACAAATGTGGTATGGAATTAATTC

TAAAATACAGCATAGCAAAACTTTAACCTCCAAATCAAGCCTCTACTTGAATCCT

TTTCTGAGGGATGAATAAGGCATAGGCATCAGGGGCTGTTGCCAATGTGCATTAG

CTGTTTGCAGCCTCACCTTCTTTCATGGAGTTTAAGATATAGTGTATTTTCCCAAG

GTTTGAACTAGCTCTTCATTTCTTTATGTTTTAAATGCACTGACCTCCCACATTCC

CTTTTTAGTAAAATATTCAGAAATAATTTAAATACATCATTGCAATGAAAATAAA

TGTTTTTTATTAGGCAGAATCCAGATGCTCAAGGCCCTTCATAATATCCCCCAGTT

TAGTAGTTGGACTTAGGGAACAAAGGAACCTTTAATAGAAATTGGACAGCAAGA

AAGCGAGCTTCTAGCTTTAGTTCCTGGTGTACTTGAGGGGATGAGTTCCTCAAT

GGTGGTTTTGACCAGCTTGCCATTCATCTCAATGAGCACAAAGCAGTCAGGAGCA

TAGTCAGAGATGAGCTCTCTGCACATGCCACAGGGGCTGACCACCCTGATGGATC

TGTCCACCTCATCAGAGTAGGGGTGCCTGACAGCCACAATGGTGTCAAAGTCCTT

CTGCCCGTTGCTCACAGCAGACCCAATGGCAATGGCTTCAGCACAGACAGTGAC

CCTGCCAATGTAGGCCTCAATGTGGACAGCAGAGATGATCTCCCCAGTCTTGGTC

CTGATGGCCGCCCCGACATGGTGCTTGTTGTCCTCATAGAGCATGGTGATCTTCT

CAGTGGCGACCTCCACCAGCTCCAGATCCTGCTGAGAGATGTTGAAGGTCTTCAT

GATGGCTCCTCctgtcaggagaggaaagagaagaaggttagtacaattgCTATA

GTGAGTTGTATTATACTATGCTTATGATTAATTGTCAAACTAGGGCTGCAgggt tcatagtgccacttttcctgcactgccccatctcctgccaccattcccaggca tagacagtcagtgacttacCAAACTCACAGGAGGGAGAAGGCAGAAGCTTGAG

ACAGACCCGCGGGACCGCCGAACTGCGAGGGGACGTGGCTAGGGCGGC

TTCTTTTATGGTGCGCCGGCCCTCGGAGGCAGGGCGCTCGGGGAGGCCTAGCG

GCCAATCTGCGGTGGCAGGAGGCGGGGCCGAAGGCCGTGCCTGACCAATCCGGA

GCACATAGGAGTCTCAGCCCCCCGCCCCAAAGCAAGGGGAAGTCACGCGCCTGT

AGCGCCAGCGTGTTGTGAAATGGGGGCTTGGGGGGGTTGGGGCCCTGACTAGTC

AAAACAAACTCCCATTGACGTCAATGGGGTGGAGACTTGGAAATCCCCGTGAGT

CAAACCGCTATCCACGCCCATTGATGTACTGCCAAAACCGCATCATCATGGTAAT

AGCGATGACTAATACGTAGATGTACTGCCAAGTAGGAAAGTCCCATAAGGTCAT

GTACTGGGCATAATGCCAGGCGGGCCATTTACCGTCATTGACGTCAATAGGGGG

CGTACTTGGCATATGATACACTTGATGTACTGCCAAGTGGGCAGTTTACCGTAAA
```

-continued

TACTCCACCCATTGACGTCAATGGAAAGTCCCTATTGGCGTTACTATGGGAACAT

ACGTCATTATTGACGTCAATGGGCGGGGGTCGTTGGGCGGTCAGCCAGGCGGGC

CATTTACCGTAAGTTATGTAACGCCTGCAGGTTAATTAAGAACATGTGAGCAAAA

GGCCAGCAAAAGGCCAGGAACCGTAAAAAGGCCGCGTTGCTGGCGTTTTTCCAT

AGGCTCCGCCCCCCTGACGAGCATCACAAAAATCGACGCTCAAGTCAGAGGTGG

CGAAACCCGACAGGACTATAAAGATACCAGGCGTTTCCCCCTGGAAGCTCCCTC

GTGCGCTCTCCTGTTCCGACCCTGCCGCTTACCGGATACCTGTCCGCCTTTCTCCC

TTCGGGAAGCGTGGCGCTTTCTCATAGCTCACGCTGTAGGTATCTCAGTTCGGTG

TAGGTCGTTCGCTCCAAGCTGGGCTGTGTGCACGAACCCCCCGTTCAGCCCGACC

GCTGCGCCTTATCCGGTAACTATCGTCTTGAGTCCAACCCGGTAAGACACGACTT

ATCGCCACTGGCAGCAGCCACTGGTAACAGGATTAGCAGAGCGAGGTATGTAGG

CGGTGCTACAGAGTTCTTGAAGTGGTGGCCTAACTACGGCTACACTAGAAGAAC

AGTATTTGGTATCTGCGCTCTGCTGAAGCCAGTTACCTTCGGAAAAAGAGTTGGT

AGCTCTTGATCCGGCAAACAAACCACCGCTGGTAGCGGTGGTTTTTTTGTTTGCA

AGCAGCAGATTACGCGCAGAAAAAAAGGATCTCAAGAAGATCCTTTGATCTTTT

CTACGGGGTCTGACGCTCAGTGGAACGAAAACTCACGTTAAGGGATTTTGGTCAT

GGCTAGTTAATTAACATTTAAATCAGCGGCCGCAATAAAATATCTTTATTTTCATT

ACATCTGTGTGTTGGTTTTTTGTGTGAATCGTAACTAACATACGCTCTCCATCAAA

ACAAAACGAAACAAACAAACTAGCAAAATAGGCTGTCCCCAGTGCAAGTGCAG

GTGCCAGAACATTTCTCTATCGAA

SEQ ID NO 7,833:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCACCGGCGAAGGAGGGCCACCATGTACAGGATGCAACTCCTGTCTTGCATTGC

ACTAAGTCTTGCACTTGTCACGAATTCGGAGGTTCAGCTGGTGGAGTCTGGCGGT

GGCCTGGTGCAGCCAGGGGGCTCACTCCGTTTGTCCTGTGCAGCTTCTGGCTTCA

ACCTCTATTATTATTATATGCACTGGGTGCGTCAGGCCCCGGGTAAGGGCCTGGA

ATGGGTTGCATATATTTCTCCTTCTTATGGCTATACTTATTATGCCGATAGCGTCA

AGGGCCGTTTCACTATAAGCGCAGACACATCCAAAAACACAGCCTACCTACAAA

TGAACAGCTTAAGAGCTGAGGACACTGCCGTCTATTATTGTGCTCGCTCTTCTTCT

GGTTACTCTTACGGTGCTTTCTACTACCCGTCTGCTATTGACTACTGGGGTCAAGG

AACCCTGGTCACCGTCTCCTCGAGTGCTAGCAGCGCTAAAACGACACCCCCATCT

GTCTATCCACTGGCCCCTGGATCTGCTGCCCAAACTAACTCCATGGTGACCCTGG

```
GATGCCTGGTCAAGGGCTATTTCCCTGAGCCAGTGACAGTGACCTGGAACTCTGG

ATCCCTGTCCAGCGGTGTGCACACCTTCCCAGCTGTCCTGCAGTCTGACCTCTAC

ACTCTGAGCAGCTCAGTGACTGTCCCCTCCAGCACCTGGCCCAGCGAGACCGTCA

CCTGCAACGTTGCCCACCCGGCCAGCAGCACCAAGGTGGACAAGAAAATTGTGC

CCAGGGATTGTGGTTGTAAGCCTTGCATATGTACAGTCCCAGAAGTATCATCTGT

CTTCATCTTCCCCCCAAAGCCCAAGGATGTGCTCACCATTACTCTGACTCCTAAG

GTCACGTGTGTTGTGGTAGACATCAGCAAGGATGATCCCGAGGTCCAGTTCAGCT

GGTTTGTAGATGATGTGGAGGTGCACACAGCTCAGACGCAACCCCGGGAGGAGC

AGTTCAACAGCACTTTCCGCTCAGTCAGTGAACTTCCCATCATGCACCAGGACTG

GCTCAATGGCAAGGAGTTCAAATGCAGGGTCAACAGTGCAGCTTTCCCTGCCCCC

ATCGAGAAACCATCTCCAAAACCAAAGGCAGACCGAAGGCTCCGCAGGTGTAC

ACCATTCCACCTCCCAAGGAGCAGATGGCCAAGGATAAAGTCAGTCTGACCTGC

ATGATAACAGACTTCTTCCCTGAAGACATTACTGTGGAGTGGCAGTGGAATGGGC

AGCCAGCGGAGAACTACAAGAACACTCAGCCCATCATGGACACAGATGGCTCTT

ACTTCGTCTACAGCAAGCTCAATGTGCAGAAGAGCAACTGGGAGGCAGGAAATA

CTTTCACCTGCTCTGTGTTACATGAGGGCCTGCACAACCACCATACTGAGAAGAG

CCTCTCCCACTCTCCTGGTAAATGATCCCAGTGTCCCTAGCTGGCCAGACATGAT

AAGATACATTGATGAGTTTGGACAAACCACAACTAGAATGCAGTGAAAAAAATG

CTTTATTTGTGAAATTTGTGATGCTATTGCTTTATTTGTAACCATTATAAGCTGCA

ATAAACAAGTTAACAACAACAATTGCATTCATTTTATGTTTCAGGTTCAGGGGGA

GGTGTGGGAGGTTTTTTAAAGCAAGTAAAACCTCTACAAATGTGGTATGGAATTA

ATTCTAAAATACAGCATAGCAAAACTTTAACCTCCAAATCAAGCCTCTACTTGAA

TCCTTTTCTGAGGGATGAATAAGGCATAGGCATCAGGGGCTGTTGCCAATGTGCA

TTAGCTGTTTGCAGCCTCACCTTCTTTCATGGAGTTTAAGATATAGTGTATTTTCC

CAAGGTTTGAACTAGCTCTTCATTTCTTTATGTTTTAAATGCACTGACCTCCCACA

TTCCCTTTTTAGTAAAATATTCAGAAATAATTTAAATACATCATTGCAATGAAAA

TAAATGTTTTTTATTAGGCAGAATCCAGATGCTCAAGGCCCTTCATAATATCCCC

CAGTTTAGTAGTTGGACTTAGGGAACAAAGGAACCTTTAATAGAAATTGGACAG

CAAGAAAGCGAGCTTCTAGCTTATCCTCAGTCCTGCTCCTCTGCCACAAAGTGCA

CGCAGTTGCCGGCCGGGTCGCGCAGGGCGAACTCCCGCCCCCACGGCTGCTCGC

CGATCTCGGTCATGGCCGGCCCGGAGGCGTCCCGGAAGTTCGTGGACACGACCT

CCGACCACTCGGCGTACAGCTCGTCCAGGCCGCGCACCCACACCCAGGCCAGGG

TGTTGTCCGGCACCACCTGGTCCTGGACCGCGCTGATGAACAGGGTCACGTCGTC

CCGGACCACACCGGCGAAGTCGTCCTCCACGAAGTCCCGGGAGAACCCGAGCCG

GTCGGTCCAGAACTCGACCGCTCCGGCGACGTCGCGCGCGGTGAGCACCGGAAC

GGCACTGGTCAACTTGGCCATGATGGCTCCTCctgtcaggagaggaaagagaag aaggttagtacaattgCTATAGTGAGTTGTATTATACTATGCAGATATACTATG CCAATGATTAATTGTCAAACTAGGGCTGCAgggttcatagtgccacttttcct gcactgccccatctcctgcccacccttttcccaggcatagacagtcagtg acttacCAAACTCACAGGAGGGAGAAGGCAGAAGCTTGAGACAGACCCGCGGGA

CCGCCGAACTGCGAGGGGACGTGGCTAGGGCGGCTTCTTTTATGGTGCGCCGGCC
```

```
CTCGGAGGCAGGGCGCTCGGGGAGGCCTAGCGGCCAATCTGCGGTGGCAGGAGG

CGGGGCCGAAGGCCGTGCCTGACCAATCCGGAGCACATAGGAGTCTCAGCCCCC

CGCCCCAAAGCAAGGGGAAGTCACGCGCCTGTAGCGCCAGCGTGTTGTGAAATG

GGGGCTTGGGGGGGTTGGGGCCCTGACTAGTCAAAACAAACTCCCATTGACGTC

AATGGGGTGGAGACTTGGAAATCCCCGTGAGTCAAACCGCTATCCACGCCCATT

GATGTACTGCCAAAACCGCATCATCATGGTAATAGCGATGACTAATACGTAGAT

GTACTGCCAAGTAGGAAAGTCCCATAAGGTCATGTACTGGGCATAATGCCAGGC

GGGCCATTTACCGTCATTGACGTCAATAGGGGGCGTACTTGGCATATGATACACT

TGATGTACTGCCAAGTGGGCAGTTTACCGTAAATACTCCACCCATTGACGTCAAT

GGAAAGTCCCTATTGGCGTTACTATGGGAACATACGTCATTATTGACGTCAATGG

GCGGGGGTCGTTGGGCGGTCAGCCAGGCGGGCCATTTACCGTAAGTTATGTAAC

GCCTGCAGGTTAATTAAGAACATGTGAGCAAAAGGCCAGCAAAAGGCCAGGAAC

CGTAAAAAGGCCGCGTTGCTGGCGTTTTTCCATAGGCTCCGCCCCCCTGACGAGC

ATCACAAAAATCGACGCTCAAGTCAGAGGTGGCGAAACCCGACAGGACTATAAA

GATACCAGGCGTTTCCCCCTGGAAGCTCCCTCGTGCGCTCTCCTGTTCCGACCCT

GCCGCTTACCGGATACCTGTCCGCCTTTCTCCCTTCGGGAAGCGTGGCGCTTTCTC

ATAGCTCACGCTGTAGGTATCTCAGTTCGGTGTAGGTCGTTCGCTCCAAGCTGGG

CTGTGTGCACGAACCCCCCGTTCAGCCCGACCGCTGCGCCTTATCCGGTAACTAT

CGTCTTGAGTCCAACCCGGTAAGACACGACTTATCGCCACTGGCAGCAGCCACTG

GTAACAGGATTAGCAGAGCGAGGTATGTAGGCGGTGCTACAGAGTTCTTGAAGT

GGTGGCCTAACTACGGCTACACTAGAAGAACAGTATTTGGTATCTGCGCTCTGCT

GAAGCCAGTTACCTTCGGAAAAAGAGTTGGTAGCTCTTGATCCGGCAAACAAAC

CACCGCTGGTAGCGGTGGTTTTTTTGTTTGCAAGCAGCAGATTACGCGCAGAAAA

AAAGGATCTCAAGAAGATCCTTTGATCTTTTCTACGGGGTCTGACGCTCAGTGGA

ACGAAAACTCACGTTAAGGGATTTTGGTCATGGCTAGTTAATTAACATTTAAATC

AGCGGCCGCAATAAAATATCTTTATTTTCATTACATCTGTGTGTTGGTTTTTTGTG

TGAATCGTAACTAACATACGCTCTCCATCAAAACAAAACGAAACAAAACAAACT

AGCAAAATAGGCTGTCCCCAGTGCAAGTGCAGGTGCCAGAACATTTCTCTATCGA

A

SEQ ID NO 7,834:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG
```

-continued

```
TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAAGGTTACGACCTGATCACGTTCGGACAGGGTACCAAGGTGGAGATCAAAC

GACTCGAGATCAAACGGGCAGATGCTGCACCAACTGTATCCATCTTCCCACCATC

CAGTGAGCAGTTAACATCTGGAGGTGCCTCAGTCGTGTGCTTCTTGAACAACTTC

TACCCCAAAGACATCAATGTCAAGTGGAAGATTGATGGCAGTGAACGACAAAAT

GGCGTCCTGAACAGTTGGACTGATCAGGACAGCAAAGACAGCACCTACAGCATG

AGCAGCACCCTCACGTTGACCAAGGACGAGTATGAACGACATAACAGCTATACC

TGTGAGGCCACTCACAAGACATCAACTTCACCCATTGTCAAGAGCTTCAACAGGA

ATGAGTGTTAGAGACAAAGGTCCTGAGAGCTAGCTGGCCAGACATGATAAGATA

CATTGATGAGTTTGGACAAACCACAACTAGAATGCAGTGAAAAAAATGCTTTATT

TGTGAAATTTGTGATGCTATTGCTTTATTTGTAACCATTATAAGCTGCAATAAACA

AGTTAACAACAACAATTGCATTCATTTTATGTTTCAGGTTCAGGGGAGGTGTGG

GAGGTTTTTTAAAGCAAGTAAAACCTCTACAAATGTGGTATGGAATTAATTCTAA

AATACAGCATAGCAAAACTTTAACCTCCAAATCAAGCCTCTACTTGAATCCTTTT

CTGAGGGATGAATAAGGCATAGGCATCAGGGGCTGTTGCCAATGTGCATTAGCT

GTTTGCAGCCTCACCTTCTTTCATGGAGTTTAAGATATAGTGTATTTTCCCAAGGT

TTGAACTAGCTCTTCATTTCTTTATGTTTTAAATGCACTGACCTCCCACATTCCCTT

TTTAGTAAAATATTCAGAAATAATTTAAATACATCATTGCAATGAAAATAAATGT

TTTTTATTAGGCAGAATCCAGATGCTCAAGGCCCTTCATAATATCCCCCAGTTTA

GTAGTTGGACTTAGGGAACAAAGGAACCTTTAATAGAAATTGGACAGCAAGAAA

GCGAGCTTCTAGCTTTAGTTCCTGGTGTACTTGAGGGGGATGAGTTCCTCAATGG

TGGTTTTGACCAGCTTGCCATTCATCTCAATGAGCACAAAGCAGTCAGGAGCATA

GTCAGAGATGAGCTCTCTGCACATGCCACAGGGGCTGACCACCCTGATGGATCTG

TCCACCTCATCAGAGTAGGGGTGCCTGACAGCCACAATGGTGTCAAAGTCCTTCT

GCCCGTTGCTCACAGCAGACCCAATGGCAATGGCTTCAGCACAGACAGTGACCC

TGCCAATGTAGGCCTCAATGTGGACAGCAGAGATGATCTCCCCAGTCTTGGTCCT

GATGGCCGCCCCGACATGGTGCTTGTTGTCCTCATAGAGCATGGTGATCTTCTCA

GTGGCGACCTCCACCAGCTCCAGATCCTGCTGAGAGATGTTGAAGGTCTTCATGA

TGGCTCCTCctgtcaggagaggaaagagaagaaggttagtacaattgCTATAGT

GAGTTGTATTATACTATGCTTATGATTAATTGTCAAACTAGGGCTGCAgggtt catagtgccacttttcctgcactgccccatctcctgccaccctttccca ggcatagacagtcagtgacttacCAAACTCACAGGAGGGAGAAGGCAGAAGC

TTGAGACAGACCCGCGGGACCGCCGAACTGCGAGGGGACGTGGCTAGGGCGGCT

TCTTTTATGGTGCGCCGGCCCTCGGAGGCAGGGCGCTCGGGGAGGCCTAGCGGC

CAATCTGCGGTGGCAGGAGGCGGGGCCGAAGGCCGTGCCTGACCAATCCGGAGC

ACATAGGAGTCTCAGCCCCCCGCCCCAAAGCAAGGGGAAGTCACGCGCCTGTAG
```

-continued
CGCCAGCGTGTTGTGAAATGGGGGCTTGGGGGGGTTGGGGCCCTGACTAGTCAA

AACAAACTCCCATTGACGTCAATGGGGTGGAGACTTGGAAATCCCCGTGAGTCA

AACCGCTATCCACGCCCATTGATGTACTGCCAAAACCGCATCATCATGGTAATAG

CGATGACTAATACGTAGATGTACTGCCAAGTAGGAAAGTCCCATAAGGTCATGT

ACTGGGCATAATGCCAGGCGGGCCATTTACCGTCATTGACGTCAATAGGGGCG

TACTTGGCATATGATACACTTGATGTACTGCCAAGTGGGCAGTTTACCGTAAATA

CTCCACCCATTGACGTCAATGGAAAGTCCCTATTGGCGTTACTATGGGAACATAC

GTCATTATTGACGTCAATGGGCGGGGGTCGTTGGGCGGTCAGCCAGGCGGGCCA

TTTACCGTAAGTTATGTAACGCCTGCAGGTTAATTAAGAACATGTGAGCAAAAGG

CCAGCAAAAGGCCAGGAACCGTAAAAAGGCCGCGTTGCTGGCGTTTTTCCATAG

GCTCCGCCCCCTGACGAGCATCACAAAAATCGACGCTCAAGTCAGAGGTGGCG

AAACCCGACAGGACTATAAAGATACCAGGCGTTTCCCCCTGGAAGCTCCCTCGT

GCGCTCTCCTGTTCCGACCCTGCCGCTTACCGGATACCTGTCCGCCTTTCTCCCTT

CGGGAAGCGTGGCGCTTTCTCATAGCTCACGCTGTAGGTATCTCAGTTCGGTGTA

GGTCGTTCGCTCCAAGCTGGGCTGTGTGCACGAACCCCCCGTTCAGCCCGACCGC

TGCGCCTTATCCGGTAACTATCGTCTTGAGTCCAACCCGGTAAGACACGACTTAT

CGCCACTGGCAGCAGCCACTGGTAACAGGATTAGCAGAGCGAGGTATGTAGGCG

GTGCTACAGAGTTCTTGAAGTGGTGGCCTAACTACGGCTACACTAGAAGAACAG

TATTTGGTATCTGCGCTCTGCTGAAGCCAGTTACCTTCGGAAAAAGAGTTGGTAG

CTCTTGATCCGGCAAACAAACCACCGCTGGTAGCGGTGGTTTTTTTGTTTGCAAG

CAGCAGATTACGCGCAGAAAAAAAGGATCTCAAGAAGATCCTTTGATCTTTTCTA

CGGGGTCTGACGCTCAGTGGAACGAAAACTCACGTTAAGGGATTTTGGTCATGG

CTAGTTAATTAACATTTAAATCAGCGGCCGCAATAAAATATCTTTATTTTCATTAC

ATCTGTGTGTTGGTTTTTTGTGTGAATCGTAACTAACATACGCTCTCCATCAAAAC

AAAACGAAACAAAACAAACTAGCAAAATAGGCTGTCCCCAGTGCAAGTGCAGGT

GCCAGAACATTTCTCTATCGAA

SEQ ID NO 7,835:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCACCGGCGAAGGAGGGCCACCATGTACAGGATGCAACTCCTGTCTTGCATTGC

ACTAAGTCTTGCACTTGTCACGAATTCGGAGGTTCAGCTGGTGGAGTCTGGCGGT

GGCCTGGTGCAGCCAGGGGGCTCACTCCGTTTGTCCTGTGCAGCTTCTGGCTTCA

ACCTCTATTATTATTCTATCCACTGGGTGCGTCAGGCCCCGGGTAAGGGCCTGGA

-continued
```
ATGGGTTGCATCTATTTCTTCTTATTATAGCTCTACTTCTTATGCCGATAGCGTCA

AGGGCCGTTTCACTATAAGCGCAGACACATCCAAAAACACAGCCTACCTACAAA

TGAACAGCTTAAGAGCTGAGGACACTGCCGTCTATTATTGTGCTCGCTTCTACTC

TGGTTACGCTGGTATGGACTACTGGGGTCAAGGAACCCTGGTCACCGTCTCCTCG

AGTGCTAGCAGCGCTAAAACGACACCCCCATCTGTCTATCCACTGGCCCCTGGAT

CTGCTGCCCAAACTAACTCCATGGTGACCCTGGGATGCCTGGTCAAGGGCTATTT

CCCTGAGCCAGTGACAGTGACCTGGAACTCTGGATCCCTGTCCAGCGGTGTGCAC

ACCTTCCCAGCTGTCCTGCAGTCTGACCTCTACACTCTGAGCAGCTCAGTGACTG

TCCCCTCCAGCACCTGGCCCAGCGAGACCGTCACCTGCAACGTTGCCCACCCGGC

CAGCAGCACCAAGGTGGACAAGAAAATTGTGCCCAGGGATTGTGGTTGTAAGCC

TTGCATATGTACAGTCCCAGAAGTATCATCTGTCTTCATCTTCCCCCCAAAGCCCA

AGGATGTGCTCACCATTACTCTGACTCCTAAGGTCACGTGTGTTGTGGTAGACAT

CAGCAAGGATGATCCCGAGGTCCAGTTCAGCTGGTTTGTAGATGATGTGGAGGT

GCACACAGCTCAGACGCAACCCCGGGAGGAGCAGTTCAACAGCACTTTCCGCTC

AGTCAGTGAACTTCCCATCATGCACCAGGACTGGCTCAATGGCAAGGAGTTCAA

ATGCAGGGTCAACAGTGCAGCTTTCCCTGCCCCCATCGAGAAAACCATCTCCAAA

ACCAAAGGCAGACCGAAGGCTCCGCAGGTGTACACCATTCCACCTCCCAAGGAG

CAGATGGCCAAGGATAAAGTCAGTCTGACCTGCATGATAACAGACTTCTTCCCTG

AAGACATTACTGTGGAGTGGCAGTGGAATGGGCAGCAGCGGAGAACTACAAGA

ACACTCAGCCCATCATGGACACAGATGGCTCTTACTTCGTCTACAGCAAGCTCAA

TGTGCAGAAGAGCAACTGGGAGGCAGGAAATACTTTCACCTGCTCTGTGTTACAT

GAGGGCCTGCACAACCACCATACTGAGAAGAGCCTCTCCCACTCTCCTGGTAAAT

GATCCCAGTGTCCCTAGCTGGCCAGACATGATAAGATACATTGATGAGTTTGGAC

AAACCACAACTAGAATGCAGTGAAAAAAATGCTTTATTTGTGAAATTTGTGATGC

TATTGCTTTATTTGTAACCATTATAAGCTGCAATAAACAAGTTAACAACAACAAT

TGCATTCATTTTATGTTTCAGGTTCAGGGGGAGGTGTGGGAGGTTTTTTAAAGCA

AGTAAAACCTCTACAAATGTGGTATGGAATTAATTCTAAAATACAGCATAGCAA

AACTTTAACCTCCAAATCAAGCCTCTACTTGAATCCTTTTCTGAGGGATGAATAA

GGCATAGGCATCAGGGGCTGTTGCCAATGTGCATTAGCTGTTTGCAGCCTCACCT

TCTTTCATGGAGTTTAAGATATAGTGTATTTTCCCAAGGTTTGAACTAGCTCTTCA

TTTCTTTATGTTTTAAATGCACTGACCTCCCACATTCCCTTTTTAGTAAAATATTC

AGAAATAATTTAAATACATCATTGCAATGAAAATAAATGTTTTTTATTAGGCAGA

ATCCAGATGCTCAAGGCCCTTCATAATATCCCCCAGTTTAGTAGTTGGACTTAGG

GAACAAAGGAACCTTTAATAGAAATTGGACAGCAAGAAAGCGAGCTTCTAGCTT

ATCCTCAGTCCTGCTCCTCTGCCACAAAGTGCACGCAGTTGCCGGCCGGGTCGCG

CAGGGCGAACTCCCGCCCCCACGGCTGCTCGCCGATCTCGGTCATGGCCGGCCCG

GAGGCGTCCCGGAAGTTCGTGGACACGACCTCCGACCACTCGGCGTACAGCTCG

TCCAGGCCGCGCACCCACACCCAGGCCAGGGTGTTGTCCGGCACCACCTGGTCCT

GGACCGCGCTGATGAACAGGGTCACGTCGTCCCGGACCACACCGGCGAAGTCGT

CCTCCACGAAGTCCCGGGAGAACCCGAGCCGGTCGGTCCAGAACTCGACCGCTC

CGGCGACGTCGCGCGCGGTGAGCACCGGAACGGCACTGGTCAACTTGGCCATGA
```

-continued

TGGCTCCTCctgtcaggagaggaaagagaagaaggttagtacaattgCTATAG

TGAGTTGTATTATACTATGCAGATATACTATGCCAATGATTAATTGTCAAACT

AGGGCTGCAgggttcatagtgccacttttcctgcactgccccatctcctgccc accctttcccaggcatagacagtcagtgacttacCAAACTCACAGGAGGGA

GAAGGCAGAAGCTTGAGACAGACCCGCGGGACCGCCGAACTGCGAGGGGACGT

GGCTAGGGCGGCTTCTTTTATGGTGCGCCGGCCCTCGGAGGCAGGGCGCTCGGG

GAGGCCTAGCGGCCAATCTGCGGTGGCAGGAGGCGGGGCCGAAGGCCGTGCCTG

ACCAATCCGGAGCACATAGGAGTCTCAGCCCCCCGCCCCAAAGCAAGGGGAAGT

CACGCGCCTGTAGCGCCAGCGTGTTGTGAAATGGGGCTTGGGGGGGTTGGGGC

CCTGACTAGTCAAAACAAACTCCCATTGACGTCAATGGGGTGGAGACTTGGAAA

TCCCCGTGAGTCAAACCGCTATCCACGCCCATTGATGTACTGCCAAAACCGCATC

ATCATGGTAATAGCGATGACTAATACGTAGATGTACTGCCAAGTAGGAAAGTCC

CATAAGGTCATGTACTGGGCATAATGCCAGGCGGGCCATTTACCGTCATTGACGT

CAATAGGGGCGTACTTGGCATATGATACACTTGATGTACTGCCAAGTGGGCAGT

TTACCGTAAATACTCCACCCATTGACGTCAATGGAAAGTCCCTATTGGCGTTACT

ATGGGAACATACGTCATTATTGACGTCAATGGGCGGGGTCGTTGGGCGGTCAG

CCAGGCGGGCCATTTACCGTAAGTTATGTAACGCCTGCAGGTTAATTAAGAACAT

GTGAGCAAAAGGCCAGCAAAAGGCCAGGAACCGTAAAAAGGCCGCGTTGCTGG

CGTTTTTCCATAGGCTCCGCCCCCCTGACGAGCATCACAAAAATCGACGCTCAAG

TCAGAGGTGGCGAAACCCGACAGGACTATAAAGATACCAGGCGTTTCCCCCTGG

AAGCTCCCTCGTGCGCTCTCCTGTTCCGACCCTGCCGCTTACCGGATACCTGTCCG

CCTTTCTCCCTTCGGGAAGCGTGGCGCTTTCTCATAGCTCACGCTGTAGGTATCTC

AGTTCGGTGTAGGTCGTTCGCTCCAAGCTGGGCTGTGTGCACGAACCCCCCGTTC

AGCCCGACCGCTGCGCCTTATCCGGTAACTATCGTCTTGAGTCCAACCCGGTAAG

ACACGACTTATCGCCACTGGCAGCAGCCACTGGTAACAGGATTAGCAGAGCGAG

GTATGTAGGCGGTGCTACAGAGTTCTTGAAGTGGTGGCCTAACTACGGCTACACT

AGAAGAACAGTATTTGGTATCTGCGCTCTGCTGAAGCCAGTTACCTTCGGAAAAA

GAGTTGGTAGCTCTTGATCCGGCAAACAAACCACCGCTGGTAGCGGTGGTTTTTT

TGTTTGCAAGCAGCAGATTACGCGCAGAAAAAAAGGATCTCAAGAAGATCCTTT

GATCTTTTCTACGGGGTCTGACGCTCAGTGGAACGAAAACTCACGTTAAGGGATT

TTGGTCATGGCTAGTTAATTAACATTTAAATCAGCGGCCGCAATAAAATATCTTT

ATTTTCATTACATCTGTGTGTTGGTTTTTTGTGTGAATCGTAACTAACATACGCTC

TCCATCAAAACAAAACGAAACAAAACAAACTAGCAAAATAGGCTGTCCCCAGTG

CAAGTGCAGGTGCCAGAACATTTCTCTATCGAA

SEQ ID NO 7,836:
GGATCTGCGATCGCTCCGGTGCCCGTCAGTGGGCAGAGCGCACATCGCCCACAG

TCCCCGAGAAGTTGGGGGGAGGGGTCGGCAATTGAACGGGTGCCTAGAGAAGGT

GGCGCGGGGTAAACTGGGAAAGTGATGTCGTGTACTGGCTCCGCCTTTTTCCCGA

GGGTGGGGGAGAACCGTATATAAGTGCAGTAGTCGCCGTGAACGTTCTTTTTCGC

AACGGGTTTGCCGCCAGAACACAGCTGAAGCTTCGAGGGGCTCGCATCTCTCCTT

CACGCGCCCGCCGCCCTACCTGAGGCCGCCATCCACGCCGGTTGAGTCGCGTTCT

-continued

```
GCCGCCTCCCGCCTGTGGTGCCTCCTGAACTGCGTCCGCCGTCTAGGTAAGTTTA

AAGCTCAGGTCGAGACCGGGCCTTTGTCCGGCGCTCCCTTGGAGCCTACCTAGAC

TCAGCCGGCTCTCCACGCTTTGCCTGACCCTGCTTGCTCAACTCTACGTCTTTGTT

TCGTTTTCTGTTCTGCGCCGTTACAGATCCAAGCTGTGACCGGCGCCTACCTGAG

ATCAACATGTACAGGATGCAACTCCTGTCTTGCATTGCACTAAGTCTTGCACTTG

TCACGAATTCAGATATCCAGATGACCCAGTCCCCGAGCTCCCTGTCCGCCTCTGT

GGGCGATAGGGTCACCATCACCTGCCGTGCCAGTCAGTCCGTGTCCAGCGCTGTA

GCCTGGTATCAACAGAAACCAGGAAAAGCTCCGAAGCTTCTGATTTACTCGGCAT

CCAGCCTCTACTCTGGAGTCCCTTCTCGCTTCTCTGGTAGCCGTTCCGGGACGGAT

TTCACTCTGACCATCAGCAGTCTGCAGCCGGAAGACTTCGCAACTTATTACTGTC

AGCAATCTGGTTACCTGATCACGTTCGGACAGGGTACCAAGGTGGAGATCAAAC

GACTCGAGATCAAACGGGCAGATGCTGCACCAACTGTATCCATCTTCCCACCATC

CAGTGAGCAGTTAACATCTGGAGGTGCCTCAGTCGTGTGCTTCTTGAACAACTTC

TACCCCAAAGACATCAATGTCAAGTGGAAGATTGATGGCAGTGAACGACAAAAT

GGCGTCCTGAACAGTTGGACTGATCAGGACAGCAAAGACAGCACCTACAGCATG

AGCAGCACCCTCACGTTGACCAAGGACGAGTATGAACGACATAACAGCTATACC

TGTGAGGCCACTCACAAGACATCAACTTCACCCATTGTCAAGAGCTTCAACAGGA

ATGAGTGTTAGAGACAAAGGTCCTGAGAGCTAGCTGGCCAGACATGATAAGATA

CATTGATGAGTTTGGACAAACCACAACTAGAATGCAGTGAAAAAAATGCTTTATT

TGTGAAATTTGTGATGCTATTGCTTTATTTGTAACCATTATAAGCTGCAATAAACA

AGTTAACAACAACAATTGCATTCATTTTATGTTTCAGGTTCAGGGGGAGGTGTGG

GAGGTTTTTTAAAGCAAGTAAAACCTCTACAAATGTGGTATGGAATTAATTCTAA

AATACAGCATAGCAAAACTTTAACCTCCAAATCAAGCCTCTACTTGAATCCTTTT

CTGAGGGATGAATAAGGCATAGGCATCAGGGGCTGTTGCCAATGTGCATTAGCT

GTTTGCAGCCTCACCTTCTTTCATGGAGTTTAAGATATAGTGTATTTTCCCAAGGT

TTGAACTAGCTCTTCATTTCTTTATGTTTTAAATGCACTGACCTCCCACATTCCCTT

TTTAGTAAAATATTCAGAAATAATTTAAATACATCATTGCAATGAAAATAAATGT

TTTTTATTAGGCAGAATCCAGATGCTCAAGGCCCTTCATAATATCCCCCAGTTTA

GTAGTTGGACTTAGGGAACAAAGGAACCTTTAATAGAAATTGGACAGCAAGAAA

GCGAGCTTCTAGCTTTAGTTCCTGGTGTACTTGAGGGGGATGAGTTCCTCAATGG

TGGTTTTGACCAGCTTGCCATTCATCTCAATGAGCACAAAGCAGTCAGGAGCATA

GTCAGAGATGAGCTCTCTGCACATGCCACAGGGGCTGACCACCCTGATGGATCTG

TCCACCTCATCAGAGTAGGGGTGCCTGACAGCCACAATGGTGTCAAAGTCCTTCT

GCCCGTTGCTCACAGCAGACCCAATGGCAATGGCTTCAGCACAGACAGTGACCC

TGCCAATGTAGGCCTCAATGTGGACAGCAGAGATGATCTCCCCAGTCTTGGTCCT

GATGGCCGCCCCGACATGGTGCTTGTTGTCCTCATAGAGCATGGTGATCTTCTCA

GTGGCGACCTCCACCAGCTCCAGATCCTGCTGAGAGATGTTGAAGGTCTTCATGA

TGGCTCCTCctgtcaggagaggaaagagaagaaggttagtacaattgCTATAGT

GAGTTGTATTATACTATGCTTATGATTAATTGTCAAACTAGGGCTGCAgggttc atagtgccacttttcctgcactgccccatctcctgcccaccctttcccaggcat
```

-continued
```
agacagtcagtgacttacCAAACTCACAGGAGGGAGAAGGCAGAAGC

TTGAGACAGACCCGCGGGACCGCCGAACTGCGAGGGGACGTGGCTAGGGCGGCT

TCTTTTATGGTGCGCCGGCCCTCGGAGGCAGGGCGCTCGGGGAGGCCTAGCGGC

CAATCTGCGGTGGCAGGAGGCGGGGCCGAAGGCCGTGCCTGACCAATCCGGAGC

ACATAGGAGTCTCAGCCCCCCGCCCCAAAGCAAGGGGAAGTCACGCGCCTGTAG

CGCCAGCGTGTTGTGAAATGGGGGCTTGGGGGGGTTGGGGCCCTGACTAGTCAA

AACAAACTCCCATTGACGTCAATGGGGTGGAGACTTGGAAATCCCCGTGAGTCA

AACCGCTATCCACGCCCATTGATGTACTGCCAAAACCGCATCATCATGGTAATAG

CGATGACTAATACGTAGATGTACTGCCAAGTAGGAAAGTCCCATAAGGTCATGT

ACTGGGCATAATGCCAGGCGGGCCATTTACCGTCATTGACGTCAATAGGGGCG

TACTTGGCATATGATACACTTGATGTACTGCCAAGTGGGCAGTTTACCGTAAATA

CTCCACCCATTGACGTCAATGGAAAGTCCCTATTGGCGTTACTATGGGAACATAC

GTCATTATTGACGTCAATGGGCGGGGTCGTTGGGCGGTCAGCCAGGCGGGCCA

TTTACCGTAAGTTATGTAACGCCTGCAGGTTAATTAAGAACATGTGAGCAAAAGG

CCAGCAAAAGGCCAGGAACCGTAAAAAGGCCGCGTTGCTGGCGTTTTTCCATAG

GCTCCGCCCCCTGACGAGCATCACAAAAATCGACGCTCAAGTCAGAGGTGGCG

AAACCCGACAGGACTATAAAGATACCAGGCGTTTCCCCCTGGAAGCTCCCTCGT

GCGCTCTCCTGTTCCGACCCTGCCGCTTACCGGATACCTGTCCGCCTTTCTCCCTT

CGGGAAGCGTGGCGCTTTCTCATAGCTCACGCTGTAGGTATCTCAGTTCGGTGTA

GGTCGTTCGCTCCAAGCTGGGCTGTGTGCACGAACCCCCCGTTCAGCCCGACCGC

TGCGCCTTATCCGGTAACTATCGTCTTGAGTCCAACCCGGTAAGACACGACTTAT

CGCCACTGGCAGCAGCCACTGGTAACAGGATTAGCAGAGCGAGGTATGTAGGCG

GTGCTACAGAGTTCTTGAAGTGGTGGCCTAACTACGGCTACACTAGAAGAACAG

TATTTGGTATCTGCGCTCTGCTGAAGCCAGTTACCTTCGGAAAAAGAGTTGGTAG

CTCTTGATCCGGCAAACAAACCACCGCTGGTAGCGGTGGTTTTTTTGTTTGCAAG

CAGCAGATTACGCGCAGAAAAAAAGGATCTCAAGAAGATCCTTTGATCTTTTCTA

CGGGGTCTGACGCTCAGTGGAACGAAAACTCACGTTAAGGGATTTTGGTCATGG

CTAGTTAATTAACATTTAAATCAGCGGCCGCAATAAAATATCTTTATTTTCATTAC

ATCTGTGTGTTGGTTTTTTGTGTGAATCGTAACTAACATACGCTCTCCATCAAAAC

AAAACGAAACAAAACAAACTAGCAAAATAGGCTGTCCCCAGTGCAAGTGCAGGT

GCCAGAACATTTCTCTATCGAA
```

TABLE 6

A non-limiting list of cancers that the T cell based therapy of the disclosed methods and compositions can target.

| | | | | |
|---|---|---|---|---|
| Acute Lymphoblastic Leukemia (ALL) | Acute Myeloid Leukemia (AML) | Adrenocortical Carcinoma | AIDS-Related Cancers | Kaposi Sarcoma |
| AIDS-Related Lymphoma | Primary CNS Lymphoma | Anal Cancer | Appendix Cancer (Gastrointestinal Carcinoid Tumors) | Astrocytomas |

TABLE 6-continued

A non-limiting list of cancers that the T cell based therapy of the disclosed methods and compositions can target.

| | | | | |
|---|---|---|---|---|
| Atypical Teratoid/Rhabdoid Tumor | Brain Cancer | Basal Cell Carcinoma of the Skin | Bile Duct Cancer | Bladder Cancer |
| Bone Cancer (includes Ewing Sarcoma and Osteosarcoma and Malignant Fibrous Histiocytoma) | Brain Tumors | Breast Cancer | Bronchial Tumors | Burkitt Lymphoma |
| Non-Hodgkin Lymphoma | Carcinoid Tumors | Carcinoma of Unknown Primary | Cardiac (Heart) Tumors | Embryonal Tumors |
| Germ Cell Tumor | Primary CNS Lymphoma | Cervical Cancer | Cholangio-carcinoma | Chordoma |
| Chronic Lymphocytic Leukemia (CLL) | Chronic Myelogenous Leukemia (CML) | Chronic Myeloproliferative Neoplasms | Colorectal Cancer | Cranio-pharyngioma |
| Cutaneous T-Cell Lymphoma (Mycosis Fungoides and Sézary Syndrome) | Ductal Carcinoma In Situ (DCIS) | Endometrial Cancer | Ependymoma | Esophageal Cancer |
| Esthesioneuro-blastoma | Ewing Sarcoma | Extracranial Germ Cell Tumor | Eye Cancer | Intraocular Melanoma |
| Fallopian Tube Cancer | Fibrous Histiocytoma of Bone | Osteosarcoma | Gallbladder Cancer | Gastric Cancer |
| Stomach Cancer | Gastrointestinal Carcinoid Tumor | Gastrointestinal Stromal Tumors (GIST) | Central Nervous System Germ Cell Tumors | Extracranial Germ Cell Tumors |
| Extragonadal Germ Cell Tumors | Ovarian Germ Cell Tumors | Testicular Cancer | Gestational Trophoblastic Disease | Hairy Cell Leukemia |
| Head and Neck Cancer | Heart Tumors | Hepatocellular (Liver) Cancer | Histiocytosis (Langerhans Cell) | Hodgkin Lymphoma |
| Hypopharyngeal Cancer | Intraocular Melanoma | Islet Cell Tumors | Pancreatic Neuroendocrine Tumors | Kidney Cancer |
| Renal Cell Cancer | Langerhans Cell Histiocytosis | Laryngeal Cancer | Leukemia | Lip and Oral Cavity Cancer |
| Liver Cancer | Lung Cancer (Non-Small Cell and Small Cell) | Lymphoma | Male Breast Cancer | Malignant Fibrous Histiocytoma of Bone and Osteosarcoma |
| Melanoma | Intraocular (Eye) Melanoma | Merkel Cell Carcinoma (Skin Cancer) | Malignant Mesothelioma | Metastatic Cancer |
| Metastatic Squamous Neck Cancer with Occult Primary | Midline Tract Carcinoma With NUT Gene Changes | Mouth Cancer | Multiple Endocrine Neoplasia Syndromes | Multiple Myeloma/Plasma Cell Neoplasms |
| Mycosis Fungoides (Lymphoma) | Myelodysplastic Syndromes | Myelodysplastic/Myeloproliferative Neoplasms | Nasal Cavity and Paranasal Sinus Cancer | Nasopharyngeal Cancer |
| Neuroblastoma | Non-Small Cell Lung Cancer | Oral Cancer | and Oropharyngeal Cancer | Ovarian Cancer |
| Pancreatic Cancer | Papillomatosis | Paraganglioma | Paranasal Sinus and Nasal Cavity Cancer | Parathyroid Cancer |
| Penile Cancer | Pharyngeal Cancer | Pheochromocytoma | Pituitary Tumor | Plasma Cell Neoplasm/Multiple Myeloma |
| Pleuropulmonary Blastoma | Primary Central Nervous System (CNS) Lymphoma | Primary Peritoneal Cancer | Prostate Cancer | Rectal Cancer |
| Recurrent Cancer | Retinoblastoma | Rhabdomyosarcoma | Salivary Gland Cancer | Sarcoma |
| Vascular Tumors | Uterine Sarcoma | Sézary Syndrome (Lymphoma) | Small Cell Lung Cancer | Small Intestine Cancer |
| Soft Tissue Sarcoma | Squamous Cell Carcinoma | Stomach (Gastric) Cancer | Throat Cancer | Thymoma |
| Thymic Carcinoma | Thyroid Cancer | Transitional Cell Cancer of the Renal Pelvis and Ureter | Carcinoma of Unknown Primary | Ureter and Renal Pelvis |
| Transitional Cell Cancer | Urethral Cancer | Uterine Cancer | Vaginal Cancer | Vulvar Cancer |
| Wilms Tumor | | | | |

TABLE 7

Splinkerette PCR primers

| SEQ ID NO: | Primer Name: | Sequence: |
|---|---|---|
| 69,824 | Splinkerette adaptor-F | CGAAGAGTAACCGTTGCTAGGAGAGACCGTGGCTGAATGAGACTGGTGTCGACACTAGTGG |
| 69,825 | Splinkerette adaptor-R | GATCCCACTAGTGTCGACACCAGTCTCTAATTTTTTTTTCAAAAAAA |
| 69,826 | Splink 1 | CGAAGAGTAACCGTTGCTAGGAGAGACC |
| 69,827 | SB-Right1 | ACTGACCTAAGACAGGGAATTTTTACTAGG |
| 69,828 | Splink 2 | GTGGCTGAATGAGACTGGTGTCGAC |
| 69,829 | SB-Right 2 | AGTGAGTTTAAATGTATTTGGCTAAGGTGTATG |

TABLE 8

Primers used for HDR arm amplification and detection

| SEQ ID NO. | Primer Name | Sequence |
|---|---|---|
| 69,830 | TRAC-left-F | GACCACTCCAGATTtCAAGATGTACAG |
| 69,831 | TRAC-left-R | GGTCAGGGTTCTGGATATCTGTGG |
| 69,832 | TARC-right-F | GAGAGACTCTAAATCCAGTGACAAGTC |
| 69,833 | TARC-right-R | GTGGGTTAATGAGTGACTGCGT |
| 69,834 | HDRwt-F2 | GAGAGAGCAATCTCCTGGTAATGTGAT |
| 69,835 | HDRwt-R3 | AGGCAGACAGACTTGTCACTGG |
| 69,836 | EGFRvIII-R1 | TCTGGATGTCGGGGATCAGCAG |

Lenti-EGFRvIII expression vector
(SEQ ID NO: 69,748)
GTGCCACCTGCAGCCTGAATATGGGCCAAACAGGATATCTGTGGTAAGCAGTTCC
TGCCCCGGCTCAGGGCCAAGAACAGATGGAACAGCTGAATATGGGCCAAACAGG
ATATCTGTGGTAAGCAGTTCCTGCCCCGGCTCAGGGCCAAGAACAGATGGTCCCC
AGATGCGGTCCAGCCCTCAGCAGTTTCTAGAGAACCATCAGATGTTTCCAGGGTG
CCCCAAGGACCTGAAATGACCCTGTGCCTTATTTGAACTAACCAATCAGTTCGCT
TCTCGCTTCTGTTCGCGCGCTTCTGCTCCCCGAGCTCAATAAAAGAGCCCACAAC
CCCTCACTCGGGGCGCCAGTCCTCCGATTGACTGAGTCGCCCGGGTACCCGTGTA
TCCAATAAACCCTCTTGCAGTTGCATCCGACTTGTGGTCTCGCTGTTCCTTGGGAG
GGTCTCCTCTGAGTGATTGACTACCCGTCAGCGGGGGTCTTTCATTTGGGGGCTC
GTCCGGGATCGGGAGACCCCTGCCCAGGGACCACCGACCCACCACCGGGAGGCA
AGCTGGCCAGCAACTTATCTGTGTCTGTCCGATTGTCTAGTGTCTATGACTGATTT
TATGCGCCTGCGTCGGTACTAGTTAGCTAACTAGCTCTGTATCTGGCGGACCCGT
GGTGGAACTGACGAGTTCTGAACACCCGGCCGCAACCCTGGGAGACGTCCCAGG
GACTTTGGGGCCGTTTTTGTGGCCCGACCTGAGGAAGGGAGTCGATGTGGAATC
CGACCCCGTCAGGATATGTGGTTCTGGTAGGAGACGAGAACCTAAAACAGTTCC
CGCCTCCGTCTGAATTTTTGCTTTCGGTTTGGAACCGAAGCCGCGTCTTGTCTG
CTGCAGCGCTGCAGCATCGTTCTGTGTTGTCTCTGTCTGACTGTGTTTCTGTATTT
GTCTGAAAATTAGGGCCAGACTGTTACCACTCCCTTAAGTTTGACCTTAGGTCAC
TGGAAAGATGTCGAGCGGATCGCTCACAACCAGTCGGTAGATGTCAAGAAGAGA
CGTTGGGTTACCTTCTGCTCTGCAGAATGGCCAACCTTTAACGTCGGATGGCCGC -continued

```
GAGACGGCACCTTTAACCGAGACCTCATCACCCAGGTTAAGATCAAGGTCTTTTC

ACCTGGCCCGCATGGACACCCAGACCAGGTCCCCTACATCGTGACCTGGGAAGC

CTTGGCTTTTGACCCCCCTCCCTGGGTCAAGCCCTTTGTACACCCTAAGCCTCCGC

CTCCTCTTCCTCCATCCGCCCCGTCTCTCCCCCTTGAACCTCCTCGTTCGACCCCG

CCTCGATCCTCCCTTTATCCAGCCCTCACTCCTTCTCTAGGCGCCGGCCGGATCCC

AGTGTGGTGGTACATCATGCGACCCTCCGGGACGGCCGGGGCAGCGCTCCTGGC

GCTGCTGGCTGCGCTCTGCCCGGCGAGTCGGGCTCTGGAGGAAAAGAAAGGTAA

TTATGTGGTGACAGATCACGGCTCGTGCGTCCGAGCCTGTGGGGCCGACAGCTAT

GAGATGGAGGAAGACGGCGTCCGCAAGTGTAAGAAGTGCGAAGGGCCTTGCCGC

AAAGTGTGTAACGGAATAGGTATTGGTGAATTTAAAGACTCACTCTCCATAAATG

CTACGAATATTAAACACTTCAAAAACTGCACCTCCATCAGTGGCGATCTCCACAT

CCTGCCGGTGGCATTTAGGGGTGACTCCTTCACACATACTCCTCCTCTGGATCCA

CAGGAACTGGATATTCTGAAAACCGTAAAGGAAATCACAGGGTTTTTGCTGATTC

AGGCTTGGCCTGAAAACAGGACGGACCTCCATGCCTTTGAGAACCTAGAAATCA

TACGCGGCAGGACCAAGCAACATGGTCAGTTTTCTCTTGCAGTCGTCAGCCTGAA

CATAACATCCTTGGGATTACGCTCCCTCAAGGAGATAAGTGATGGAGATGTGATA

ATTTCAGGAAACAAAAATTTGTGCTATGCAAATACAATAAACTGGAAAAAACTG

TTTGGGACCTCCGGTCAGAAAACCAAAATTATAAGCAACAGAGGTGAAAACAGC

TGCAAGGCCACAGGCCAGGTCTGCCATGCCTTGTGCTCCCCCGAGGGCTGCTGGG

GCCCGGAGCCCAGGGACTGCGTCTCTTGCCGGAATGTCAGCCGAGGCAGGGAAT

GCGTGGACAAGTGCAACCTTCTGGAGGGTGAGCCAAGGGAGTTTGTGGAGAACT

CTGAGTGCATACAGTGCCACCCAGAGTGCCTGCCTCAGGCCATGAACATCACCTG

CACAGGACGGGACCAGACAACTGTATCCAGTGTGCCCACTACATTGACGGCCC

CCACTGCGTCAAGACCTGCCCGGCAGGAGTCATGGGAGAAAACAACACCCTGGT

CTGGAAGTACGCAGACGCCGGCCATGTGTGCCACCTGTGCCATCCAAACTGCAC

CTACGGATGCACTGGGCCAGGTCTTGAAGGCTGTCCAACGAATGGGCCTAAGAT

CCCGTCCATCGCCACTGGGATGGTGGGGCCCTCCTCTTGCTGCTGGTGGTGGCC

CTGGGGATCGGCCTCTTCATGCGAAGGCGCCACATCGTTCGGAAGCGCACGCTG

CGGAGGCTGCTGCAGGAGAGGGAGCTTGTGGAGCCTCTTACACCCAGTGGAGAA

GCTCCCAACCAAGCTCTCTTGAGGATCTTGAAGGAAACTGAATTCAAAAAGATC

AAAGTGCTGGGCTCCGGTGCGTTCGGCACGGTGTATAAGGGACTCTGGATCCCA

GAAGGTGAGAAAGTTAAAATTCCCGTCGCTATCAAGGAATTAAGAGAAGCAACA

TCTCCGAAAGCCAACAAGGAAATCCTCGATGAAGCCTACGTGATGGCCAGCGTG

GACAACCCCCACGTGTGCCGCCTGCTGGGCATCTGCCTCACCTCCACCGTGCAAC

TCATCACGCAGCTCATGCCCTTCGGCTGCCTCCTGGACTATGTCCGGGAACACAA

AGACAATATTGGCTCCCAGTACCTGCTCAACTGGTGTGTGCAGATCGCAAAGGGC

ATGAACTACTTGGAGGACCGTCGCTTGGTGCACCGCGACCTGGCAGCCAGGAAC

GTACTGGTGAAAACACCGCAGCATGTCAAGATCACAGATTTTGGGCTGGCCAAA

CTGCTGGGTGCGGAAGAGAAAGAATACCATGCAGAAGGAGGCAAAGTGCCTATC

AAGTGGATGGCATTGGAATCAATTTTACACAGAATCTATACCCACCAGAGTGATG
```

-continued

```
TCTGGAGCTACGGGGTGACCGTTTGGGAGTTGATGACCTTTGGATCCAAGCCATA
TGACGGAATCCCTGCCAGCGAGATCTCCTCCATCCTGGAGAAAGGAGAACGCCT
CCCTCAGCCACCCATATGTACCATCGATGTCTACATGATCATGGTCAAGTGCTGG
ATGATAGACGCAGATAGTCGCCCAAAGTTCCGTGAGTTGATCATCGAATTCTCCA
AAATGGCCCGAGACCCCCAGCGCTACCTTGTCATTCAGGGGGATGAAAGAATGC
ATTTGCCAAGTCCTACAGACTCCAACTTCTACCGTGCCCTGATGGATGAAGAAGA
CATGGACGACGTGGTGGATGCCGACGAGTACCTCATCCCACAGCAGGGCTTCTTC
AGCAGCCCCTCCACGTCACGGACTCCCCTCCTGAGCTCTCTGAGTGCAACCAGCA
ACAATTCCACCGTGGCTTGCATTGATAGAAATGGGCTGCAAAGCTGTCCCATCAA
GGAAGACAGCTTCTTGCAGCGATACAGCTCAGACCCCACAGGCGCCTTGACTGA
GGACAGCATAGACGACACCTTCCTCCCAGTGCCTGAATACATAAACCAGTCCGTT
CCCAAAAGGCCCGCTGGCTCTGTGCAGAATCCTGTCTATCACAATCAGCCTCTGA
ACCCCGCGCCCAGCAGAGACCCACACTACCAGGACCCCCACAGCACTGCAGTGG
GCAACCCCGAGTATCTCAACACTGTCCAGCCCACCTGTGTCAACAGCACATTCGA
CAGCCCTGCCCACTGGGCCCAGAAAGGCAGCCACCAAATTAGCCTGGACAACCC
TGACTACCAGCAGGACTTCTTTCCCAAGGAAGCCAAGCCAAATGGCATCTTTAAG
GGCTCCACAGCTGAAAATGCAGAATACCTAAGGGTCGCGCCACAAAGCAGTGAA
TTTATTGGAGCATGAGATGTAGGAATTCGCCAGCACAGTGGTCGACCCTGTGGAA
TGTGTGTCAGTTAGGGTGTGGAAAGTCCCCAGGCTCCCCAGCAGGCAGAAGTAT
GCAAAGCATGCATCTCAATTAGTCAGCAACCAGGTGTGGAAAGTCCCCAGGCTC
CCCAGCAGGCAGAAGTATGCAAAGCATGCATCTCAATTAGTCAGCAACCATAGT
CCCGCCCCTAACTCCGCCCATCCCGCCCCTAACTCCGCCCAGTTCCGCCCATTCTC
CGCCCCATGGCTGACTAATTTTTTTATTTATGCAGAGGCCGAGGCCGCCTCGGC
CTCTGAGCTATTCCAGAAGTAGTGAGGAGGCTTTTTTGGAGGCCTAGGCTTTTGC
AAAAAGCTTACCATGACCGAGTACAAGCCCACGGTGCGCCTCGCCACCCGCGAC
GACGTCCCCAGGGCCGTACGCACCCTCGCCGCCGCGTTCGCCGACTACCCCGCCA
CGCGCCACACCGTCGATCCGGACCGCCACATCGAGCGGGTCACCGAGCTGCAAG
AACTCTTCCTCACGCGCGTCGGGCTCGACATCGGCAAGGTGTGGGTCGCGGACG
ACGGCGCCGCGGTGGCGGTCTGGACCACGCCGGAGAGCGTCGAAGCGGGGGCG
GTGTTCGCCGAGATCGGCCCGCGCATGGCCGAGTTGAGCGGTTCCCGGCTGGCC
GCGCAGCAACAGATGGAAGGCCTCCTGGCGCCGCACCGGCCCAAGGAGCCCGCG
TGGTTCCTGGCCACCGTCGGCGTCTCGCCCGACCACCAGGGCAAGGGTCTGGGC
AGCGCCGTCGTGCTCCCCGGAGTGGAGGCGGCCGAGCGCGCCGGGGTGCCCGCC
TTCCTGGAGACCTCCGCGCCCCGCAACCTCCCCTTCTACGAGCGGCTCGGCTTCA
CCGTCACCGCCGACGTCGAGGTGCCCGAAGGACCGCGCACCTGGTGCATGACCC
GCAAGCCCGGTGCCTGACGCCCGCCCCACGACCCGCAGCGCCCGACCGAAAGGA
GCGCACGACCCCATGCATCGATAAAATAAAAGATTTTATTTAGTCTCCAGAAAAA
GGGGGGAATGAAAGACCCCACCTGTAGGTTTGGCAAGCTAGCTTAAGTAACGCC
ATTTTGCAAGGCATGGAAAAATACATAACTGAGAATAGAGAAGTTCAGATCAAG
GTCAGGAACAGATGGAACAGCTGAATATGGGCCAAACAGGATATCTGTGGTAAG
CAGTTCCTGCCCCGGCTCAGGGCCAAGAACAGATGGAACAGCTGAATATGGGCC
```

-continued

```
AAACAGGATATCTGTGGTAAGCAGTTCCTGCCCCGGCTCAGGGCCAAGAACAGA

TGGTCCCCAGATGCGGTCCAGCCCTCAGCAGTTTCTAGAGAACCATCAGATGTTT

CCAGGGTGCCCCAAGGACCTGAAATGACCCTGTGCCTTATTTGAACTAACCAATC

AGTTCGCTTCTCGCTTCTGTTCGCGCGCTTCTGCTCCCCGAGCTCAATAAAAGAGC

CCACAACCCCTCACTCGGGGCGCCAGTCCTCCGATTGACTGAGTCGCCCGGGTAC

CCGTGTATCCAATAAACCCTCTTGCAGTTGCATCCGACTTGTGGTCTCGCTGTTCC

TTGGGAGGGTCTCCTCTGAGTGATTGACTACCCGTCAGCGGGGGTCTTTCACATG

CAGCATGTATCAAAATTAATTTGGTTTTTTTTCTTAAGTATTTACATTAAATGGCC

ATAGTTGCATTAATGAATCGGCCAACGCGCGGGGAGAGGCGGTTTGCGTATTGG

GCGCTCTTCCGCTTCCTCGCTCACTGACTCGCTGCGCTCGGTCGTTCGGCTGCGGC

GAGCGGTATCAGCTCACTCAAAGGCGGTAATACGGTTATCCACAGAATCAGGGG

ATAACGCAGGAAAGAACATGTGAGCAAAAGGCCAGCAAAAGGCCAGGAACCGT

AAAAAGGCCGCGTTGCTGGCGTTTTTCCATAGGCTCCGCCCCCCTGACGAGCATC

ACAAAAATCGACGCTCAAGTCAGAGGTGGCGAAACCCGACAGGACTATAAAGAT

ACCAGGCGTTTCCCCCTGGAAGCTCCCTCGTGCGCTCTCCTGTTCCGACCCTGCC

GCTTACCGGATACCTGTCCGCCTTTCTCCCTTCGGGAAGCGTGGCGCTTTCTCATA

GCTCACGCTGTAGGTATCTCAGTTCGGTGTAGGTCGTTCGCTCCAAGCTGGGCTG

TGTGCACGAACCCCCCGTTCAGCCCGACCGCTGCGCCTTATCCGGTAACTATCGT

CTTGAGTCCAACCCGGTAAGACACGACTTATCGCCACTGGCAGCAGCCACTGGT

AACAGGATTAGCAGAGCGAGGTATGTAGGCGGTGCTACAGAGTTCTTGAAGTGG

TGGCCTAACTACGGCTACACTAGAAGAACAGTATTTGGTATCTGCGCTCTGCTGA

AGCCAGTTACCTTCGGAAAAAGAGTTGGTAGCTCTTGATCCGGCAAACAAACCA

CCGCTGGTAGCGGTGGTTTTTTGTTTGCAAGCAGCAGATTACGCGCAGAAAAAA

AGGATCTCAAGAAGATCCTTTGATCTTTTCTACGGGGTCTGACGCTCAGTGGAAC

GAAAACTCACGTTAAGGGATTTTGGTCATGAGATTATCAAAAAGGATCTTCACCT

AGATCCTTTTGCGGCCGCAAATCAATCTAAAGTATATATGAGTAAACTTGGTCTG

ACAGTTACCAATGCTTAATCAGTGAGGCACCTATCTCAGCGATCTGTCTATTTCG

TTCATCCATAGTTGCCTGACTCCCCGTCGTGTAGATAACTACGATACGGGAGGGC

TTACCATCTGGCCCCAGTGCTGCAATGATACCGCGAGACCCACGCTCACCGGCTC

CAGATTTATCAGCAATAAACCAGCCAGCCGGAAGGGCCGAGCGCAGAAGTGGTC

CTGCAACTTTATCCGCCTCCATCCAGTCTATTAATTGTTGCCGGGAAGCTAGAGT

AAGTAGTTCGCCAGTTAATAGTTTGCGCAACGTTGTTGCCATTGCTACAGGCATC

GTGGTGTCACGCTCGTCGTTTGGTATGGCTTCATTCAGCTCCGGTTCCCAACGATC

AAGGCGAGTTACATGATCCCCCATGTTGTGCAAAAAAGCGGTTAGCTCCTTCGGT

CCTCCGATCGTTGTCAGAAGTAAGTTGGCCGCAGTGTTATCACTCATGGTTATGG

CAGCACTGCATAATTCTCTTACTGTCATGCCATCCGTAAGATGCTTTTCTGTGACT

GGTGAGTACTCAACCAAGTCATTCTGAGAATAGTGTATGCGGCGACCGAGTTGCT

CTTGCCCGGCGTCAATACGGGATAATACCGCGCCACATAGCAGAACTTTAAAAG

TGCTCATCATTGGAAAACGTTCTTCGGGGCGAAAACTCTCAAGGATCTTACCGCT

GTTGAGATCCAGTTCGATGTAACCCACTCGTGCACCCAACTGATCTTCAGCATCT
```

```
-continued
TTTACTTTCACCAGCGTTTCTGGGTGAGCAAAAACAGGAAGGCAAAATGCCGCA

AAAAAGGGAATAAGGGCGACACGGAAATGTTGAATACTCATACTCTTCCTTTTTC

AATATTATTGAAGCATTTATCAGGGTTATTGTCTCATGAGCGGATACATATTTGA

ATGTATTTAGAAAAATAAACAAATAGGGGTTCCGCGCACATTTCCCCGAAAA

EGFRvIII CAR (pLY60_TRAC-LHA-pAAV-EFS-h139-41BBz-RHA)
                                             (SEQ ID NO: 69,749)
CCTGCAGGCAGCTGCGCGCTCGCTCGCTCACTGAGGCCGCCCGGGCAAAGCCCG

GGCGTCGGGCGACCTTTGGTCGCCCGGCCTCAGTGAGCGAGCGAGCGCGCAGAG

AGGGAGTGGCCAACTCCATCACTAGGGGTTCCTGCGGCCGCACGCGTGACCACT

CCAGATTTCAAGATGTACAGTTTGCTTTGCTGGGCCTTTTTCCCATGCCTGCCTTT

ACTCTGCCAGAGTTATATTGCTGGGGTTTTGAAGAAGATCCTATTAAATAAAAGA

ATAAGCAGTATTATTAAGTAGCCCTGCATTTCAGGTTTCCTTGAGTGGCAGGCCA

GGCCTGGCCGTGAACGTTCACTGAAATCATGGCCTCTTGGCCAAGATTGATAGCT

TGTGCCTGTCCCTGAGTCCCAGTCCGTCACGAGCAGCTGGTTTCTAATATGCTATT

TCCCGTATAAAGCATGAGACCGTGACTTGCCAGCCCCACAGAGCCCCGCCCTTGT

CCATCACTGGCATCTGGACTCCAGCCTGGGTTGGGGCAAAGAGGGAAATGAGAT

CATGTCCTAACCCTGATCCTCTTGTCCCACAGATATCCAGAACCCTGACCCCTAG

GTCTTGAAAGGAGTGGGAATTGGCTCCGGTGCCCGTCAGTGGGCAGAGCGCACA

TCGCCCACAGTCCCCGAGAAGTTGGGGGGAGGGGTCGGCAATTGATCCGGTGCC

TAGAGAAGGTGGCGCGGGGTAAACTGGGAAAGTGATGTCGTGTACTGGCTCCGC

CTTTTTCCCGAGGGTGGGGGAGAACCGTATATAAGTGCAGTAGTCGCCGTGAAC

GTTCTTTTTCGCAACGGGTTTGCCGCCAGAACACAGGACCGGTTCTAGACGTACG

GCCACCATGGTTCTGCTGGTCACCAGCCTACTACTGTGCGAACTGCCCCACCCCG

CCTTTCTGCTGATCCCCGACATCCAGATGACCCAGAGCCCTAGCAGCCTGAGCGC

CAGCGTGGGCGACAGAGTGACCATCACCTGTCGAGCCAGCCAGGGCATCAGAAA

CAACCTGGCCTGGTATCAGCAGAAGCCAGGCAAGGCCCCAAAGAGACTGATCTA

CGCTGCCAGCAATCTGCAGAGCGGCGTGCCAAGCAGATTCACCGGAAGCGGCTC

CGGCACCGAGTTCACCCTGATCGTGTCCAGCCTGCAGCCCGAGGACTTCGCCAC

CTACTACTGCCTGCAGCACCACAGCTACCCTCTGACCAGCGGCGGAGGCACCAA

GGTGGAGATCAAGCGAACCGGAAGCACCAGCGGAAGCGGCAAGCCTGGCAGCG

GAGAAGGAAGCGAGGTCCAGGTGCTGGAATCTGGCGGCGGACTGGTGCAGCCTG

GCGGCAGCCTGAGACTGAGCTGTGCCGCCAGCGGCTTCACCTTCAGCAGCTACG

CCATGTCTTGGGTCCGGCAGGCTCCTGGAAAGGGCCTGGAATGGGTGTCCGCCAT

CAGCGGCTCTGGCGGCTCCACCAACTACGCCGACAGCGTGAAGGGCCGGTTCAC

CATCAGCCGGGACAACAGCAAGAACACCCTGTATCTGCAGATGAACAGCCTGAG

AGCCGAGGACACCGCCGTGTATTATTGTGCCGGCAGCAGCGGGTGGAGCGAGTA

CTGGGGACAGGGCACACTGGTCACAGTGTCTAGCGCGGCCGCACTCGAGACCAC

GACACCAGCGCCACGACCACCAACACCGGCGCCAACCATCGCGTCGCAGCCACT

GTCCCTGCGCCCAGAAGCATGCCGACCAGCAGCAGGAGGAGCAGTGCACACGAG

GGGGCTGGACTTCGCCTGTGATATCTACATCTGGGCGCCCTTGGCCGGGACTTGT

GGGGTCCTTCTCCTGTCACTGGTTATCACCCTTTACTGCAAACGGGGCAGAAAGA

AACTCCTGTATATATTCAAACAACCATTTATGAGACCAGTACAAACTACTCAAGA
```

-continued

```
GGAAGATGGCTGTAGCTGCCGATTTCCAGAAGAAGAAGAAGGAGGATGTGAACT

GAGAGTGAAGTTCAGCAGGAGCGCAGACGCCCCCGCGTACCAGCAGGGCCAGA

ACCAGCTCTATAACGAGCTCAATCTAGGACGAAGAGAGGAGTACGATGTTTTGG

ACAAGAGACGTGGCCGGGACCCTGAGATGGGGGAAAGCCGAGAAGGAAGAAC

CCTCAGGAAGGCCTGTACAATGAACTGCAGAAAGATAAGATGGCGGAGGCCTAC

AGTGAGATTGGGATGAAAGGCGAGCGCCGGAGGGGCAAGGGGCACGATGGCCT

TTACCAGGGTCTCAGTACAGCCACCAAGGACACCTACGACGCCCTTCACATGCA

GGCCCTGCCCCCTCGCTAAGCTAGCAATAAAAGATCTTTATTTTCATTAGATCTGT

GTGTTGGTTTTTTGTGTGGTACCGAGAGACTCTAAATCCAGTGACAAGTCTGTCT

GCCTATTCACCGATTTTGATTCTCAAACAAATGTGTCACAAAGTAAGGATTCTGA

TGTGTATATCACAGACAAAACTGTGCTAGACATGAGGTCTATGGACTTCAAGAGC

AACAGTGCTGTGGCCTGGAGCAACAAATCTGACTTTGCATGTGCAAACGCCTTCA

ACAACAGCATTATTCCAGAAAACACCTTCTTCCCCAGCCCAGGTAAGGGCAGCTT

TGGTGCCTTCGCAGGCTGTTTCCTTGCTTCAGGAATGGCCAGGTTCTGCCCAGAG

CTCTGGTCAATGATGTCTAAAACTCCTCTGATTGGTGGTCTCGGCCTTATCCATTG

CCACCAAAACCCTCTTTTTACTAAGAAACAGTGAGCCTTGTTCTGGCAGTCCAGA

GAATGACACGGAAAAAAAGCAGATGAAGAGAAGGTGGCAGGAGAGGGCACGTG

GCCCAGCCTCAGTCTCTCCAACTGAGTTCCTGCCTGCCTGCCTTTGCTCAGACTGT

TTGCCCCTTACTGCTCTTCTAGGCCTCATTCTAAGCCCCTTCTCCAAGTTGCCTCT

CCTTATTTCTCCCTGTCTGCCAAAAAATCTTTCCCAGCTCACTAAGTCAGTCTCAC

GCAGTCACTCATTAACCCACCGGACCGAGCGGCCGCAGGAACCCCTAGTGATGG

AGTTGGCCACTCCCTCTCTGCGCGCTCGCTCGCTCACTGAGGCCGGGCGACCAAA

GGTCGCCCGACGCCCGGGCTTTGCCCGGGCGGCCTCAGTGAGCGAGCGAGCGCG

CAGCTGCCTGCAGGGGCGCCTGATGCGGTATTTTCTCCTTACGCATCTGTGCGGT

ATTTCACACCGCATACGTCAAAGCAACCATAGTACGCGCCCTGTAGCGGCGCATT

AAGCGCGGCGGGTGTGGTGGTTACGCGCAGCGTGACCGCTACACTTGCCAGCGC

CCTAGCGCCCGCTCCTTTCGCTTTCTTCCCTTCCTTTCTCGCCACGTTCGCCGGCTT

TCCCCGTCAAGCTCTAAATCGGGGCTCCCTTTAGGGTTCCGATTTAGTGCTTTAC

GGCACCTCGACCCCAAAAAACTTGATTTGGGTGATGGTTCACGTAGTGGGCCATC

GCCCTGATAGACGGTTTTTCGCCCTTTGACGTTGGAGTCCACGTTCTTTAATAGTG

GACTCTTGTTCCAAACTGGAACAACACTCAACCCTATCTCGGGCTATTCTTTTGAT

TTATAAGGGATTTTGCCGATTTCGGCCTATTGGTTAAAAAATGAGCTGATTTAAC

AAAAATTTAACGCGAATTTTAACAAAATATTAACGTTTACAATTTTATGGTGCAC

TCTCAGTACAATCTGCTCTGATGCCGCATAGTTAAGCCAGCCCCGACACCCGCCA

ACACCCGCTGACGCGCCCTGACGGGCTTGTCTGCTCCCGGCATCCGCTTACAGAC

AAGCTGTGACCGTCTCCGGGAGCTGCATGTGTCAGAGGTTTTCACCGTCATCACC

GAAACGCGCGAGACGAAAGGGCCTCGTGATACGCCTATTTTTATAGGTTAATGTC

ATGATAATAATGGTTTCTTAGACGTCAGGTGGCACTTTTCGGGGAAATGTGCGCG

GAACCCCTATTTGTTTATTTTTCTAAATACATTCAAATATGTATCCGCTCATGAGA

CAATAACCCTGATAAATGCTTCAATAATATTGAAAAAGGAAGAGTATGAGTATT
```

```
-continued
CAACATTTCCGTGTCGCCCTTATTCCCTTTTTGCGGCATTTTGCCTTCCTGTTTTT

GCTCACCCAGAAACGCTGGTGAAAGTAAAAGATGCTGAAGATCAGTTGGGTGCA

CGAGTGGGTTACATCGAACTGGATCTCAACAGCGGTAAGATCCTTGAGAGTTTTC

GCCCCGAAGAACGTTTTCCAATGATGAGCACTTTTAAAGTTCTGCTATGTGGCGC

GGTATTATCCCGTATTGACGCCGGGCAAGAGCAACTCGGTCGCCGCATACACTAT

TCTCAGAATGACTTGGTTGAGTACTCACCAGTCACAGAAAAGCATCTTACGGATG

GCATGACAGTAAGAGAATTATGCAGTGCTGCCATAACCATGAGTGATAACACTG

CGGCCAACTTACTTCTGACAACGATCGGAGGACCGAAGGAGCTAACCGCTTTTTT

GCACAACATGGGGGATCATGTAACTCGCCTTGATCGTTGGGAACCGGAGCTGAA

TGAAGCCATACCAAACGACGAGCGTGACACCACGATGCCTGTAGCAATGGCAAC

AACGTTGCGCAAACTATTAACTGGCGAACTACTTACTCTAGCTTCCCGGCAACAA

TTAATAGACTGGATGGAGGCGGATAAAGTTGCAGGACCACTTCTGCGCTCGGCC

CTTCCGGCTGGCTGGTTTATTGCTGATAAATCTGGAGCCGGTGAGCGTGGGTCTC

GCGGTATCATTGCAGCACTGGGGCCAGATGGTAAGCCCTCCCGTATCGTAGTTAT

CTACACGACGGGGAGTCAGGCAACTATGGATGAACGAAATAGACAGATCGCTGA

GATAGGTGCCTCACTGATTAAGCATTGGTAACTGTCAGACCAAGTTTACTCATAT

ATACTTTAGATTGATTTAAAACTTCATTTTTAATTTAAAAGGATCTAGGTGAAGA

TCCTTTTTGATAATCTCATGACCAAAATCCCTTAACGTGAGTTTTCGTTCCACTGA

GCGTCAGACCCCGTAGAAAAGATCAAAGGATCTTCTTGAGATCCTTTTTTTCTGC

GCGTAATCTGCTGCTTGCAAACAAAAAAACCACCGCTACCAGCGGTGGTTTGTTT

GCCGGATCAAGAGCTACCAACTCTTTTTCCGAAGGTAACTGGCTTCAGCAGAGCG

CAGATACCAAATACTGTCCTTCTAGTGTAGCCGTAGTTAGGCCACCACTTCAAGA

ACTCTGTAGCACCGCCTACATACCTCGCTCTGCTAATCCTGTTACCAGTGGCTGCT

GCCAGTGGCGATAAGTCGTGTCTTACCGGGTTGGACTCAAGACGATAGTTACCGG

ATAAGGCGCAGCGGTCGGGCTGAACGGGGGGTTCGTGCACACAGCCCAGCTTGG

AGCGAACGACCTACACCGAACTGAGATACCTACAGCGTGAGCTATGAGAAAGCG

CCACGCTTCCCGAAGGGAGAAAGGCGGACAGGTATCCGGTAAGCGGCAGGGTCG

GAACAGGAGAGCGCACGAGGGAGCTTCCAGGGGGAAACGCCTGGTATCTTTATA

GTCCTGTCGGGTTTCGCCACCTCTGACTTGAGCGTCGATTTTTGTGATGCTCGTCA

GGGGGGCGGAGCCTATGGAAAAACGCCAGCAACGCGGCCTTTTTACGGTTCCTG

GCCTTTTGCTGGCCTTTTGCTCACATGT
```

Other Embodiments

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (69841 sequences)

SEQ ID NO: 1 - DNA, 20 bp, Artificial Sequence
  sgRNA
  mm00013_Abca1
acatgtcatcaacataacag

SEQ ID NO: 2 - DNA, 20 bp, Artificial Sequence
  sgRNA
  mm00014_Abca1
gtggacccgtactctcgcag

SEQ ID NO: 3 - DNA, 20 bp, Artificial Sequence
  sgRNA
  mm00015_Abca1
caagctgtcaagcaacactg

SEQ ID NO: 4 - DNA, 20 bp, Artificial Sequence
  sgRNA
  mm00016_Abca1
ggtatacacagagccatttg

SEQ ID NO: 5 - DNA, 20 bp, Artificial Sequence
  sgRNA
  mm00021_Abca2
catgtatgtagcgatccgcg

SEQ ID NO: 6 - DNA, 20 bp, Artificial Sequence
  sgRNA
  mm00022_Abca2
ctggacgccaataagcacgg

SEQ ID NO: 7 - DNA, 20 bp, Artificial Sequence
  sgRNA
  mm00023_Abca2
taagggataaagttgccacg

SEQ ID NO: 8 - DNA, 20 bp, Artificial Sequence
  sgRNA
  mm00024_Abca2
gagcctgaagcgcttcggag

SEQ ID NO: 9 - DNA, 20 bp, Artificial Sequence
  sgRNA
  mm00029_Abcg1
caaggacaatgcgtatacag

SEQ ID NO: 10 - DNA, 20 bp, Artificial Sequence
  sgRNA
  mm00030_Abcg1
gactataagagagacctcgg

SEQ ID NO: 11 - DNA, 20 bp, Artificial Sequence
  sgRNA
  mm00031_Abcg1
caggccgatcccaatgtgcg

SEQ ID NO: 12 - DNA, 20 bp, Artificial Sequence
  sgRNA
  mm00032_Abcg1
tttcctactctgtacccgag

SEQ ID NO: 13 - DNA, 20 bp, Artificial Sequence
  sgRNA
  mm00073_Asic1
ccacgtcaccaagctcgacg

SEQ ID NO: 14 - DNA, 20 bp, Artificial Sequence
  sgRNA
  mm00074_Asic1
gtgggcaagaccgtgcagcg

SEQ ID NO: 15 - DNA, 20 bp, Artificial Sequence
  sgRNA
  mm00075_Asic1
ggaaaactgcaactgccgta

SEQ ID NO: 16 - DNA, 20 bp, Artificial Sequence
  sgRNA
  mm00076_Asic1
tctctcgtgccacttccgag

SEQ ID NO: 17 - DNA, 20 bp, Artificial Sequence
  sgRNA
  mm00077_Ace
gttgttgaacgagtacgcag

SEQ ID NO: 18 - DNA, 20 bp, Artificial Sequence
  sgRNA
  mm00078_Ace
acaaatacgtcaatctcagg

SEQ ID NO: 19 - DNA, 20 bp, Artificial Sequence
  sgRNA
  mm00079_Ace
ctataactcgagtgccgagg

SEQ ID NO: 20 - DNA, 20 bp, Artificial Sequence
  sgRNA
  mm00080_Ace
gcaatgcacacgggtcacga

SEQ ID NO: 21 - DNA, 20 bp, Artificial Sequence
  sgRNA
  mm00081_Ache
cagcagacctacattgccag

SEQ ID NO: 22 - DNA, 20 bp, Artificial Sequence
  sgRNA
  mm00082_Ache
aaatgtctgctaccagtacg

SEQ ID NO: 23 - DNA, 20 bp, Artificial Sequence
  sgRNA
  mm00083_Ache
gaccccgtaaaccagaaagt

SEQ ID NO: 24 - DNA, 20 bp, Artificial Sequence
  sgRNA
  mm00084_Ache
cagtatgtgcatgcccacgg

SEQ ID NO: 25 - DNA, 20 bp, Artificial Sequence
  sgRNA
  mm00109_Acp2
gggatttggtcagctaacca

SEQ ID NO: 26 - DNA, 20 bp, Artificial Sequence
  sgRNA
  mm00110_Acp2
acatggtggccaacgagaca

SEQ ID NO: 27 - DNA, 20 bp, Artificial Sequence
  sgRNA
  mm00111_Acp2
ttctgcagctgctcataacg

SEQ ID NO: 28 - DNA, 20 bp, Artificial Sequence
  sgRNA
  mm00112_Acp2
ttctgaacacctcttaccac

SEQ ID NO: 29 - DNA, 20 bp, Artificial Sequence
  sgRNA
  mm00121_Chrna1
tgacttgtacaatctcacgg

SEQ ID NO: 30 - DNA, 20 bp, Artificial Sequence
  sgRNA
  mm00122_Chrna1
aaggtgctcctggactacac

SEQ ID NO: 31 - DNA, 20 bp, Artificial Sequence
  sgRNA
  mm00123_Chrna1
aacatatacttcccgatcag

SEQ ID NO: 32 - DNA, 20 bp, Artificial Sequence
  sgRNA
  mm00124_Chrna1
gagtaacttcatggagagcg

SEQ ID NO: 33 - DNA, 20 bp, Artificial Sequence
  sgRNA
  mm00125_Chrna4
tgacattctcgtagtcacca

SEQ ID NO: 34 - DNA, 20 bp, Artificial Sequence
  sgRNA
  mm00126_Chrna4
ggtgagcatgcacagccgtg

SEQ ID NO: 35 - DNA, 20 bp, Artificial Sequence
  sgRNA
  mm00127_Chrna4
tcttctctggctacaacaag

SEQ ID NO: 36 - DNA, 20 bp, Artificial Sequence
  sgRNA
  mm00128_Chrna4
tgtagaacagtggcagtcgg

SEQ ID NO: 37 - DNA, 20 bp, Artificial Sequence
  sgRNA
  mm00133_Chrna7
agatgcattcaccaagacgt

SEQ ID NO: 38 - DNA, 20 bp, Artificial Sequence
  sgRNA
  mm00134_Chrna7
acacagtaaccatgcgccgt

SEQ ID NO: 39 - DNA, 20 bp, Artificial Sequence
  sgRNA
  mm00135_Chrna7
tggaacatgtctgagtaccc

SEQ ID NO: 40 - DNA, 20 bp, Artificial Sequence
  sgRNA
  mm00136_Chrna7
aatggagaatgggatctcat

SEQ ID NO: 41 - DNA, 20 bp, Artificial Sequence
  sgRNA
  mm00141_Chrnb2
tgtgcgtggtaggcgaacgg

SEQ ID NO: 42 - DNA, 20 bp, Artificial Sequence
  sgRNA
  mm00142_Chrnb2
cgtctgggttctcgttgcgt

SEQ ID NO: 43 - DNA, 20 bp, Artificial Sequence
  sgRNA
  mm00143_Chrnb2
tccctcgacgtaccgctggt

SEQ ID NO: 44 - DNA, 20 bp, Artificial Sequence
  sgRNA
  mm00144_Chrnb2
ggagccagatgtgcttagaa

SEQ ID NO: 45 - DNA, 20 bp, Artificial Sequence
  sgRNA
  mm00157_Adipoq
cgctgagcgatacacataag

SEQ ID NO: 46 - DNA, 20 bp, Artificial Sequence
  sgRNA
  mm00158_Adipoq
acgtcatcttcggcatgact

SEQ ID NO: 47 - DNA, 20 bp, Artificial Sequence
  sgRNA
  mm00159_Adipoq
ggggttccggggaagccccg

SEQ ID NO: 48 - DNA, 20 bp, Artificial Sequence
  sgRNA
  mm00160_Adipoq
aaccaacagaatcattatga

SEQ ID NO: 49 - DNA, 20 bp, Artificial Sequence
  sgRNA
  mm00201_Acvr1
ggtggaaattctgtgttccg

SEQ ID NO: 50 - DNA, 20 bp, Artificial Sequence
  sgRNA
  mm00202_Acvr1
tgtgggagacagcactctag

SEQ ID NO: 51 - DNA, 20 bp, Artificial Sequence
  sgRNA
  mm00203_Acvr1
gctttcaggtttatgagcag

SEQ ID NO: 52 - DNA, 20 bp, Artificial Sequence
  sgRNA
  mm00204_Acvr1
attgtactgtccatagccag

SEQ ID NO: 53 - DNA, 20 bp, Artificial Sequence
  sgRNA
  mm00205_Acvr1b
gtgtctaccataaccgccag

SEQ ID NO: 54 - DNA, 20 bp, Artificial Sequence
  sgRNA
  mm00206_Acvr1b
tctacgacctctccacgtca

SEQ ID NO: 55 - DNA, 20 bp, Artificial Sequence
  sgRNA
  mm00207_Acvr1b
tgtacgtacctgcatcccca

SEQ ID NO: 56 - DNA, 20 bp, Artificial Sequence
  sgRNA
  mm00208_Acvr1b
caagaactcactcaccgctg

SEQ ID NO: 57 - DNA, 20 bp, Artificial Sequence
  sgRNA
  mm00209_Acvr2a
agagacagaaccaaccagac

SEQ ID NO: 58 - DNA, 20 bp, Artificial Sequence
  sgRNA
  mm00210_Acvr2a
ggtgtacagacatcacaaga

SEQ ID NO: 59 - DNA, 20 bp, Artificial Sequence
  sgRNA
  mm00211_Acvr2a
aggattggcatatttacatg

SEQ ID NO: 60 - DNA, 20 bp, Artificial Sequence
  sgRNA
  mm00212_Acvr2a
agctgttagaagtgaaagca

SEQ ID NO: 61 - DNA, 20 bp, Artificial Sequence
  sgRNA
  mm00213_Acvr2b
gtggaacgaactgtgccacg

SEQ ID NO: 62 - DNA, 20 bp, Artificial Sequence
  sgRNA
  mm00214_Acvr2b
ccgatgacgatacatccaga

SEQ ID NO: 63 - DNA, 20 bp, Artificial Sequence
  sgRNA
  mm00215_Acvr2b
gcagcagcagaagtacacct

SEQ ID NO: 64 - DNA, 20 bp, Artificial Sequence
  sgRNA
  mm00216_Acvr2b
catctactacaacgccaact

SEQ ID NO: 65 - DNA, 20 bp, Artificial Sequence
  sgRNA
  mm00217_Acvrl1
tgccaaagatctccacatgt

SEQ ID NO: 66 - DNA, 20 bp, Artificial Sequence
  sgRNA
  mm00218_Acvrl1
gttgcgctggtagagtgtgt

SEQ ID NO: 67 - DNA, 20 bp, Artificial Sequence
  sgRNA
  mm00219_Acvrl1
gttccgcgaagtcatgtcgg

SEQ ID NO: 68 - DNA, 20 bp, Artificial Sequence
  sgRNA
  mm00220_Acvrl1
gccacaagcctagagcaccc

SEQ ID NO: 69 - DNA, 20 bp, Artificial Sequence
  sgRNA
  mm00225_Ada
gttgtggatcttgtgaacca

SEQ ID NO: 70 - DNA, 20 bp, Artificial Sequence
  sgRNA
  mm00226_Ada
attcatcggaccgtccacgc

SEQ ID NO: 71 - DNA, 20 bp, Artificial Sequence
  sgRNA
  mm00227_Ada
cttcatctccacaaactcgt

SEQ ID NO: 72 - DNA, 20 bp, Artificial Sequence
  sgRNA
  mm00228_Ada
gctgcgcaacattatcggca

SEQ ID NO: 73 - DNA, 20 bp, Artificial Sequence
  sgRNA
  mm00229_Adam10
ggtttcatcaagactcgtgg

SEQ ID NO: 74 - DNA, 20 bp, Artificial Sequence
  sgRNA
  mm00230_Adam10
cccataaatacggcccacag

SEQ ID NO: 75 - DNA, 20 bp, Artificial Sequence
  sgRNA
  mm00231_Adam10
tatctgtggaaacgggatgg

SEQ ID NO: 76 - DNA, 20 bp, Artificial Sequence
  sgRNA
  mm00232_Adam10
caaacgagcagtctcacatg

SEQ ID NO: 77 - DNA, 20 bp, Artificial Sequence
  sgRNA
  mm00237_Adam12
tccagtctagaaactcatgg

SEQ ID NO: 78 - DNA, 20 bp, Artificial Sequence
  sgRNA
  mm00238_Adam12
agagcatgacgaacatccaa

SEQ ID NO: 79 - DNA, 20 bp, Artificial Sequence
  sgRNA
  mm00239_Adam12
ggagatccttatggtaactg

SEQ ID NO: 80 - DNA, 20 bp, Artificial Sequence
  sgRNA
  mm00240_Adam12
ggagcctggtacttaccccg

SEQ ID NO: 81 - DNA, 20 bp, Artificial Sequence
  sgRNA
  mm00241_Adam15
gggggctgtcctgaacaacc

SEQ ID NO: 82 - DNA, 20 bp, Artificial Sequence
  sgRNA
  mm00242_Adam15
tggcacccgaatggtcagcg

SEQ ID NO: 83 - DNA, 20 bp, Artificial Sequence
  sgRNA
  mm00243_Adam15
gattgtggctgataattcag

SEQ ID NO: 84 - DNA, 20 bp, Artificial Sequence
  sgRNA
  mm00244_Adam15
tgttcccctgacttctccgg

SEQ ID NO: 85 - DNA, 20 bp, Artificial Sequence
  sgRNA
  mm00245_Adam17
ggtgtgtggcaactccaggg

SEQ ID NO: 86 - DNA, 20 bp, Artificial Sequence
  sgRNA
  mm00246_Adam17
acacgtcgtgggataatgca

SEQ ID NO: 87 - DNA, 20 bp, Artificial Sequence
  sgRNA
  mm00247_Adam17
catcgacgtacggcacacac

SEQ ID NO: 88 - DNA, 20 bp, Artificial Sequence
  sgRNA
  mm00248_Adam17
gccccaaatgaggaccaagg

SEQ ID NO: 89 - DNA, 20 bp, Artificial Sequence
  sgRNA
  mm00249_Adam19
ggtgtcaatagatactgcgt

SEQ ID NO: 90 - DNA, 20 bp, Artificial Sequence
  sgRNA
  mm00250_Adam19
gacactaggacgctgtatgg

SEQ ID NO: 91 - DNA, 20 bp, Artificial Sequence
  sgRNA
  mm00251_Adam19
gccaatctcatgggccacag

SEQ ID NO: 92 - DNA, 20 bp, Artificial Sequence
  sgRNA
  mm00252_Adam19
accaactattatcagatgga

SEQ ID NO: 93 - DNA, 20 bp, Artificial Sequence
  sgRNA
  mm00253_Adam2
atgttggcgctacctatcaa

SEQ ID NO: 94 - DNA, 20 bp, Artificial Sequence
  sgRNA
  mm00254_Adam2
aagcaatggctacgaaacac

SEQ ID NO: 95 - DNA, 20 bp, Artificial Sequence
  sgRNA
  mm00255_Adam2
gaattactgtaagattaaag

SEQ ID NO: 96 - DNA, 20 bp, Artificial Sequence
  sgRNA
  mm00256_Adam2
tgcattactctacgccgaga

SEQ ID NO: 97 - DNA, 20 bp, Artificial Sequence
  sgRNA
  mm00257_Adam22
aactcacgaagggtaatcag

SEQ ID NO: 98 - DNA, 20 bp, Artificial Sequence
  sgRNA
  mm00258_Adam22
tgaataccataccagacgga

SEQ ID NO: 99 - DNA, 20 bp, Artificial Sequence
  sgRNA
  mm00259_Adam22
cgccgcccaagcgatagatg

SEQ ID NO: 100 - DNA, 20 bp, Artificial Sequence
  sgRNA
  mm00260_Adam22
gttcactcagtgcaatgtcg

SEQ ID NO: 101 - DNA, 20 bp, Artificial Sequence
  sgRNA
  mm00261_Adam3
ctgtctccgatgtattccga

SEQ ID NO: 102 - DNA, 20 bp, Artificial Sequence
  sgRNA
  mm00262_Adam3
gcatccaaagacgttagctg

SEQ ID NO: 103 - DNA, 20 bp, Artificial Sequence
  sgRNA
  mm00263_Adam3
gactcacctctggtttgaca

SEQ ID NO: 104 - DNA, 20 bp, Artificial Sequence
  sgRNA
  mm00264_Adam3
aatctgtacactgcctatct

SEQ ID NO: 105 - DNA, 20 bp, Artificial Sequence
  sgRNA
  mm00277_Adam9
ccacgcaggtgggatcaatg

SEQ ID NO: 106 - DNA, 20 bp, Artificial Sequence
  sgRNA
  mm00278_Adam9
gattcgcttagcaaactacc

SEQ ID NO: 107 - DNA, 20 bp, Artificial Sequence
  sgRNA
  mm00279_Adam9
accagcttattaccacagga

SEQ ID NO: 108 - DNA, 20 bp, Artificial Sequence
  sgRNA
  mm00280_Adam9
gtttacacctacgacaagga

SEQ ID NO: 109 - DNA, 20 bp, Artificial Sequence
  sgRNA
  mm00285_Adcy6
ccggatacatcgcctcggag

SEQ ID NO: 110 - DNA, 20 bp, Artificial Sequence
  sgRNA
  mm00286_Adcy6
ctcacgggtgcacagcaccg

SEQ ID NO: 111 - DNA, 20 bp, Artificial Sequence
  sgRNA
  mm00287_Adcy6
gagtaccacaaaaaggacag

SEQ ID NO: 112 - DNA, 20 bp, Artificial Sequence
  sgRNA
  mm00288_Adcy6
cccgaggttacatccaggcg

SEQ ID NO: 113 - DNA, 20 bp, Artificial Sequence
  sgRNA
  mm00297_Adcy9
atgtcatgacatgcacaaag

SEQ ID NO: 114 - DNA, 20 bp, Artificial Sequence
  sgRNA
  mm00298_Adcy9
tgtacgcccggcattatgcg

SEQ ID NO: 115 - DNA, 20 bp, Artificial Sequence
  sgRNA
  mm00299_Adcy9
gatggtgaacatgcgtgttg

SEQ ID NO: 116 - DNA, 20 bp, Artificial Sequence
  sgRNA
  mm00300_Adcy9
tctgctgcatcttaaagggg

SEQ ID NO: 117 - DNA, 20 bp, Artificial Sequence
  sgRNA
  mm00305_Adcyap1r1
ccaggattattactacctgt

SEQ ID NO: 118 - DNA, 20 bp, Artificial Sequence
  sgRNA
  mm00306_Adcyap1r1
gtctggatgacagaaaccat

SEQ ID NO: 119 - DNA, 20 bp, Artificial Sequence
  sgRNA
  mm00307_Adcyap1r1
ggctctactttgatgatgcg

SEQ ID NO: 120 - DNA, 20 bp, Artificial Sequence
  sgRNA
  mm00308_Adcyap1r1
tgtgggacaatatcacatgt

SEQ ID NO: 121 - DNA, 20 bp, Artificial Sequence
  sgRNA
  mm00361_Adora2b
tcactgggacacgagcgaga

SEQ ID NO: 122 - DNA, 20 bp, Artificial Sequence
  sgRNA
  mm00362_Adora2b
ttctcaaagagacatgtcac

SEQ ID NO: 123 - DNA, 20 bp, Artificial Sequence
  sgRNA
  mm00363_Adora2b
caacgtgctggtgtgcgccg

SEQ ID NO: 124 - DNA, 20 bp, Artificial Sequence
  sgRNA
  mm00364_Adora2b
ctttctggtatccctggcga

SEQ ID NO: 125 - DNA, 20 bp, Artificial Sequence
  sgRNA
  mm00381_Adra1b
agtatcgcaccccaatgtag

SEQ ID NO: 126 - DNA, 20 bp, Artificial Sequence
  sgRNA
  mm00382_Adra1b
tcttggccacgatgtagact

SEQ ID NO: 127 - DNA, 20 bp, Artificial Sequence
  sgRNA
  mm00383_Adra1b
cattccgactacaatgccca

SEQ ID NO: 128 - DNA, 20 bp, Artificial Sequence
  sgRNA
  mm00384_Adra1b
accttgaatacggcgtccgg

SEQ ID NO: 129 - DNA, 20 bp, Artificial Sequence
  sgRNA
  mm00393_Adra2a
ccagtaacccataacctcgt

SEQ ID NO: 130 - DNA, 20 bp, Artificial Sequence
  sgRNA
  mm00394_Adra2a
ggggcaccgttaagctgggt

SEQ ID NO: 131 - DNA, 20 bp, Artificial Sequence
  sgRNA
  mm00395_Adra2a
gcaagatcaacgaccagaag

SEQ ID NO: 132 - DNA, 20 bp, Artificial Sequence
  sgRNA
  mm00396_Adra2a
gacagccgagatgacccaca

SEQ ID NO: 133 - DNA, 20 bp, Artificial Sequence
  sgRNA
  mm00445_Afp
cttctccgtcacgcactggg

SEQ ID NO: 134 - DNA, 20 bp, Artificial Sequence
  sgRNA
  mm00446_Afp
cttggctgctcagtacgaca

SEQ ID NO: 135 - DNA, 20 bp, Artificial Sequence
  sgRNA
  mm00447_Afp
cttatacttacgttgcctgg

SEQ ID NO: 136 - DNA, 20 bp, Artificial Sequence
  sgRNA
  mm00448_Afp
caaaatgactagcgatgtgt

SEQ ID NO: 137 - DNA, 20 bp, Artificial Sequence
  sgRNA
  mm00457_Ager
ccttacggtagactcggact

SEQ ID NO: 138 - DNA, 20 bp, Artificial Sequence
  sgRNA
  mm00458_Ager
ccactggaattgtcgatgag

SEQ ID NO: 139 - DNA, 20 bp, Artificial Sequence
  sgRNA
  mm00459_Ager
agacgggactctttacactg

SEQ ID NO: 140 - DNA, 20 bp, Artificial Sequence
  sgRNA
  mm00460_Ager
acttgtgctaagctgtaagg

SEQ ID NO: 141 - DNA, 20 bp, Artificial Sequence
  sgRNA
  mm00461_Angpt1
actggttcctatctcaagca

SEQ ID NO: 142 - DNA, 20 bp, Artificial Sequence
  sgRNA
  mm00462_Angpt1
agcctttgcactaaagaagg

SEQ ID NO: 143 - DNA, 20 bp, Artificial Sequence
  sgRNA
  mm00463_Angpt1
ttgcaatatggatgtgaatg

SEQ ID NO: 144 - DNA, 20 bp, Artificial Sequence
  sgRNA
  mm00464_Angpt1
agaattggacaccttgaagg

SEQ ID NO: 145 - DNA, 20 bp, Artificial Sequence
  sgRNA
  mm00473_Agrn
acaccagatcagcctatacg

SEQ ID NO: 146 - DNA, 20 bp, Artificial Sequence
  sgRNA
  mm00474_Agrn
agaaggccagatgtgaagcg

SEQ ID NO: 147 - DNA, 20 bp, Artificial Sequence
  sgRNA
  mm00475_Agrn
tctgtatgcctgtcccgccg

SEQ ID NO: 148 - DNA, 20 bp, Artificial Sequence
  sgRNA
  mm00476_Agrn
gaagattctagtgtccccgg

SEQ ID NO: 149 - DNA, 20 bp, Artificial Sequence
  sgRNA
  mm00489_Agtr1a
gggccagcggtattccatag

SEQ ID NO: 150 - DNA, 20 bp, Artificial Sequence
  sgRNA
  mm00490_Agtr1a
acacgtgagcaggaacacgc

SEQ ID NO: 151 - DNA, 20 bp, Artificial Sequence
  sgRNA
  mm00491_Agtr1a
tggttaggcccagtcctatg

SEQ ID NO: 152 - DNA, 20 bp, Artificial Sequence
  sgRNA
  mm00492_Agtr1a
ttacatgaagctgaagactg

SEQ ID NO: 153 - DNA, 20 bp, Artificial Sequence
  sgRNA
  mm00497_Agtr2
gtacctatcgacactcatgc

SEQ ID NO: 154 - DNA, 20 bp, Artificial Sequence
  sgRNA
  mm00498_Agtr2
acaagccatacaccaaacaa

SEQ ID NO: 155 - DNA, 20 bp, Artificial Sequence
  sgRNA
  mm00499_Agtr2
actgagcatatttctcgggt

SEQ ID NO: 156 - DNA, 20 bp, Artificial Sequence
  sgRNA
  mm00500_Agtr2
tttgtgtgagcaattaaagg

SEQ ID NO: 157 - DNA, 20 bp, Artificial Sequence
  sgRNA
  mm00521_Ahsg
tccgttcaacgataccaacg

SEQ ID NO: 158 - DNA, 20 bp, Artificial Sequence
  sgRNA
  mm00522_Ahsg
actccaccagagtagacact

SEQ ID NO: 159 - DNA, 20 bp, Artificial Sequence
  sgRNA
  mm00523_Ahsg
ctcacagaacagtttgccag

SEQ ID NO: 160 - DNA, 20 bp, Artificial Sequence
  sgRNA
  mm00524_Ahsg
acccagtgtcattccacccc

SEQ ID NO: 161 - DNA, 20 bp, Artificial Sequence
  sgRNA
  mm00573_Alpl
ggataacgagatgccaccag

SEQ ID NO: 162 - DNA, 20 bp, Artificial Sequence
  sgRNA
  mm00574_Alpl
ctaggaggcaggattgacca

SEQ ID NO: 163 - DNA, 20 bp, Artificial Sequence
  sgRNA
  mm00575_Alpl
acctaagaggtagtccaccc

SEQ ID NO: 164 - DNA, 20 bp, Artificial Sequence
  sgRNA
  mm00576_Alpl
gttgcatcgcgtgcgctctg

SEQ ID NO: 165 - DNA, 20 bp, Artificial Sequence
  sgRNA
  mm00577_Akp3
tgttcgacttagccatcgag

SEQ ID NO: 166 - DNA, 20 bp, Artificial Sequence
  sgRNA
  mm00578_Akp3
gtgtgaacatatgtgcccga

SEQ ID NO: 167 - DNA, 20 bp, Artificial Sequence
  sgRNA
  mm00579_Akp3
ctgtccccagacatacagtg

SEQ ID NO: 168 - DNA, 20 bp, Artificial Sequence
  sgRNA
  mm00580_Akp3
gttgcactggtcgaatctcg

SEQ ID NO: 169 - DNA, 20 bp, Artificial Sequence
  sgRNA
  mm00605_Alcam
tgcaagtaggaacgcgactg

SEQ ID NO: 170 - DNA, 20 bp, Artificial Sequence
  sgRNA
  mm00606_Alcam
ctgaacaccttgactagggt

SEQ ID NO: 171 - DNA, 20 bp, Artificial Sequence
  sgRNA
  mm00607_Alcam
ggttgtcttgtactccaagg

SEQ ID NO: 172 - DNA, 20 bp, Artificial Sequence
  sgRNA
  mm00608_Alcam
actttcaggaaaagcccgat

SEQ ID NO: 173 - DNA, 20 bp, Artificial Sequence
  sgRNA
  mm00637_Alk
tgggcaacatatctccccga

SEQ ID NO: 174 - DNA, 20 bp, Artificial Sequence
  sgRNA
  mm00638_Alk
gaattccaacttgagcgtgg

SEQ ID NO: 175 - DNA, 20 bp, Artificial Sequence
  sgRNA
  mm00639_Alk
tacacttaccatatcgactg

SEQ ID NO: 176 - DNA, 20 bp, Artificial Sequence
  sgRNA
  mm00640_Alk
ggggtgtacaggatacccaa

SEQ ID NO: 177 - DNA, 20 bp, Artificial Sequence
  sgRNA
  mm00681_Ambp
gcatgaccagtactcgatgg

SEQ ID NO: 178 - DNA, 20 bp, Artificial Sequence
  sgRNA
  mm00682_Ambp
tatctggcagtgttgacgca

SEQ ID NO: 179 - DNA, 20 bp, Artificial Sequence
  sgRNA
  mm00683_Ambp
ggactgagccactaataact

SEQ ID NO: 180 - DNA, 20 bp, Artificial Sequence
  sgRNA
  mm00684_Ambp
aaggatgtggccctgaatgt

SEQ ID NO: 181 - DNA, 20 bp, Artificial Sequence
  sgRNA
  mm00689_Amelx
acccatgggttcgtaaccat

SEQ ID NO: 182 - DNA, 20 bp, Artificial Sequence
  sgRNA
  mm00690_Amelx
gctctggtaccacttcaaag

SEQ ID NO: 183 - DNA, 20 bp, Artificial Sequence
  sgRNA
  mm00691_Amelx
ggctgaagggtgtgactcgg

SEQ ID NO: 184 - DNA, 20 bp, Artificial Sequence
  sgRNA
  mm00692_Amelx
gggctgttgagctggcacca

SEQ ID NO: 185 - DNA, 20 bp, Artificial Sequence
  sgRNA
  mm00725_Ank3
ctatacaccactgcacatcg

SEQ ID NO: 186 - DNA, 20 bp, Artificial Sequence
  sgRNA
  mm00726_Ank3
caaccaccgagatgtaacca

SEQ ID NO: 187 - DNA, 20 bp, Artificial Sequence
  sgRNA
  mm00727_Ank3
atctattcaagccgtaaccg

SEQ ID NO: 188 - DNA, 20 bp, Artificial Sequence
  sgRNA
  mm00728_Ank3
gagggatttccacaatgacg

SEQ ID NO: 189 - DNA, 20 bp, Artificial Sequence
  sgRNA
  mm00753_Anxa4
cctggcctctcgtacccctg

SEQ ID NO: 190 - DNA, 20 bp, Artificial Sequence
  sgRNA
  mm00754_Anxa4
gcttcataagagcatcatca

SEQ ID NO: 191 - DNA, 20 bp, Artificial Sequence
  sgRNA
  mm00755_Anxa4
ctgtacgtcatacagcactg

SEQ ID NO: 192 - DNA, 20 bp, Artificial Sequence
  sgRNA
  mm00756_Anxa4
ggaaccatctgctccacggt

SEQ ID NO: 193 - DNA, 20 bp, Artificial Sequence
  sgRNA
  mm00757_Anxa5
taggcatcgtagagtcgtga

SEQ ID NO: 194 - DNA, 20 bp, Artificial Sequence
  sgRNA
  mm00758_Anxa5
atcaatttcaggtaccgatg

SEQ ID NO: 195 - DNA, 20 bp, Artificial Sequence
  sgRNA
  mm00759_Anxa5
atacttcagggtactaccag

SEQ ID NO: 196 - DNA, 20 bp, Artificial Sequence
  sgRNA
  mm00760_Anxa5
tgtccttgaagcaataatct

SEQ ID NO: 197 - DNA, 20 bp, Artificial Sequence
  sgRNA
  mm00773_Aoc3
acaatgactacagccccccg

SEQ ID NO: 198 - DNA, 20 bp, Artificial Sequence
  sgRNA
  mm00774_Aoc3
atcaatgtcgacctgctacg

SEQ ID NO: 199 - DNA, 20 bp, Artificial Sequence
  sgRNA
  mm00775_Aoc3
tcccaaacaatggtacaggt

SEQ ID NO: 200 - DNA, 20 bp, Artificial Sequence
  sgRNA
  mm00776_Aoc3
tgcatcacgtagtgtcttgg

SEQ ID NO: 201 - DNA, 20 bp, Artificial Sequence
  sgRNA
  mm00821_Ap2m1
ccaaagataccgtactacca

SEQ ID NO: 202 - DNA, 20 bp, Artificial Sequence
  sgRNA
  mm00822_Ap2m1
gagaagacacttaccctgtg

SEQ ID NO: 203 - DNA, 20 bp, Artificial Sequence
  sgRNA
  mm00823_Ap2m1
cagctgatgaaacaagcaag

SEQ ID NO: 204 - DNA, 20 bp, Artificial Sequence
  sgRNA
  mm00824_Ap2m1
cctttatcccatatagacga

SEQ ID NO: 205 - DNA, 20 bp, Artificial Sequence
  sgRNA
  mm00913_Apoa1
ggagctctaccgccagaagg

SEQ ID NO: 206 - DNA, 20 bp, Artificial Sequence
  sgRNA
  mm00914_Apoa1
caaggaggaggattcaaact

SEQ ID NO: 207 - DNA, 20 bp, Artificial Sequence
  sgRNA
  mm00915_Apoa1
gtcccaatgggacaaagtga

SEQ ID NO: 208 - DNA, 20 bp, Artificial Sequence
  sgRNA
  mm00916_Apoa1
ctggaaaactgggacactct

SEQ ID NO: 209 - DNA, 20 bp, Artificial Sequence
  sgRNA
  mm00921_Apoa4
caaagtaacccagacgttcg

SEQ ID NO: 210 - DNA, 20 bp, Artificial Sequence
  sgRNA
  mm00922_Apoa4
ggtggcaaggggcatcatcg

SEQ ID NO: 211 - DNA, 20 bp, Artificial Sequence
  sgRNA
  mm00923_Apoa4
tgctagtacgtatgctgatg

SEQ ID NO: 212 - DNA, 20 bp, Artificial Sequence
  sgRNA
  mm00924_Apoa4
aaagtaatcccacaccacat

SEQ ID NO: 213 - DNA, 20 bp, Artificial Sequence
  sgRNA
  mm00949_Apoh
aaagacatcctacgaccctg

SEQ ID NO: 214 - DNA, 20 bp, Artificial Sequence
  sgRNA
  mm00950_Apoh
tttccgatcatggcaaagtg

SEQ ID NO: 215 - DNA, 20 bp, Artificial Sequence
  sgRNA
  mm00951_Apoh
cagctcatctaagtgcacgg

SEQ ID NO: 216 - DNA, 20 bp, Artificial Sequence
  sgRNA
  mm00952_Apoh
aggattataggccttcagct

SEQ ID NO: 217 - DNA, 20 bp, Artificial Sequence
  sgRNA
  mm00957_App
cacggaagagtactgcatgg

SEQ ID NO: 218 - DNA, 20 bp, Artificial Sequence
  sgRNA
  mm00958_App
gcagcttgtagagacacaca

SEQ ID NO: 219 - DNA, 20 bp, Artificial Sequence
  sgRNA
  mm00959_App
aacggtaaggaatcacgatg

SEQ ID NO: 220 - DNA, 20 bp, Artificial Sequence
  sgRNA
  mm00960_App
caaaacctgcattggcacca

SEQ ID NO: 221 - DNA, 20 bp, Artificial Sequence
  sgRNA
  mm00965_Aqp1
aagtgaattgtcgactaggg

SEQ ID NO: 222 - DNA, 20 bp, Artificial Sequence
  sgRNA
  mm00966_Aqp1
cctaggcttcaattacccac

SEQ ID NO: 223 - DNA, 20 bp, Artificial Sequence
  sgRNA
  mm00967_Aqp1
ggagccccagtgtgaccgca

SEQ ID NO: 224 - DNA, 20 bp, Artificial Sequence
  sgRNA
  mm00968_Aqp1
tgatgtacatgacagcccgg

SEQ ID NO: 225 - DNA, 20 bp, Artificial Sequence
  sgRNA
  mm00977_Aqp4
ggatccaccataaactgggg

SEQ ID NO: 226 - DNA, 20 bp, Artificial Sequence
  sgRNA
  mm00978_Aqp4
accatggctacagtcacagc

SEQ ID NO: 227 - DNA, 20 bp, Artificial Sequence
  sgRNA
  mm00979_Aqp4
aagtgattattaactccacc

SEQ ID NO: 228 - DNA, 20 bp, Artificial Sequence
  sgRNA
  mm00980_Aqp4
aatcctccaaccacactggg

SEQ ID NO: 229 - DNA, 20 bp, Artificial Sequence
  sgRNA
  mm01017_Areg
aggggactacgactactcag

SEQ ID NO: 230 - DNA, 20 bp, Artificial Sequence
  sgRNA
  mm01018_Areg
agaaggcatttcgcttatgg

SEQ ID NO: 231 - DNA, 20 bp, Artificial Sequence
  sgRNA
  mm01019_Areg
cagatacatcgagaacctgg

SEQ ID NO: 232 - DNA, 20 bp, Artificial Sequence
  sgRNA
  mm01020_Areg
gaaaggcgaatcgctttctg

SEQ ID NO: 233 - DNA, 20 bp, Artificial Sequence
  sgRNA
  mm01037_Arf6
ccccacggtgggcttcaacg

SEQ ID NO: 234 - DNA, 20 bp, Artificial Sequence
  sgRNA
  mm01038_Arf6
tctggcggcattactacacc

SEQ ID NO: 235 - DNA, 20 bp, Artificial Sequence
  sgRNA
  mm01039_Arf6
tcttcgggaacaaggaaatg

SEQ ID NO: 236 - DNA, 20 bp, Artificial Sequence
  sgRNA
  mm01040_Arf6
cgaccgcgaccgcatcgacg

SEQ ID NO: 237 - DNA, 20 bp, Artificial Sequence
  sgRNA
  mm01049_Rhoa
aaaacacatcaatataacat

SEQ ID NO: 238 - DNA, 20 bp, Artificial Sequence
  sgRNA
  mm01050_Rhoa
ctatgtggcggatatcgagg

SEQ ID NO: 239 - DNA, 20 bp, Artificial Sequence
  sgRNA
  mm01051_Rhoa
gctactcacctaaactatca

SEQ ID NO: 240 - DNA, 20 bp, Artificial Sequence
  sgRNA
  mm01052_Rhoa
cagcaaggaccagttcccag

SEQ ID NO: 241 - DNA, 20 bp, Artificial Sequence
  sgRNA
  mm01053_Rhob
gaagcacataaggatgacgt

SEQ ID NO: 242 - DNA, 20 bp, Artificial Sequence
  sgRNA
  mm01054_Rhob
cacatagttctcgaacacgg

SEQ ID NO: 243 - DNA, 20 bp, Artificial Sequence
  sgRNA
  mm01055_Rhob
ggggcagaagtgctttacct

SEQ ID NO: 244 - DNA, 20 bp, Artificial Sequence
  sgRNA
  mm01056_Rhob
cagcgacgagcatgtccgca

SEQ ID NO: 245 - DNA, 20 bp, Artificial Sequence
  sgRNA
  mm01057_Rhoc
acgtgcccatcatcctagtg

SEQ ID NO: 246 - DNA, 20 bp, Artificial Sequence
  sgRNA
  mm01058_Rhoc
gatgacgtcagtgtccgggt

SEQ ID NO: 247 - DNA, 20 bp, Artificial Sequence
  sgRNA
  mm01059_Rhoc
ctatatagccgacatcgaag

SEQ ID NO: 248 - DNA, 20 bp, Artificial Sequence
  sgRNA
  mm01060_Rhoc
cagcaaagatcagtttccag

SEQ ID NO: 249 - DNA, 20 bp, Artificial Sequence
  sgRNA
  mm01105_Art1
tgccgcccaacaatttggcg

SEQ ID NO: 250 - DNA, 20 bp, Artificial Sequence
  sgRNA
  mm01106_Art1
tcaggccaacaaagtatacg

SEQ ID NO: 251 - DNA, 20 bp, Artificial Sequence
  sgRNA
  mm01107_Art1
aaagccccccagcctaacgg

SEQ ID NO: 252 - DNA, 20 bp, Artificial Sequence
  sgRNA
  mm01108_Art1
gctggcacccgcgagatcgg

SEQ ID NO: 253 - DNA, 20 bp, Artificial Sequence
  sgRNA
  mm01109_Art2b
ggttgtagtttagtttaccg

SEQ ID NO: 254 - DNA, 20 bp, Artificial Sequence
  sgRNA
  mm01110_Art2b
aacagtacgagttatccggc

SEQ ID NO: 255 - DNA, 20 bp, Artificial Sequence
  sgRNA
  mm01111_Art2b
ctctgttaaaatctatagcg

SEQ ID NO: 256 - DNA, 20 bp, Artificial Sequence
  sgRNA
  mm01112_Art2b
ctagcatgaaaggcactgca

SEQ ID NO: 257 - DNA, 20 bp, Artificial Sequence
  sgRNA
  mm01125_Arsb
ggtgggcagactaggtctgg

SEQ ID NO: 258 - DNA, 20 bp, Artificial Sequence
  sgRNA
  mm01126_Arsb
gaatgtctgccgacacgccg

SEQ ID NO: 259 - DNA, 20 bp, Artificial Sequence
  sgRNA
  mm01127_Arsb
agcacagacgtatttatgca

SEQ ID NO: 260 - DNA, 20 bp, Artificial Sequence
  sgRNA
  mm01128_Arsb
gccagcacgaagaccacatg

SEQ ID NO: 261 - DNA, 20 bp, Artificial Sequence
  sgRNA
  mm01129_Arsa
aagcacgttaggttctgaca

SEQ ID NO: 262 - DNA, 20 bp, Artificial Sequence
  sgRNA
  mm01130_Arsa
aggagtccccaaatggccca

SEQ ID NO: 263 - DNA, 20 bp, Artificial Sequence
  sgRNA
  mm01131_Arsa
gtgacctggccagtagacca

SEQ ID NO: 264 - DNA, 20 bp, Artificial Sequence
  sgRNA
  mm01132_Arsa
tcgggagaaagacacatacc

SEQ ID NO: 265 - DNA, 20 bp, Artificial Sequence
  sgRNA
  mm01133_Asah1
gcaaggtgtacgttacctag

SEQ ID NO: 266 - DNA, 20 bp, Artificial Sequence
  sgRNA
  mm01134_Asah1
taacatttataacataccgc

SEQ ID NO: 267 - DNA, 20 bp, Artificial Sequence
  sgRNA
  mm01135_Asah1
agtgataaaccctacccact

SEQ ID NO: 268 - DNA, 20 bp, Artificial Sequence
  sgRNA
  mm01136_Asah1
gaatataaataataacactt

SEQ ID NO: 269 - DNA, 20 bp, Artificial Sequence
  sgRNA
  mm01153_Astn1
ccttacacgatatttcagcg

SEQ ID NO: 270 - DNA, 20 bp, Artificial Sequence
  sgRNA
  mm01154_Astn1
tgctcagatggtttcaacgg

SEQ ID NO: 271 - DNA, 20 bp, Artificial Sequence
  sgRNA
  mm01155_Astn1
tgacatgagaagagcacacg

SEQ ID NO: 272 - DNA, 20 bp, Artificial Sequence
  sgRNA
  mm01156_Astn1
tgatgatcctgtacactcgc

SEQ ID NO: 273 - DNA, 20 bp, Artificial Sequence
  sgRNA
  mm01213_Atp1a1
gtacacgacgatgccacgtg

SEQ ID NO: 274 - DNA, 20 bp, Artificial Sequence
  sgRNA
  mm01214_Atp1a1
cttaccactctgattctccg

SEQ ID NO: 275 - DNA, 20 bp, Artificial Sequence
  sgRNA
  mm01215_Atp1a1
aatctgttccgtatttacga

SEQ ID NO: 276 - DNA, 20 bp, Artificial Sequence
  sgRNA
  mm01216_Atp1a1
gaaaatgagcatcaatgcgg

SEQ ID NO: 277 - DNA, 20 bp, Artificial Sequence
  sgRNA
  mm01217_Atp1b1
gtacttacaccaactaccac

SEQ ID NO: 278 - DNA, 20 bp, Artificial Sequence
  sgRNA
  mm01218_Atp1b1
ttgagcttgataatgatgca

SEQ ID NO: 279 - DNA, 20 bp, Artificial Sequence
  sgRNA
  mm01219_Atp1b1
ggcgacatcaatcacgaacg

SEQ ID NO: 280 - DNA, 20 bp, Artificial Sequence
  sgRNA
  mm01220_Atp1b1
agctcttggggtcattagga

SEQ ID NO: 281 - DNA, 20 bp, Artificial Sequence
  sgRNA
  mm01221_Atp1b2
ggttgctcataatatcgccc

SEQ ID NO: 282 - DNA, 20 bp, Artificial Sequence
  sgRNA
  mm01222_Atp1b2
aggagttcgtgtggaacccg

SEQ ID NO: 283 - DNA, 20 bp, Artificial Sequence
  sgRNA
  mm01223_Atp1b2
attagtgacactgaaagctg

SEQ ID NO: 284 - DNA, 20 bp, Artificial Sequence
  sgRNA
  mm01224_Atp1b2
cagtcgatcctggtacttgg

SEQ ID NO: 285 - DNA, 20 bp, Artificial Sequence
  sgRNA
  mm01225_Atp1b3
ctccatcaggacaacttgtg

SEQ ID NO: 286 - DNA, 20 bp, Artificial Sequence
  sgRNA
  mm01226_Atp1b3
tcaacacaattacctggact

SEQ ID NO: 287 - DNA, 20 bp, Artificial Sequence
  sgRNA
  mm01227_Atp1b3
gccacagacttacaaaaagt

SEQ ID NO: 288 - DNA, 20 bp, Artificial Sequence
  sgRNA
  mm01228_Atp1b3
cgagcagcggagagtttctg

SEQ ID NO: 289 - DNA, 20 bp, Artificial Sequence
  sgRNA
  mm01257_Atp5b
ctgctggccccatacgccaa

SEQ ID NO: 290 - DNA, 20 bp, Artificial Sequence
  sgRNA
  mm01258_Atp5b
gcgcttaccaggatgaaccc

SEQ ID NO: 291 - DNA, 20 bp, Artificial Sequence
  sgRNA
  mm01259_Atp5b
aaatacagagtaaccaccat

SEQ ID NO: 292 - DNA, 20 bp, Artificial Sequence
  sgRNA
  mm01260_Atp5b
cccaccctagccaccgacat

SEQ ID NO: 293 - DNA, 20 bp, Artificial Sequence
  sgRNA
  mm01277_Atp6v1a
tgactgctgatatccgacag

SEQ ID NO: 294 - DNA, 20 bp, Artificial Sequence
  sgRNA
  mm01278_Atp6v1a
agtcggccatcatactgacg

SEQ ID NO: 295 - DNA, 20 bp, Artificial Sequence
  sgRNA
  mm01279_Atp6v1a
atgttgcccccacgtaacag

SEQ ID NO: 296 - DNA, 20 bp, Artificial Sequence
  sgRNA
  mm01280_Atp6v1a
cttacgggaaaagggcatcg

SEQ ID NO: 297 - DNA, 20 bp, Artificial Sequence
  sgRNA
  mm01325_Slc7a1
gccatggcatagataactcg

SEQ ID NO: 298 - DNA, 20 bp, Artificial Sequence
  sgRNA
  mm01326_Slc7a1
cacaaacgtgaaatacggtg

SEQ ID NO: 299 - DNA, 20 bp, Artificial Sequence
  sgRNA
  mm01327_Slc7a1
tgacgtgagaactctccgat

SEQ ID NO: 300 - DNA, 20 bp, Artificial Sequence
  sgRNA
  mm01328_Slc7a1
ccaggtccttcagttcaaag

SEQ ID NO: 301 - DNA, 20 bp, Artificial Sequence
  sgRNA
  mm01329_Slc7a2
aggacgtcactattccgatg

SEQ ID NO: 302 - DNA, 20 bp, Artificial Sequence
  sgRNA
  mm01330_Slc7a2
gaacggaacaagcatctacg

SEQ ID NO: 303 - DNA, 20 bp, Artificial Sequence
  sgRNA
  mm01331_Slc7a2
gtatctatacacttacgtca

SEQ ID NO: 304 - DNA, 20 bp, Artificial Sequence
  sgRNA
  mm01332_Slc7a2
ccgagacaacatatttggcg

SEQ ID NO: 305 - DNA, 20 bp, Artificial Sequence
  sgRNA
  mm01337_Atrn
cctcactgtacagacaactg

SEQ ID NO: 306 - DNA, 20 bp, Artificial Sequence
  sgRNA
  mm01338_Atrn
acgatgtggatactcagatg

SEQ ID NO: 307 - DNA, 20 bp, Artificial Sequence
  sgRNA
  mm01339_Atrn
gaggaaaaattgattcaaca

SEQ ID NO: 308 - DNA, 20 bp, Artificial Sequence
  sgRNA
  mm01340_Atrn
ggccgccgttgacacacggc

SEQ ID NO: 309 - DNA, 20 bp, Artificial Sequence
  sgRNA
  mm01353_Pcdh15
ctatcatgaagtacgcatcg

SEQ ID NO: 310 - DNA, 20 bp, Artificial Sequence
  sgRNA
  mm01354_Pcdh15
gaagcgggggtaatcctcag

SEQ ID NO: 311 - DNA, 20 bp, Artificial Sequence
  sgRNA
  mm01355_Pcdh15
ttagcaaacgcatctacaag

SEQ ID NO: 312 - DNA, 20 bp, Artificial Sequence
  sgRNA
  mm01356_Pcdh15
cttcctgaatgactacacct

SEQ ID NO: 313 - DNA, 20 bp, Artificial Sequence
  sgRNA
  mm01385_B2m
atttggatttcaatgtgagg

SEQ ID NO: 314 - DNA, 20 bp, Artificial Sequence
  sgRNA
  mm01386_B2m
actcactctggatagcatac

SEQ ID NO: 315 - DNA, 20 bp, Artificial Sequence
  sgRNA
  mm01387_B2m
tgagtatacttgaatttgag

SEQ ID NO: 316 - DNA, 20 bp, Artificial Sequence
  sgRNA
  mm01388_B2m
tcggcttcccattctccggt

SEQ ID NO: 317 - DNA, 20 bp, Artificial Sequence
  sgRNA
  mm01437_Bcan
cgaagcctaccggttccgcg

SEQ ID NO: 318 - DNA, 20 bp, Artificial Sequence
  sgRNA
  mm01438_Bcan
gatggagagcgagtctcgtg

SEQ ID NO: 319 - DNA, 20 bp, Artificial Sequence
  sgRNA
  mm01439_Bcan
tggatggctatcctggcgtg

SEQ ID NO: 320 - DNA, 20 bp, Artificial Sequence
  sgRNA
  mm01440_Bcan
acacccagccaacgctgtgg

SEQ ID NO: 321 - DNA, 20 bp, Artificial Sequence
  sgRNA
  mm01445_Phb2
tctatgaccgccttccactg

SEQ ID NO: 322 - DNA, 20 bp, Artificial Sequence
  sgRNA
  mm01446_Phb2
tgggtcgggacagcacacgc

SEQ ID NO: 323 - DNA, 20 bp, Artificial Sequence
  sgRNA
  mm01447_Phb2
catagtccagccctagacgc

SEQ ID NO: 324 - DNA, 20 bp, Artificial Sequence
  sgRNA
  mm01448_Phb2
agcgccgtgcccatgccccg

SEQ ID NO: 325 - DNA, 20 bp, Artificial Sequence
  sgRNA
  mm01457_Bche
aattacaaccaagaccggaa

SEQ ID NO: 326 - DNA, 20 bp, Artificial Sequence
  sgRNA
  mm01458_Bche
gtttcgatgaactatagggt

SEQ ID NO: 327 - DNA, 20 bp, Artificial Sequence
  sgRNA
  mm01459_Bche
ctgggcagtaaagcatcctg

SEQ ID NO: 328 - DNA, 20 bp, Artificial Sequence
  sgRNA
  mm01460_Bche
acaatgatagccttatcaca

SEQ ID NO: 329 - DNA, 20 bp, Artificial Sequence
  sgRNA
  mm01529_Bdkrb2
gcacaaaaacagctgcactg

SEQ ID NO: 330 - DNA, 20 bp, Artificial Sequence
  sgRNA
  mm01530_Bdkrb2
ggacgggtagacgatgacgc

SEQ ID NO: 331 - DNA, 20 bp, Artificial Sequence
  sgRNA
  mm01531_Bdkrb2
tcccgttaagagcagacccg

SEQ ID NO: 332 - DNA, 20 bp, Artificial Sequence
  sgRNA
  mm01532_Bdkrb2
catcgccaataactttgact

SEQ ID NO: 333 - DNA, 20 bp, Artificial Sequence
  sgRNA
  mm01565_Bgn
atggattcgtagttctacca

SEQ ID NO: 334 - DNA, 20 bp, Artificial Sequence
  sgRNA
  mm01566_Bgn
gaagttcgttcagggtctca

SEQ ID NO: 335 - DNA, 20 bp, Artificial Sequence
  sgRNA
  mm01567_Bgn
gttctgcaggtctagcagtg

SEQ ID NO: 336 - DNA, 20 bp, Artificial Sequence
  sgRNA
  mm01568_Bgn
cttattgtttaccaagacca

SEQ ID NO: 337 - DNA, 20 bp, Artificial Sequence
  sgRNA
  mm01589_Fabp7
actgtgattatcagtcagga

SEQ ID NO: 338 - DNA, 20 bp, Artificial Sequence
  sgRNA
  mm01590_Fabp7
tagatgctttctgcgcaacc

SEQ ID NO: 339 - DNA, 20 bp, Artificial Sequence
  sgRNA
  mm01591_Fabp7
cacgtttcccacttgcctag

SEQ ID NO: 340 - DNA, 20 bp, Artificial Sequence
  sgRNA
  mm01592_Fabp7
tcttgaatgtgcattgtgtc

SEQ ID NO: 341 - DNA, 20 bp, Artificial Sequence
  sgRNA
  mm01605_Cxcr5
gaaggtcggctactgcgagg

SEQ ID NO: 342 - DNA, 20 bp, Artificial Sequence
  sgRNA
  mm01606_Cxcr5
gtgatgggatggtgttacgt

SEQ ID NO: 343 - DNA, 20 bp, Artificial Sequence
  sgRNA
  mm01607_Cxcr5
ggatggagaggagtcgacgg

SEQ ID NO: 344 - DNA, 20 bp, Artificial Sequence
  sgRNA
  mm01608_Cxcr5
ggatgtttcccatcataccc

SEQ ID NO: 345 - DNA, 20 bp, Artificial Sequence
  sgRNA
  mm01613_Bmp1
cccacctcggcgacccacgt

SEQ ID NO: 346 - DNA, 20 bp, Artificial Sequence
  sgRNA
  mm01614_Bmp1
agccacagtagcgcccaatg

SEQ ID NO: 347 - DNA, 20 bp, Artificial Sequence
  sgRNA
  mm01615_Bmp1
gtagccattgggatactcag

SEQ ID NO: 348 - DNA, 20 bp, Artificial Sequence
  sgRNA
  mm01616_Bmp1
tgttcaaggcccaaccgcgg

SEQ ID NO: 349 - DNA, 20 bp, Artificial Sequence
  sgRNA
  mm01617_Bmp10
tcgcatgatgtatgatggcg

SEQ ID NO: 350 - DNA, 20 bp, Artificial Sequence
  sgRNA
  mm01618_Bmp10
ctacggaaccaacagtgagt

SEQ ID NO: 351 - DNA, 20 bp, Artificial Sequence
  sgRNA
  mm01619_Bmp10
ctccggatgatgttagcaga

SEQ ID NO: 352 - DNA, 20 bp, Artificial Sequence
  sgRNA
  mm01620_Bmp10
actgctcaaggcccataatg

SEQ ID NO: 353 - DNA, 20 bp, Artificial Sequence
  sgRNA
  mm01625_Bmp2
gggccgcaagaagttcgccg

SEQ ID NO: 354 - DNA, 20 bp, Artificial Sequence
  sgRNA
  mm01626_Bmp2
gtgcgcagcttccatcacga

SEQ ID NO: 355 - DNA, 20 bp, Artificial Sequence
  sgRNA
  mm01627_Bmp2
gcccatttagaggagaaccc

SEQ ID NO: 356 - DNA, 20 bp, Artificial Sequence
  sgRNA
  mm01628_Bmp2
tgtgttctgattcactaacc

SEQ ID NO: 357 - DNA, 20 bp, Artificial Sequence
  sgRNA
  mm01657_Bmpr1a
gggtaccataaatttctgtg

SEQ ID NO: 358 - DNA, 20 bp, Artificial Sequence
  sgRNA
  mm01658_Bmpr1a
tgacctacctataacaacag

SEQ ID NO: 359 - DNA, 20 bp, Artificial Sequence
  sgRNA
  mm01659_Bmpr1a
aatctagatagtatgctcca

SEQ ID NO: 360 - DNA, 20 bp, Artificial Sequence
  sgRNA
  mm01660_Bmpr1a
catacacccagaagttaatg

SEQ ID NO: 361 - DNA, 20 bp, Artificial Sequence
  sgRNA
  mm01665_Bmpr2
gtaggatgttggtctcacat

SEQ ID NO: 362 - DNA, 20 bp, Artificial Sequence
  sgRNA
  mm01666_Bmpr2
cacacagaattaccacgagg

SEQ ID NO: 363 - DNA, 20 bp, Artificial Sequence
  sgRNA
  mm01667_Bmpr2
gctggacatcgaatgctcag

SEQ ID NO: 364 - DNA, 20 bp, Artificial Sequence
  sgRNA
  mm01668_Bmpr2
agataatgcggctataagtg

SEQ ID NO: 365 - DNA, 20 bp, Artificial Sequence
  sgRNA
  mm01697_Bst1
agactgtgaaaacaacgccg

SEQ ID NO: 366 - DNA, 20 bp, Artificial Sequence
  sgRNA
  mm01698_Bst1
ttctgggggcaagagcgcgg

SEQ ID NO: 367 - DNA, 20 bp, Artificial Sequence
  sgRNA
  mm01699_Bst1
cctgctcgttatgagctatg

SEQ ID NO: 368 - DNA, 20 bp, Artificial Sequence
  sgRNA
  mm01700_Bst1
aaaggagcctatcccacgag

SEQ ID NO: 369 - DNA, 20 bp, Artificial Sequence
  sgRNA
  mm01733_Bsg
ggacgcagatgaccgctctg

SEQ ID NO: 370 - DNA, 20 bp, Artificial Sequence
  sgRNA
  mm01734_Bsg
ccaccttactcggccaccca

SEQ ID NO: 371 - DNA, 20 bp, Artificial Sequence
  sgRNA
  mm01735_Bsg
gaaatcagagcattccagtg

SEQ ID NO: 372 - DNA, 20 bp, Artificial Sequence
  sgRNA
  mm01736_Bsg
caaaccaccactggatctcg

SEQ ID NO: 373 - DNA, 20 bp, Artificial Sequence
  sgRNA
  mm01737_Bsn
ccacagccagtccgacacga

SEQ ID NO: 374 - DNA, 20 bp, Artificial Sequence
  sgRNA
  mm01738_Bsn
agacatgtcactgcaaaccg

SEQ ID NO: 375 - DNA, 20 bp, Artificial Sequence
  sgRNA
  mm01739_Bsn
accgagctatagcgccgcag

SEQ ID NO: 376 - DNA, 20 bp, Artificial Sequence
  sgRNA
  mm01740_Bsn
gaggacgactccttggcatg

SEQ ID NO: 377 - DNA, 20 bp, Artificial Sequence
  sgRNA
  mm01797_C1qa
cacagatgaagcgacccgtg

SEQ ID NO: 378 - DNA, 20 bp, Artificial Sequence
  sgRNA
  mm01798_C1qa
cccaatgacgcttggcaacg

SEQ ID NO: 379 - DNA, 20 bp, Artificial Sequence
  sgRNA
  mm01799_C1qa
ttcagccactgtccatacta

SEQ ID NO: 380 - DNA, 20 bp, Artificial Sequence
  sgRNA
  mm01800_C1qa
aggcaatccaggcaatatca

SEQ ID NO: 381 - DNA, 20 bp, Artificial Sequence
  sgRNA
  mm01805_C1qbp
atcagtcaagaattcaacga

SEQ ID NO: 382 - DNA, 20 bp, Artificial Sequence
  sgRNA
  mm01806_C1qbp
cgtacgctgagcaaaccgaa

SEQ ID NO: 383 - DNA, 20 bp, Artificial Sequence
  sgRNA
  mm01807_C1qbp
gttgaagttaccaagactga

SEQ ID NO: 384 - DNA, 20 bp, Artificial Sequence
  sgRNA
  mm01808_C1qbp
tcctcctcaccatcaaatgt

SEQ ID NO: 385 - DNA, 20 bp, Artificial Sequence
  sgRNA
  mm01817_Ciita
agctcgactaaggctccggg

SEQ ID NO: 386 - DNA, 20 bp, Artificial Sequence
  sgRNA
  mm01818_Ciita
aggtccttgattatatcgtg

SEQ ID NO: 387 - DNA, 20 bp, Artificial Sequence
  sgRNA
  mm01819_Ciita
tccagtgtcctaatctacca

SEQ ID NO: 388 - DNA, 20 bp, Artificial Sequence
  sgRNA
  mm01820_Ciita
agcaggccaagacttacatg

SEQ ID NO: 389 - DNA, 20 bp, Artificial Sequence
  sgRNA
  mm01821_C3ar1
gcttatgtactatcagacat

SEQ ID NO: 390 - DNA, 20 bp, Artificial Sequence
  sgRNA
  mm01822_C3ar1
ggaggctttccaccataatg

SEQ ID NO: 391 - DNA, 20 bp, Artificial Sequence
  sgRNA
  mm01823_C3ar1
tggatgggataagtttgcac

SEQ ID NO: 392 - DNA, 20 bp, Artificial Sequence
  sgRNA
  mm01824_C3ar1
gagaccaagaatgaccatgg

SEQ ID NO: 393 - DNA, 20 bp, Artificial Sequence
  sgRNA
  mm01833_C5ar1
cgagggcaggactatacagg

SEQ ID NO: 394 - DNA, 20 bp, Artificial Sequence
  sgRNA
  mm01834_C5ar1
tccatccttcgtgtaccggg

SEQ ID NO: 395 - DNA, 20 bp, Artificial Sequence
  sgRNA
  mm01835_C5ar1
gaacaccagcaggaaacggt

SEQ ID NO: 396 - DNA, 20 bp, Artificial Sequence
  sgRNA
  mm01836_C5ar1
gcagtgccaagcacgagagg

SEQ ID NO: 397 - DNA, 20 bp, Artificial Sequence
  sgRNA
  mm01841_Hyou1
acaggcggataaccctcatg

SEQ ID NO: 398 - DNA, 20 bp, Artificial Sequence
  sgRNA
  mm01842_Hyou1
acatcgtactcacttgccca

SEQ ID NO: 399 - DNA, 20 bp, Artificial Sequence
  sgRNA
  mm01843_Hyou1
tggaattgatatctttccgg

SEQ ID NO: 400 - DNA, 20 bp, Artificial Sequence
  sgRNA
  mm01844_Hyou1
tggcgtgctcagtttagaca

SEQ ID NO: 401 - DNA, 20 bp, Artificial Sequence
  sgRNA
  mm01853_Cacna1b
gagcgacgagcaagacaccg

SEQ ID NO: 402 - DNA, 20 bp, Artificial Sequence
  sgRNA
  mm01854_Cacna1b
tctgtgctttcaccatacgc

SEQ ID NO: 403 - DNA, 20 bp, Artificial Sequence
  sgRNA
  mm01855_Cacna1b
catgggattgagtcgcaagg

SEQ ID NO: 404 - DNA, 20 bp, Artificial Sequence
  sgRNA
  mm01856_Cacna1b
aagggctcctaccttcggaa

SEQ ID NO: 405 - DNA, 20 bp, Artificial Sequence
  sgRNA
  mm01857_Cacna1c
ccagtaaattccaaccattg

SEQ ID NO: 406 - DNA, 20 bp, Artificial Sequence
  sgRNA
  mm01858_Cacna1c
aatcagggtggataagacgt

SEQ ID NO: 407 - DNA, 20 bp, Artificial Sequence
  sgRNA
  mm01859_Cacna1c
gacatcgagggagaaaactg

SEQ ID NO: 408 - DNA, 20 bp, Artificial Sequence
  sgRNA
  mm01860_Cacna1c
ccagtacaaagtgtggtacg

SEQ ID NO: 409 - DNA, 20 bp, Artificial Sequence
  sgRNA
  mm01873_Cacna1s
ctgatggaataggaagccgt

SEQ ID NO: 410 - DNA, 20 bp, Artificial Sequence
  sgRNA
  mm01874_Cacna1s
tctccagcattacaaccagt

SEQ ID NO: 411 - DNA, 20 bp, Artificial Sequence
  sgRNA
  mm01875_Cacna1s
tccagctcatgtaaccacgg

SEQ ID NO: 412 - DNA, 20 bp, Artificial Sequence
  sgRNA
  mm01876_Cacna1s
aaatgcacaccagcacacca

SEQ ID NO: 413 - DNA, 20 bp, Artificial Sequence
  sgRNA
  mm01877_Cacna2d1
ttgcagcttactgtaaaacg

SEQ ID NO: 414 - DNA, 20 bp, Artificial Sequence
  sgRNA
  mm01878_Cacna2d1
attcccacggacatctatga

SEQ ID NO: 415 - DNA, 20 bp, Artificial Sequence
  sgRNA
  mm01879_Cacna2d1
ggtcaacataattatgacag

SEQ ID NO: 416 - DNA, 20 bp, Artificial Sequence
  sgRNA
  mm01880_Cacna2d1
atgatgtacgcagaagacca

SEQ ID NO: 417 - DNA, 20 bp, Artificial Sequence
  sgRNA
  mm01909_Pdia4
ctgactgttaacataccacg

SEQ ID NO: 418 - DNA, 20 bp, Artificial Sequence
  sgRNA
  mm01910_Pdia4
gtacagcaaacgccccctgg

SEQ ID NO: 419 - DNA, 20 bp, Artificial Sequence
  sgRNA
  mm01911_Pdia4
tactggagttctatgcacca

SEQ ID NO: 420 - DNA, 20 bp, Artificial Sequence
  sgRNA
  mm01912_Pdia4
agcatcctgatactgcaagt

SEQ ID NO: 421 - DNA, 20 bp, Artificial Sequence
  sgRNA
  mm01917_Anxa2
cagatcagtcttgtacactg

SEQ ID NO: 422 - DNA, 20 bp, Artificial Sequence
  sgRNA
  mm01918_Anxa2
gtttgtcaggatgttgacaa

SEQ ID NO: 423 - DNA, 20 bp, Artificial Sequence
  sgRNA
  mm01919_Anxa2
aaggaaccgacgtccccaag

SEQ ID NO: 424 - DNA, 20 bp, Artificial Sequence
  sgRNA
  mm01920_Anxa2
ttgccttcgcctatcagaga

SEQ ID NO: 425 - DNA, 20 bp, Artificial Sequence
  sgRNA
  mm01937_Calcr
gtgatggcgtggataatggt

SEQ ID NO: 426 - DNA, 20 bp, Artificial Sequence
  sgRNA
  mm01938_Calcr
caaagtccgggaagtagtca

SEQ ID NO: 427 - DNA, 20 bp, Artificial Sequence
  sgRNA
  mm01939_Calcr
cctaccaatctcactgactc

SEQ ID NO: 428 - DNA, 20 bp, Artificial Sequence
  sgRNA
  mm01940_Calcr
acatatgtggacaatgcagt

SEQ ID NO: 429 - DNA, 20 bp, Artificial Sequence
  sgRNA
  mm01957_Calr
tgagcagaatatcgactgtg

SEQ ID NO: 430 - DNA, 20 bp, Artificial Sequence
  sgRNA
  mm01958_Calr
caagaatgtgctgatcaaca

SEQ ID NO: 431 - DNA, 20 bp, Artificial Sequence
  sgRNA
  mm01959_Calr
tatgtttggattcgacccag

SEQ ID NO: 432 - DNA, 20 bp, Artificial Sequence
  sgRNA
  mm01960_Calr
gcggccagacaacacctatg

SEQ ID NO: 433 - DNA, 20 bp, Artificial Sequence
  sgRNA
  mm01965_Calu
gaaggggcacgacctcaatg

SEQ ID NO: 434 - DNA, 20 bp, Artificial Sequence
  sgRNA
  mm01966_Calu
cctacctaaaacgtagccgt

SEQ ID NO: 435 - DNA, 20 bp, Artificial Sequence
  sgRNA
  mm01967_Calu
tgaactttatcgctgagctg

SEQ ID NO: 436 - DNA, 20 bp, Artificial Sequence
  sgRNA
  mm01968_Calu
aagtaaaatagatgacgaca

SEQ ID NO: 437 - DNA, 20 bp, Artificial Sequence
  sgRNA
  mm02017_Capn5
agcttgatatgatccgtctg

SEQ ID NO: 438 - DNA, 20 bp, Artificial Sequence
  sgRNA
  mm02018_Capn5
cctgagcatccataagacat

SEQ ID NO: 439 - DNA, 20 bp, Artificial Sequence
  sgRNA
  mm02019_Capn5
tttactataagggcacccca

SEQ ID NO: 440 - DNA, 20 bp, Artificial Sequence
  sgRNA
  mm02020_Capn5
atgagctggttgttgactgt

SEQ ID NO: 441 - DNA, 20 bp, Artificial Sequence
  sgRNA
  mm02061_Car4
ctgtacagcctcgtaccggg

SEQ ID NO: 442 - DNA, 20 bp, Artificial Sequence
  sgRNA
  mm02062_Car4
gaagttgacatctagcaagg

SEQ ID NO: 443 - DNA, 20 bp, Artificial Sequence
  sgRNA
  mm02063_Car4
tcacggggtttggagatact

SEQ ID NO: 444 - DNA, 20 bp, Artificial Sequence
  sgRNA
  mm02064_Car4
gaggataccttcagtagagg

SEQ ID NO: 445 - DNA, 20 bp, Artificial Sequence
  sgRNA
  mm02125_Casr
gataatgtcagccatcgcgg

SEQ ID NO: 446 - DNA, 20 bp, Artificial Sequence
  sgRNA
  mm02126_Casr
cccaacttccttgaacacaa

SEQ ID NO: 447 - DNA, 20 bp, Artificial Sequence
  sgRNA
  mm02127_Casr
agccttcagaccgaacccaa

SEQ ID NO: 448 - DNA, 20 bp, Artificial Sequence
  sgRNA
  mm02128_Casr
ttcctcgtgacttctcacga

SEQ ID NO: 449 - DNA, 20 bp, Artificial Sequence
  sgRNA
  mm02145_Cav1
caagcatctcaacgacgacg

SEQ ID NO: 450 - DNA, 20 bp, Artificial Sequence
  sgRNA
  mm02146_Cav1
atgtgattgcagaaccagaa

SEQ ID NO: 451 - DNA, 20 bp, Artificial Sequence
  sgRNA
  mm02147_Cav1
cgaagatcgtagacaacaag

SEQ ID NO: 452 - DNA, 20 bp, Artificial Sequence
  sgRNA
  mm02148_Cav1
agtgtatgacgcgcacacca

SEQ ID NO: 453 - DNA, 20 bp, Artificial Sequence
  sgRNA
  mm02149_Cav2
gcagatccacactttgtcaa

SEQ ID NO: 454 - DNA, 20 bp, Artificial Sequence
  sgRNA
  mm02150_Cav2
agatgagagttgagctggtg

SEQ ID NO: 455 - DNA, 20 bp, Artificial Sequence
  sgRNA
  mm02151_Cav2
ctgcgtagtcaacgccactg

SEQ ID NO: 456 - DNA, 20 bp, Artificial Sequence
  sgRNA
  mm02152_Cav2
atacccgcaatgaaggccaa

SEQ ID NO: 457 - DNA, 20 bp, Artificial Sequence
  sgRNA
  mm02153_Cav3
ccagcagtgtagacaacagg

SEQ ID NO: 458 - DNA, 20 bp, Artificial Sequence
  sgRNA
  mm02154_Cav3
ccatacaccgtcgaagctgt

SEQ ID NO: 459 - DNA, 20 bp, Artificial Sequence
  sgRNA
  mm02155_Cav3
cgaccccaagaacatcaatg

SEQ ID NO: 460 - DNA, 20 bp, Artificial Sequence
  sgRNA
  mm02156_Cav3
tcactgcaaggagatagact

SEQ ID NO: 461 - DNA, 20 bp, Artificial Sequence
  sgRNA
  mm02201_Serpinh1
tgggtgttacgatgatgcac

SEQ ID NO: 462 - DNA, 20 bp, Artificial Sequence
  sgRNA
  mm02202_Serpinh1
catcgcctgatataggctga

SEQ ID NO: 463 - DNA, 20 bp, Artificial Sequence
  sgRNA
  mm02203_Serpinh1
agactcacgcttaaagaaca

SEQ ID NO: 464 - DNA, 20 bp, Artificial Sequence
  sgRNA
  mm02204_Serpinh1
cggagctgggcccgtacagg

SEQ ID NO: 465 - DNA, 20 bp, Artificial Sequence
  sgRNA
  mm02249_Cckbr
gatggccgcgagatttagag

SEQ ID NO: 466 - DNA, 20 bp, Artificial Sequence
  sgRNA
  mm02250_Cckbr
agccgggtccgaaaccaagg

SEQ ID NO: 467 - DNA, 20 bp, Artificial Sequence
  sgRNA
  mm02251_Cckbr
cgaagatgaatgtgcccatg

SEQ ID NO: 468 - DNA, 20 bp, Artificial Sequence
  sgRNA
  mm02252_Cckbr
cccggttccgcggatacgag

SEQ ID NO: 469 - DNA, 20 bp, Artificial Sequence
  sgRNA
  mm02313_Ccr6
actgatgaaaggcacatatg

SEQ ID NO: 470 - DNA, 20 bp, Artificial Sequence
  sgRNA
  mm02314_Ccr6
tctgagacagacctgtaccg

SEQ ID NO: 471 - DNA, 20 bp, Artificial Sequence
  sgRNA
  mm02315_Ccr6
agaggtcagaaacttcacca

SEQ ID NO: 472 - DNA, 20 bp, Artificial Sequence
  sgRNA
  mm02316_Ccr6
agatttggttgcctggacga

SEQ ID NO: 473 - DNA, 20 bp, Artificial Sequence
  sgRNA
  mm02349_Cd14
aatccgactaggaatccgcg

SEQ ID NO: 474 - DNA, 20 bp, Artificial Sequence
  sgRNA
  mm02350_Cd14
gcagatgtggaattgtacgg

SEQ ID NO: 475 - DNA, 20 bp, Artificial Sequence
  sgRNA
  mm02351_Cd14
ttgcccacgacacgttgcgg

SEQ ID NO: 476 - DNA, 20 bp, Artificial Sequence
  sgRNA
  mm02352_Cd14
tggagggtcgggaacttgag

SEQ ID NO: 477 - DNA, 20 bp, Artificial Sequence
  sgRNA
  mm02353_Cd151
tacctgctgataatagacat

SEQ ID NO: 478 - DNA, 20 bp, Artificial Sequence
  sgRNA
  mm02354_Cd151
taccaccagtcaggccacga

SEQ ID NO: 479 - DNA, 20 bp, Artificial Sequence
  sgRNA
  mm02355_Cd151
agccacggcctacatcttag

SEQ ID NO: 480 - DNA, 20 bp, Artificial Sequence
  sgRNA
  mm02356_Cd151
gactaatgtagtcactcttg

SEQ ID NO: 481 - DNA, 20 bp, Artificial Sequence
  sgRNA
  mm02357_Ctla4
tgtgatggtgaatattcaca

SEQ ID NO: 482 - DNA, 20 bp, Artificial Sequence
  sgRNA
  mm02358_Ctla4
ggactgagagctgttgacac

SEQ ID NO: 483 - DNA, 20 bp, Artificial Sequence
  sgRNA
  mm02359_Ctla4
acaggtgacccaaccttcag

SEQ ID NO: 484 - DNA, 20 bp, Artificial Sequence
  sgRNA
  mm02360_Ctla4
tgcccacaaagtatggcggt

SEQ ID NO: 485 - DNA, 20 bp, Artificial Sequence
  sgRNA
  mm02361_Cd19
gaatgactgaccccgccagg

SEQ ID NO: 486 - DNA, 20 bp, Artificial Sequence
  sgRNA
  mm02362_Cd19
aatgtctcagaccatatggg

SEQ ID NO: 487 - DNA, 20 bp, Artificial Sequence
  sgRNA
  mm02363_Cd19
ggcacctattattgtctccg

SEQ ID NO: 488 - DNA, 20 bp, Artificial Sequence
  sgRNA
  mm02364_Cd19
tttagcccacacatacagct

SEQ ID NO: 489 - DNA, 20 bp, Artificial Sequence
  sgRNA
  mm02365_Cd1d1
ggagaccacggacaaatagg

SEQ ID NO: 490 - DNA, 20 bp, Artificial Sequence
  sgRNA
  mm02366_Cd1d1
ctggtcccgcacagacagcg

SEQ ID NO: 491 - DNA, 20 bp, Artificial Sequence
  sgRNA
  mm02367_Cd1d1
aaatatgtcgtgagattctg

SEQ ID NO: 492 - DNA, 20 bp, Artificial Sequence
  sgRNA
  mm02368_Cd1d1
tggcttcgtgaagctgatgg

SEQ ID NO: 493 - DNA, 20 bp, Artificial Sequence
  sgRNA
  mm02369_Cd2
ccgatgatgagaaacgacag

SEQ ID NO: 494 - DNA, 20 bp, Artificial Sequence
  sgRNA
  mm02370_Cd2
gaacgcaccattcaagtgtg

SEQ ID NO: 495 - DNA, 20 bp, Artificial Sequence
  sgRNA
  mm02371_Cd2
tgatattgatgaggtgcgat

SEQ ID NO: 496 - DNA, 20 bp, Artificial Sequence
  sgRNA
  mm02372_Cd2
agagacaatgagaccatctg

SEQ ID NO: 497 - DNA, 20 bp, Artificial Sequence
  sgRNA
  mm02373_Ms4a1
gttacagtactgtgtagatg

SEQ ID NO: 498 - DNA, 20 bp, Artificial Sequence
  sgRNA
  mm02374_Ms4a1
taccatacactcaaacagat

SEQ ID NO: 499 - DNA, 20 bp, Artificial Sequence
  sgRNA
  mm02375_Ms4a1
cagtcgtagatatcaacata

SEQ ID NO: 500 - DNA, 20 bp, Artificial Sequence
  sgRNA
  mm02376_Ms4a1
ccacacaaagcttcttcatg

SEQ ID NO: 501 - DNA, 20 bp, Artificial Sequence
  sgRNA
  mm02377_Cd22
gtaattcccagcatgccacg

SEQ ID NO: 502 - DNA, 20 bp, Artificial Sequence
  sgRNA
  mm02378_Cd22
cgatacgtgccaatgacagt

SEQ ID NO: 503 - DNA, 20 bp, Artificial Sequence
  sgRNA
  mm02379_Cd22
cagcgcggatctctgatgcg

SEQ ID NO: 504 - DNA, 20 bp, Artificial Sequence
  sgRNA
  mm02380_Cd22
gtacaaaactccactaccca

SEQ ID NO: 505 - DNA, 20 bp, Artificial Sequence
  sgRNA
  mm02381_Cd24a
gaacagggtctcacctgcgt

SEQ ID NO: 506 - DNA, 20 bp, Artificial Sequence
  sgRNA
  mm02382_Cd24a
gcagaaatattctggttacc

SEQ ID NO: 507 - DNA, 20 bp, Artificial Sequence
  sgRNA
  mm02383_Cd24a
gaaacggtgcaacagatgtt

SEQ ID NO: 508 - DNA, 20 bp, Artificial Sequence
  sgRNA
  mm02384_Cd24a
ggtagcgttacttggatttg

SEQ ID NO: 509 - DNA, 20 bp, Artificial Sequence
  sgRNA
  mm02385_Cd28
tcggcattcgagcgaaactg

SEQ ID NO: 510 - DNA, 20 bp, Artificial Sequence
  sgRNA
  mm02386_Cd28
gcttgtggtagatagcaacg

SEQ ID NO: 511 - DNA, 20 bp, Artificial Sequence
  sgRNA
  mm02387_Cd28
caagggcgtgaacagcgacg

SEQ ID NO: 512 - DNA, 20 bp, Artificial Sequence
  sgRNA
  mm02388_Cd28
ttcctacaaccttctcgcaa

SEQ ID NO: 513 - DNA, 20 bp, Artificial Sequence
  sgRNA
  mm02393_Cd33
ctcctgacattataatcccg

SEQ ID NO: 514 - DNA, 20 bp, Artificial Sequence
  sgRNA
  mm02394_Cd33
aggtgtgaacgtcagcacgg

SEQ ID NO: 515 - DNA, 20 bp, Artificial Sequence
  sgRNA
  mm02395_Cd33
gcccgagtcagtgacagtcg

SEQ ID NO: 516 - DNA, 20 bp, Artificial Sequence
  sgRNA
  mm02396_Cd33
ctagtgcagaaggcaacaca

SEQ ID NO: 517 - DNA, 20 bp, Artificial Sequence
  sgRNA
  mm02397_Cd34
tgatgtgtaagcatatggct

SEQ ID NO: 518 - DNA, 20 bp, Artificial Sequence
  sgRNA
  mm02398_Cd34
gctctggaatccgagaagtg

SEQ ID NO: 519 - DNA, 20 bp, Artificial Sequence
  sgRNA
  mm02399_Cd34
tgtcctgatagatcaagtag

SEQ ID NO: 520 - DNA, 20 bp, Artificial Sequence
  sgRNA
  mm02400_Cd34
ctcattggtaggaactgatg

SEQ ID NO: 521 - DNA, 20 bp, Artificial Sequence
  sgRNA
  mm02401_Cd36
aaatataactcaggaccccg

SEQ ID NO: 522 - DNA, 20 bp, Artificial Sequence
  sgRNA
  mm02402_Cd36
ccaaaactgtctgtacacag

SEQ ID NO: 523 - DNA, 20 bp, Artificial Sequence
  sgRNA
  mm02403_Cd36
taggatatggaaccaaactg

SEQ ID NO: 524 - DNA, 20 bp, Artificial Sequence
  sgRNA
  mm02404_Cd36
ttaatcatgtcgcaatagct

SEQ ID NO: 525 - DNA, 20 bp, Artificial Sequence
  sgRNA
  mm02405_Scarb2
atagaacaggccgaaattcg

SEQ ID NO: 526 - DNA, 20 bp, Artificial Sequence
  sgRNA
  mm02406_Scarb2
aaataaaactggatgtacac

SEQ ID NO: 527 - DNA, 20 bp, Artificial Sequence
  sgRNA
  mm02407_Scarb2
aatatgattaacgggacaga

SEQ ID NO: 528 - DNA, 20 bp, Artificial Sequence
  sgRNA
  mm02408_Scarb2
ataatgacacgtaccaacag

SEQ ID NO: 529 - DNA, 20 bp, Artificial Sequence
  sgRNA
  mm02409_Cd37
ccaagtctgcagtggcacga

SEQ ID NO: 530 - DNA, 20 bp, Artificial Sequence
  sgRNA
  mm02410_Cd37
atctccgcgggactggaaca

SEQ ID NO: 531 - DNA, 20 bp, Artificial Sequence
  sgRNA
  mm02411_Cd37
ctgtctcatccggattcgtg

SEQ ID NO: 532 - DNA, 20 bp, Artificial Sequence
  sgRNA
  mm02412_Cd37
tttgccacacagattaccct

SEQ ID NO: 533 - DNA, 20 bp, Artificial Sequence
  sgRNA
  mm02413_Cd38
agcccagatcggtctcggag

SEQ ID NO: 534 - DNA, 20 bp, Artificial Sequence
  sgRNA
  mm02414_Cd38
tcaaaccataccatgtaaca

SEQ ID NO: 535 - DNA, 20 bp, Artificial Sequence
  sgRNA
  mm02415_Cd38
ggaggatctgagtgtagatg

SEQ ID NO: 536 - DNA, 20 bp, Artificial Sequence
  sgRNA
  mm02416_Cd38
catcaatatacttggatcca

SEQ ID NO: 537 - DNA, 20 bp, Artificial Sequence
  sgRNA
  mm02417_Entpd2
gccagcactccactctacct

SEQ ID NO: 538 - DNA, 20 bp, Artificial Sequence
  sgRNA
  mm02418_Entpd2
tggccacttgtagacaaaca

SEQ ID NO: 539 - DNA, 20 bp, Artificial Sequence
  sgRNA
  mm02419_Entpd2
ggacgctgacccatagtgca

SEQ ID NO: 540 - DNA, 20 bp, Artificial Sequence
  sgRNA
  mm02420_Entpd2
gggcaccacggaagtcaaag

SEQ ID NO: 541 - DNA, 20 bp, Artificial Sequence
  sgRNA
  mm02421_Entpd6
ggctggttacctcgacacgt

SEQ ID NO: 542 - DNA, 20 bp, Artificial Sequence
  sgRNA
  mm02422_Entpd6
tctatgttgcctatatcaag

SEQ ID NO: 543 - DNA, 20 bp, Artificial Sequence
  sgRNA
  mm02423_Entpd6
ttagacaggttacctccagg

SEQ ID NO: 544 - DNA, 20 bp, Artificial Sequence
  sgRNA
  mm02424_Entpd6
acaagctgtactcctacagg

SEQ ID NO: 545 - DNA, 20 bp, Artificial Sequence
  sgRNA
  mm02429_Cd3d
ttacacagatatatccctcg

SEQ ID NO: 546 - DNA, 20 bp, Artificial Sequence
  sgRNA
  mm02430_Cd3d
tccatctagatgcatgacgc

SEQ ID NO: 547 - DNA, 20 bp, Artificial Sequence
  sgRNA
  mm02431_Cd3d
aagaataaaacactcaactt

SEQ ID NO: 548 - DNA, 20 bp, Artificial Sequence
  sgRNA
  mm02432_Cd3d
gatacaagtgaccgaatatg

SEQ ID NO: 549 - DNA, 20 bp, Artificial Sequence
  sgRNA
  mm02433_Cd3e
agggcacgtcaactctacac

SEQ ID NO: 550 - DNA, 20 bp, Artificial Sequence
  sgRNA
  mm02434_Cd3e
ttctcggaagtcgaggacag

SEQ ID NO: 551 - DNA, 20 bp, Artificial Sequence
  sgRNA
  mm02435_Cd3e
tacttgtacctgaaagctcg

SEQ ID NO: 552 - DNA, 20 bp, Artificial Sequence
  sgRNA
  mm02436_Cd3e
tcagaagcatgataagcacc

SEQ ID NO: 553 - DNA, 20 bp, Artificial Sequence
  sgRNA
  mm02437_Cd3g
tgacactgatacgtgcctcg

SEQ ID NO: 554 - DNA, 20 bp, Artificial Sequence
  sgRNA
  mm02438_Cd3g
ttctgtaatacacttgcagg

SEQ ID NO: 555 - DNA, 20 bp, Artificial Sequence
  sgRNA
  mm02439_Cd3g
aactgcattgagctaaacat

SEQ ID NO: 556 - DNA, 20 bp, Artificial Sequence
  sgRNA
  mm02440_Cd3g
gtacaagtggatggcagccg

SEQ ID NO: 557 - DNA, 20 bp, Artificial Sequence
  sgRNA
  mm02445_Cd4
tcaaaacgatcaaactgcga

SEQ ID NO: 558 - DNA, 20 bp, Artificial Sequence
  sgRNA
  mm02446_Cd4
tatcacggcctataagagtg

SEQ ID NO: 559 - DNA, 20 bp, Artificial Sequence
  sgRNA
  mm02447_Cd4
actcaccctcaagatacccc

SEQ ID NO: 560 - DNA, 20 bp, Artificial Sequence
  sgRNA
  mm02448_Cd4
ttcttctgggaactctcgca

SEQ ID NO: 561 - DNA, 20 bp, Artificial Sequence
  sgRNA
  mm02449_Cd44
gcaatatgtgtcatagtggg

SEQ ID NO: 562 - DNA, 20 bp, Artificial Sequence
  sgRNA
  mm02450_Cd44
tcatggagaaaattggaccc

SEQ ID NO: 563 - DNA, 20 bp, Artificial Sequence
  sgRNA
  mm02451_Cd44
tctgtgcgggcagaaacccg

SEQ ID NO: 564 - DNA, 20 bp, Artificial Sequence
  sgRNA
  mm02452_Cd44
cagtccgggagatactgtag

SEQ ID NO: 565 - DNA, 20 bp, Artificial Sequence
  sgRNA
  mm02453_Cd48
atacgtttatatggtccaag

SEQ ID NO: 566 - DNA, 20 bp, Artificial Sequence
  sgRNA
  mm02454_Cd48
tcacctgaggctatcgtgtg

SEQ ID NO: 567 - DNA, 20 bp, Artificial Sequence
  sgRNA
  mm02455_Cd48
gaacgagttgaagataaccc

SEQ ID NO: 568 - DNA, 20 bp, Artificial Sequence
  sgRNA
  mm02456_Cd48
ccttgaaatccagttcccaa

SEQ ID NO: 569 - DNA, 20 bp, Artificial Sequence
  sgRNA
  mm02457_Cd5
actgcagagacttacagatg

SEQ ID NO: 570 - DNA, 20 bp, Artificial Sequence
  sgRNA
  mm02458_Cd5
cactgctgcccccgaccagg

SEQ ID NO: 571 - DNA, 20 bp, Artificial Sequence
  sgRNA
  mm02459_Cd5
gtgtgcaaacagctgagatg

SEQ ID NO: 572 - DNA, 20 bp, Artificial Sequence
  sgRNA
  mm02460_Cd5
tgagacacagctcccgttcg

SEQ ID NO: 573 - DNA, 20 bp, Artificial Sequence
  sgRNA
  mm02461_Cd53
gttacggaagagtactccat

SEQ ID NO: 574 - DNA, 20 bp, Artificial Sequence
  sgRNA
  mm02462_Cd53
cattgtgggatccattatca

SEQ ID NO: 575 - DNA, 20 bp, Artificial Sequence
  sgRNA
  mm02463_Cd53
gctgattattctccttgctg

SEQ ID NO: 576 - DNA, 20 bp, Artificial Sequence
  sgRNA
  mm02464_Cd53
aatgactcaccgacataagc

SEQ ID NO: 577 - DNA, 20 bp, Artificial Sequence
  sgRNA
  mm02465_Cd59a
tggaaacaatcagattgtca

SEQ ID NO: 578 - DNA, 20 bp, Artificial Sequence
  sgRNA
  mm02466_Cd59a
aaaccaccggttggaaacag

SEQ ID NO: 579 - DNA, 20 bp, Artificial Sequence
  sgRNA
  mm02467_Cd59a
caggaatgcaagtgtatcaa

SEQ ID NO: 580 - DNA, 20 bp, Artificial Sequence
  sgRNA
  mm02468_Cd59a
tagagacaggaatcctggtc

SEQ ID NO: 581 - DNA, 20 bp, Artificial Sequence
  sgRNA
  mm02469_Cd6
gcagcgccgggaatacgacg

SEQ ID NO: 582 - DNA, 20 bp, Artificial Sequence
  sgRNA
  mm02470_Cd6
gagccaaaggacaatacggt

SEQ ID NO: 583 - DNA, 20 bp, Artificial Sequence
  sgRNA
  mm02471_Cd6
agcagttcacctgatcgcgg

SEQ ID NO: 584 - DNA, 20 bp, Artificial Sequence
  sgRNA
  mm02472_Cd6
aatacctgagcagacaaccc

SEQ ID NO: 585 - DNA, 20 bp, Artificial Sequence
  sgRNA
  mm02473_Cd63
ccccgcactactcacgcaga

SEQ ID NO: 586 - DNA, 20 bp, Artificial Sequence
  sgRNA
  mm02474_Cd63
ccttcctagaataactgctg

SEQ ID NO: 587 - DNA, 20 bp, Artificial Sequence
  sgRNA
  mm02475_Cd63
gacaggaagatggcaaactg

SEQ ID NO: 588 - DNA, 20 bp, Artificial Sequence
  sgRNA
  mm02476_Cd63
attacccatgagactactgc

SEQ ID NO: 589 - DNA, 20 bp, Artificial Sequence
  sgRNA
  mm02481_Cd69
gtgggcaagtacaattgccc

SEQ ID NO: 590 - DNA, 20 bp, Artificial Sequence
  sgRNA
  mm02482_Cd69
caaaatgtatactggtgcca

SEQ ID NO: 591 - DNA, 20 bp, Artificial Sequence
  sgRNA
  mm02483_Cd69
cattcttgcaggtagcaaca

SEQ ID NO: 592 - DNA, 20 bp, Artificial Sequence
  sgRNA
  mm02484_Cd69
atgagtggatttcatacaag

SEQ ID NO: 593 - DNA, 20 bp, Artificial Sequence
  sgRNA
  mm02489_Cd72
gggtaagactacgcacagcg

SEQ ID NO: 594 - DNA, 20 bp, Artificial Sequence
  sgRNA
  mm02490_Cd72
gcatctaaccatctaggaca

SEQ ID NO: 595 - DNA, 20 bp, Artificial Sequence
  sgRNA
  mm02491_Cd72
gtcctgtctgatgttagggg

SEQ ID NO: 596 - DNA, 20 bp, Artificial Sequence
  sgRNA
  mm02492_Cd72
agggagaagataagtcagct

SEQ ID NO: 597 - DNA, 20 bp, Artificial Sequence
  sgRNA
  mm02493_Cd79a
ggaaccctaatatcacatgg

SEQ ID NO: 598 - DNA, 20 bp, Artificial Sequence
  sgRNA
  mm02494_Cd79a
cctactcactgcgcacgcgg

SEQ ID NO: 599 - DNA, 20 bp, Artificial Sequence
  sgRNA
  mm02495_Cd79a
cgaagtaaacaagaaccaca

SEQ ID NO: 600 - DNA, 20 bp, Artificial Sequence
  sgRNA
  mm02496_Cd79a
aggcgtatgacaagaagagg

SEQ ID NO: 601 - DNA, 20 bp, Artificial Sequence
  sgRNA
  mm02497_Cd80
tgaggagagttgtaacggca

SEQ ID NO: 602 - DNA, 20 bp, Artificial Sequence
  sgRNA
  mm02498_Cd80
gaaattgtcgtattgatgcc

SEQ ID NO: 603 - DNA, 20 bp, Artificial Sequence
  sgRNA
  mm02499_Cd80
ctggcaaaaacatgacaaag

SEQ ID NO: 604 - DNA, 20 bp, Artificial Sequence
  sgRNA
  mm02500_Cd80
tgccccggtctgaaaggacc

SEQ ID NO: 605 - DNA, 20 bp, Artificial Sequence
  sgRNA
  mm02505_Cd82
tgccaccagtagccgcgagg

SEQ ID NO: 606 - DNA, 20 bp, Artificial Sequence
  sgRNA
  mm02506_Cd82
ctgtatcggtgctgtcaatg

SEQ ID NO: 607 - DNA, 20 bp, Artificial Sequence
  sgRNA
  mm02507_Cd82
gaagtagaagaggaccccta

SEQ ID NO: 608 - DNA, 20 bp, Artificial Sequence
  sgRNA
  mm02508_Cd82
agggggtgccttacgtagga

SEQ ID NO: 609 - DNA, 20 bp, Artificial Sequence
  sgRNA
  mm02509_Cd83
gggcgctgtgcaaggcaagt

SEQ ID NO: 610 - DNA, 20 bp, Artificial Sequence
  sgRNA
  mm02510_Cd83
acccgcgatggcgatgcggg

SEQ ID NO: 611 - DNA, 20 bp, Artificial Sequence
  sgRNA
  mm02511_Cd83
caagcaaaacagctccttcg

SEQ ID NO: 612 - DNA, 20 bp, Artificial Sequence
  sgRNA
  mm02512_Cd83
cacactctcagtgccactct

SEQ ID NO: 613 - DNA, 20 bp, Artificial Sequence
  sgRNA
  mm02513_Cd84
gaatcccattcattaccacc

SEQ ID NO: 614 - DNA, 20 bp, Artificial Sequence
  sgRNA
  mm02514_Cd84
catagatcagaagtatgacc

SEQ ID NO: 615 - DNA, 20 bp, Artificial Sequence
  sgRNA
  mm02515_Cd84
aggagctggttacctgtaca

SEQ ID NO: 616 - DNA, 20 bp, Artificial Sequence
  sgRNA
  mm02516_Cd84
ataacttacggtagatatga

SEQ ID NO: 617 - DNA, 20 bp, Artificial Sequence
  sgRNA
  mm02517_Cd86
agtgtgaatgccaagtacct

SEQ ID NO: 618 - DNA, 20 bp, Artificial Sequence
  sgRNA
  mm02518_Cd86
ttgacctgcacgtctaagca

SEQ ID NO: 619 - DNA, 20 bp, Artificial Sequence
  sgRNA
  mm02519_Cd86
tctgccgtgcccatttacaa

SEQ ID NO: 620 - DNA, 20 bp, Artificial Sequence
  sgRNA
  mm02520_Cd86
tggaggataattgatcctgt

SEQ ID NO: 621 - DNA, 20 bp, Artificial Sequence
  sgRNA
  mm02521_Cd8a
tgggtgagtcgattatcctg

SEQ ID NO: 622 - DNA, 20 bp, Artificial Sequence
  sgRNA
  mm02522_Cd8a
atcccacaacaagataacgt

SEQ ID NO: 623 - DNA, 20 bp, Artificial Sequence
  sgRNA
  mm02523_Cd8a
gtgttggggtccgtttcgca

SEQ ID NO: 624 - DNA, 20 bp, Artificial Sequence
  sgRNA
  mm02524_Cd8a
ggacgccgaacttggtcaga

SEQ ID NO: 625 - DNA, 20 bp, Artificial Sequence
  sgRNA
  mm02525_Cd8b1
acagggacgaagctgactgt

SEQ ID NO: 626 - DNA, 20 bp, Artificial Sequence
  sgRNA
  mm02526_Cd8b1
tgacttctacttctgcgcga

SEQ ID NO: 627 - DNA, 20 bp, Artificial Sequence
  sgRNA
  mm02527_Cd8b1
gctggttcaaaccaaccata

SEQ ID NO: 628 - DNA, 20 bp, Artificial Sequence
  sgRNA
  mm02528_Cd8b1
ggacgaaggggtctgaatga

SEQ ID NO: 629 - DNA, 20 bp, Artificial Sequence
  sgRNA
  mm02529_Cd9
caatggcgaatatcaccaag

SEQ ID NO: 630 - DNA, 20 bp, Artificial Sequence
  sgRNA
  mm02530_Cd9
aaagccatccatatggcggt

SEQ ID NO: 631 - DNA, 20 bp, Artificial Sequence
  sgRNA
  mm02531_Cd9
cttgtgggtatagccccaga

SEQ ID NO: 632 - DNA, 20 bp, Artificial Sequence
  sgRNA
  mm02532_Cd9
tcttggtctgagagtcgaat

SEQ ID NO: 633 - DNA, 20 bp, Artificial Sequence
  sgRNA
  mm02573_Cdh1
atgatgaaaacgccaacggg

SEQ ID NO: 634 - DNA, 20 bp, Artificial Sequence
  sgRNA
  mm02574_Cdh1
ccctccaaatccgatacctg

SEQ ID NO: 635 - DNA, 20 bp, Artificial Sequence
  sgRNA
  mm02575_Cdh1
ggtggctgagaccttcatca

SEQ ID NO: 636 - DNA, 20 bp, Artificial Sequence
  sgRNA
  mm02576_Cdh1
aaatgccatcattggtcgtg

SEQ ID NO: 637 - DNA, 20 bp, Artificial Sequence
  sgRNA
  mm02577_Cdh11
caccaagacattggaccgag

SEQ ID NO: 638 - DNA, 20 bp, Artificial Sequence
  sgRNA
  mm02578_Cdh11
aggacaaccctatttctcgg

SEQ ID NO: 639 - DNA, 20 bp, Artificial Sequence
  sgRNA
  mm02579_Cdh11
tttgtgatagaagagtacac

SEQ ID NO: 640 - DNA, 20 bp, Artificial Sequence
  sgRNA
  mm02580_Cdh11
ctgtgagagcgatcacccca

SEQ ID NO: 641 - DNA, 20 bp, Artificial Sequence
  sgRNA
  mm02581_Cdh13
ccagcctgccgaattcatcg

SEQ ID NO: 642 - DNA, 20 bp, Artificial Sequence
  sgRNA
  mm02582_Cdh13
gcagagatctcatagtccag

SEQ ID NO: 643 - DNA, 20 bp, Artificial Sequence
  sgRNA
  mm02583_Cdh13
cgctgtcatccgcatcaccg

SEQ ID NO: 644 - DNA, 20 bp, Artificial Sequence
  sgRNA
  mm02584_Cdh13
gcagaactcgtgattgtcgg

SEQ ID NO: 645 - DNA, 20 bp, Artificial Sequence
  sgRNA
  mm02585_Cdh15
ccatcgacaagttcaccggg

SEQ ID NO: 646 - DNA, 20 bp, Artificial Sequence
  sgRNA
  mm02586_Cdh15
gtataatctgaccttgcaag

SEQ ID NO: 647 - DNA, 20 bp, Artificial Sequence
  sgRNA
  mm02587_Cdh15
ctgaggacgagcatagctga

SEQ ID NO: 648 - DNA, 20 bp, Artificial Sequence
  sgRNA
  mm02588_Cdh15
ccttcaaaaagggtgaagca

SEQ ID NO: 649 - DNA, 20 bp, Artificial Sequence
  sgRNA
  mm02593_Cdh17
tcagtacaacttaagtatcg

SEQ ID NO: 650 - DNA, 20 bp, Artificial Sequence
  sgRNA
  mm02594_Cdh17
ctggagacagacatgtcggt

SEQ ID NO: 651 - DNA, 20 bp, Artificial Sequence
  sgRNA
  mm02595_Cdh17
tgtagcttggatgattagga

SEQ ID NO: 652 - DNA, 20 bp, Artificial Sequence
  sgRNA
  mm02596_Cdh17
tacataacatcgttgatttg

SEQ ID NO: 653 - DNA, 20 bp, Artificial Sequence
  sgRNA
  mm02597_Cdh2
ttaccgaaggatgtgcacga

SEQ ID NO: 654 - DNA, 20 bp, Artificial Sequence
  sgRNA
  mm02598_Cdh2
aatgcggcatacagaatcag

SEQ ID NO: 655 - DNA, 20 bp, Artificial Sequence
  sgRNA
  mm02599_Cdh2
tctgttgcatatatcgatcg

SEQ ID NO: 656 - DNA, 20 bp, Artificial Sequence
  sgRNA
  mm02600_Cdh2
gtgtttgaaaggccataagt

SEQ ID NO: 657 - DNA, 20 bp, Artificial Sequence
  sgRNA
  mm02601_Cdh3
atggtgaagactccttcggg

SEQ ID NO: 658 - DNA, 20 bp, Artificial Sequence
  sgRNA
  mm02602_Cdh3
atggtgaacatgaggtcgtg

SEQ ID NO: 659 - DNA, 20 bp, Artificial Sequence
  sgRNA
  mm02603_Cdh3
atcacctcccacgatgtggt

SEQ ID NO: 660 - DNA, 20 bp, Artificial Sequence
  sgRNA
  mm02604_Cdh3
aaactccggagcgttatcgt

SEQ ID NO: 661 - DNA, 20 bp, Artificial Sequence
  sgRNA
  mm02605_Cdh4
ggatatgaacggtaacaagg

SEQ ID NO: 662 - DNA, 20 bp, Artificial Sequence
  sgRNA
  mm02606_Cdh4
cgtctaccgaatcataagtg

SEQ ID NO: 663 - DNA, 20 bp, Artificial Sequence
  sgRNA
  mm02607_Cdh4
caccatcaacagtgaaacag

SEQ ID NO: 664 - DNA, 20 bp, Artificial Sequence
  sgRNA
  mm02608_Cdh4
cttggacttcaaagtcgggg

SEQ ID NO: 665 - DNA, 20 bp, Artificial Sequence
  sgRNA
  mm02609_Cdh5
acagaccccaaacgtaacga

SEQ ID NO: 666 - DNA, 20 bp, Artificial Sequence
  sgRNA
  mm02610_Cdh5
gccaacgaactggattctcg

SEQ ID NO: 667 - DNA, 20 bp, Artificial Sequence
  sgRNA
  mm02611_Cdh5
gcttacattgagtaaagacg

SEQ ID NO: 668 - DNA, 20 bp, Artificial Sequence
  sgRNA
  mm02612_Cdh5
tcggggtcgatgctaacaca

SEQ ID NO: 669 - DNA, 20 bp, Artificial Sequence
  sgRNA
  mm02613_Cdh6
ggatccgattatcagtacgt

SEQ ID NO: 670 - DNA, 20 bp, Artificial Sequence
  sgRNA
  mm02614_Cdh6
caatgagccaatattcacca

SEQ ID NO: 671 - DNA, 20 bp, Artificial Sequence
  sgRNA
  mm02615_Cdh6
ctacatcctacagatacggg

SEQ ID NO: 672 - DNA, 20 bp, Artificial Sequence
  sgRNA
  mm02616_Cdh6
caacatcacagtgatcgcaa

SEQ ID NO: 673 - DNA, 20 bp, Artificial Sequence
  sgRNA
  mm02733_Celsr1
gtacggatcacaccagacgt

SEQ ID NO: 674 - DNA, 20 bp, Artificial Sequence
  sgRNA
  mm02734_Celsr1
gctggtgcagtactacaaca

SEQ ID NO: 675 - DNA, 20 bp, Artificial Sequence
  sgRNA
  mm02735_Celsr1
agtcccggataactgacggg

SEQ ID NO: 676 - DNA, 20 bp, Artificial Sequence
  sgRNA
  mm02736_Celsr1
ctttgctactccaatccgtg

SEQ ID NO: 677 - DNA, 20 bp, Artificial Sequence
  sgRNA
  mm02781_Cftr
gccgtgtgactgacatacgt

SEQ ID NO: 678 - DNA, 20 bp, Artificial Sequence
  sgRNA
  mm02782_Cftr
ttctaactgagaccttacgc

SEQ ID NO: 679 - DNA, 20 bp, Artificial Sequence
  sgRNA
  mm02783_Cftr
gtggcgatcatgttgctgcg

SEQ ID NO: 680 - DNA, 20 bp, Artificial Sequence
  sgRNA
  mm02784_Cftr
tatggagagtaaaatatcgt

SEQ ID NO: 681 - DNA, 20 bp, Artificial Sequence
  sgRNA
  mm02837_Chl1
ttgttagccgcaattatccg

SEQ ID NO: 682 - DNA, 20 bp, Artificial Sequence
  sgRNA
  mm02838_Chl1
tgaagaaaactacgcgacag

SEQ ID NO: 683 - DNA, 20 bp, Artificial Sequence
  sgRNA
  mm02839_Chl1
gtacagccaacaatttgttg

SEQ ID NO: 684 - DNA, 20 bp, Artificial Sequence
  sgRNA
  mm02840_Chl1
tgttgggtagacaatgccat

SEQ ID NO: 685 - DNA, 20 bp, Artificial Sequence
  sgRNA
  mm02861_Chrm4
ccagttcttgtccaacccgg

SEQ ID NO: 686 - DNA, 20 bp, Artificial Sequence
  sgRNA
  mm02862_Chrm4
cattaagaaacctccaccag

SEQ ID NO: 687 - DNA, 20 bp, Artificial Sequence
  sgRNA
  mm02863_Chrm4
tgttcacaagcatcgacccg

SEQ ID NO: 688 - DNA, 20 bp, Artificial Sequence
  sgRNA
  mm02864_Chrm4
ggcctgccatcttagtagtg

SEQ ID NO: 689 - DNA, 20 bp, Artificial Sequence
  sgRNA
  mm02929_Clcn2
tctgtttgacaaccggacgt

SEQ ID NO: 690 - DNA, 20 bp, Artificial Sequence
  sgRNA
  mm02930_Clcn2
gaaatgaaaaccatccttcg

SEQ ID NO: 691 - DNA, 20 bp, Artificial Sequence
  sgRNA
  mm02931_Clcn2
gcctccaggtacaattcggt

SEQ ID NO: 692 - DNA, 20 bp, Artificial Sequence
  sgRNA
  mm02932_Clcn2
tgatgtcctcgactcgcacc

SEQ ID NO: 693 - DNA, 20 bp, Artificial Sequence
  sgRNA
  mm02933_Clcn3
ggttgtaccacaatgcactg

SEQ ID NO: 694 - DNA, 20 bp, Artificial Sequence
  sgRNA
  mm02934_Clcn3
gagaattgtggggatcgctg

SEQ ID NO: 695 - DNA, 20 bp, Artificial Sequence
  sgRNA
  mm02935_Clcn3
agatgacaatttgttagacg

SEQ ID NO: 696 - DNA, 20 bp, Artificial Sequence
  sgRNA
  mm02936_Clcn3
ctaaaaagaactcctccgat

SEQ ID NO: 697 - DNA, 20 bp, Artificial Sequence
  sgRNA
  mm02941_Clcn5
gggcaagtatcctgtcgtcg

SEQ ID NO: 698 - DNA, 20 bp, Artificial Sequence
  sgRNA
  mm02942_Clcn5
taaaagcaaagagtcaacat

SEQ ID NO: 699 - DNA, 20 bp, Artificial Sequence
  sgRNA
  mm02943_Clcn5
aaaagaagggatatgtacag

SEQ ID NO: 700 - DNA, 20 bp, Artificial Sequence
  sgRNA
  mm02944_Clcn5
tgggcatctacagtgccatg

SEQ ID NO: 701 - DNA, 20 bp, Artificial Sequence
  sgRNA
  mm02949_Clcnka
agaacaggtaaacgcaactg

SEQ ID NO: 702 - DNA, 20 bp, Artificial Sequence
  sgRNA
  mm02950_Clcnka
gtcccaaagatggtgaaccg

SEQ ID NO: 703 - DNA, 20 bp, Artificial Sequence
  sgRNA
  mm02951_Clcnka
caaagccgtcggggatactg

SEQ ID NO: 704 - DNA, 20 bp, Artificial Sequence
  sgRNA
  mm02952_Clcnka
atgaaacggcccacaccagg

SEQ ID NO: 705 - DNA, 20 bp, Artificial Sequence
  sgRNA
  mm02985_Tpp1
tgagtttcatcgctatgtag

SEQ ID NO: 706 - DNA, 20 bp, Artificial Sequence
  sgRNA
  mm02986_Tpp1
ttatggtagaaggttacctg

SEQ ID NO: 707 - DNA, 20 bp, Artificial Sequence
  sgRNA
  mm02987_Tpp1
aacctgacagccaaagatgt

SEQ ID NO: 708 - DNA, 20 bp, Artificial Sequence
  sgRNA
  mm02988_Tpp1
gatcgaggccagtctagatg

SEQ ID NO: 709 - DNA, 20 bp, Artificial Sequence
  sgRNA
  mm03001_Clu
agaaatgaggcctcttgtgt

SEQ ID NO: 710 - DNA, 20 bp, Artificial Sequence
  sgRNA
  mm03002_Clu
aacatgttgtggaagctcgg

SEQ ID NO: 711 - DNA, 20 bp, Artificial Sequence
  sgRNA
  mm03003_Clu
ttcctctaaactgttgagca

SEQ ID NO: 712 - DNA, 20 bp, Artificial Sequence
  sgRNA
  mm03004_Clu
agatgaccgcactgtgtgca

SEQ ID NO: 713 - DNA, 20 bp, Artificial Sequence
  sgRNA
  mm03013_Cxcr2
tgtggttgtaatatacgtcc

SEQ ID NO: 714 - DNA, 20 bp, Artificial Sequence
  sgRNA
  mm03014_Cxcr2
gatattctcatacgtgaagg

SEQ ID NO: 715 - DNA, 20 bp, Artificial Sequence
  sgRNA
  mm03015_Cxcr2
tcgtagaattaagatgggca

SEQ ID NO: 716 - DNA, 20 bp, Artificial Sequence
  sgRNA
  mm03016_Cxcr2
caggttcagcaggtagacat

SEQ ID NO: 717 - DNA, 20 bp, Artificial Sequence
  sgRNA
  mm03017_Cxcr3
tgagggctacacgtacccgg

SEQ ID NO: 718 - DNA, 20 bp, Artificial Sequence
  sgRNA
  mm03018_Cxcr3
agttaacaccagcagaacat

SEQ ID NO: 719 - DNA, 20 bp, Artificial Sequence
  sgRNA
  mm03019_Cxcr3
tctgcgtgtactgcagctag

SEQ ID NO: 720 - DNA, 20 bp, Artificial Sequence
  sgRNA
  mm03020_Cxcr3
actggcaatgggtggcattg

SEQ ID NO: 721 - DNA, 20 bp, Artificial Sequence
  sgRNA
  mm03021_Cxcr4
acaggctatcggggtaaagg

SEQ ID NO: 722 - DNA, 20 bp, Artificial Sequence
  sgRNA
  mm03022_Cxcr4
tggtggcgtggacaatagcg

SEQ ID NO: 723 - DNA, 20 bp, Artificial Sequence
  sgRNA
  mm03023_Cxcr4
tcttctggtaacccatgacc

SEQ ID NO: 724 - DNA, 20 bp, Artificial Sequence
  sgRNA
  mm03024_Cxcr4
tggagactatgactccaaca

SEQ ID NO: 725 - DNA, 20 bp, Artificial Sequence
  sgRNA
  mm03025_Ccr1
gaacactagagaatacaggg

SEQ ID NO: 726 - DNA, 20 bp, Artificial Sequence
  sgRNA
  mm03026_Ccr1
acggtgagtgaactcccact

SEQ ID NO: 727 - DNA, 20 bp, Artificial Sequence
  sgRNA
  mm03027_Ccr1
cagattatcatgactaacag

SEQ ID NO: 728 - DNA, 20 bp, Artificial Sequence
  sgRNA
  mm03028_Ccr1
agtaacagttcgggccctca

SEQ ID NO: 729 - DNA, 20 bp, Artificial Sequence
  sgRNA
  mm03029_Ccr9
tggtattgccacatgtacca

SEQ ID NO: 730 - DNA, 20 bp, Artificial Sequence
  sgRNA
  mm03030_Ccr9
tctcatcatgtgcatcagtg

SEQ ID NO: 731 - DNA, 20 bp, Artificial Sequence
  sgRNA
  mm03031_Ccr9
ttgtgcaataccagtagaca

SEQ ID NO: 732 - DNA, 20 bp, Artificial Sequence
  sgRNA
  mm03032_Ccr9
aggccatgaccataaagggg

SEQ ID NO: 733 - DNA, 20 bp, Artificial Sequence
  sgRNA
  mm03041_Ccr2
atcatcgtagtcatacggtg

SEQ ID NO: 734 - DNA, 20 bp, Artificial Sequence
  sgRNA
  mm03042_Ccr2
tacacttgttatcaccccaa

SEQ ID NO: 735 - DNA, 20 bp, Artificial Sequence
  sgRNA
  mm03043_Ccr2
gatgatcaccattacacctg

SEQ ID NO: 736 - DNA, 20 bp, Artificial Sequence
  sgRNA
  mm03044_Ccr2
ccagggagtagagtggaggc

SEQ ID NO: 737 - DNA, 20 bp, Artificial Sequence
  sgRNA
  mm03045_Ccr4
ggagaataccgcgtgcacga

SEQ ID NO: 738 - DNA, 20 bp, Artificial Sequence
  sgRNA
  mm03046_Ccr4
actcggtcaactcgacgacg

SEQ ID NO: 739 - DNA, 20 bp, Artificial Sequence
  sgRNA
  mm03047_Ccr4
caagaggctcaagtccatga

SEQ ID NO: 740 - DNA, 20 bp, Artificial Sequence
  sgRNA
  mm03048_Ccr4
ggaaggtatcaaggcatttg

SEQ ID NO: 741 - DNA, 20 bp, Artificial Sequence
  sgRNA
  mm03049_Ccr5
agtcagaacggtcaactttg

SEQ ID NO: 742 - DNA, 20 bp, Artificial Sequence
  sgRNA
  mm03050_Ccr5
gaataccagggagtagagtg

SEQ ID NO: 743 - DNA, 20 bp, Artificial Sequence
  sgRNA
  mm03051_Ccr5
cagaaatgatactgagtgtg

SEQ ID NO: 744 - DNA, 20 bp, Artificial Sequence
  sgRNA
  mm03052_Ccr5
agtacctatcaattgtcagg

SEQ ID NO: 745 - DNA, 20 bp, Artificial Sequence
  sgRNA
  mm03053_Ccr7
tttggcgtctacctgtgtaa

SEQ ID NO: 746 - DNA, 20 bp, Artificial Sequence
  sgRNA
  mm03054_Ccr7
tgacgtacatctatttcaag

SEQ ID NO: 747 - DNA, 20 bp, Artificial Sequence
  sgRNA
  mm03055_Ccr7
taggaacccaaaaaccatct

SEQ ID NO: 748 - DNA, 20 bp, Artificial Sequence
  sgRNA
  mm03056_Ccr7
agcggtcaatgctgatgcat

SEQ ID NO: 749 - DNA, 20 bp, Artificial Sequence
  sgRNA
  mm03061_Ccr10
gtgaaggccaacgacgctgt

SEQ ID NO: 750 - DNA, 20 bp, Artificial Sequence
  sgRNA
  mm03062_Ccr10
agactgaaaccaagtgcgct

SEQ ID NO: 751 - DNA, 20 bp, Artificial Sequence
  sgRNA
  mm03063_Ccr10
caggctgccatgacgcccag

SEQ ID NO: 752 - DNA, 20 bp, Artificial Sequence
  sgRNA
  mm03064_Ccr10
ccatcagggagacactgggt

SEQ ID NO: 753 - DNA, 20 bp, Artificial Sequence
  sgRNA
  mm03065_Ackr3
acaccaagatgcatacaaca

SEQ ID NO: 754 - DNA, 20 bp, Artificial Sequence
  sgRNA
  mm03066_Ackr3
gcataaccagtggcccatgg

SEQ ID NO: 755 - DNA, 20 bp, Artificial Sequence
  sgRNA
  mm03067_Ackr3
ggtccacgctcatgcaggcg

SEQ ID NO: 756 - DNA, 20 bp, Artificial Sequence
  sgRNA
  mm03068_Ackr3
ccaacaatgagacctactgc

SEQ ID NO: 757 - DNA, 20 bp, Artificial Sequence
  sgRNA
  mm03069_Abcc2
aagaccctgactcatatccg

SEQ ID NO: 758 - DNA, 20 bp, Artificial Sequence
  sgRNA
  mm03070_Abcc2
gcattcggaagaaagaactc

SEQ ID NO: 759 - DNA, 20 bp, Artificial Sequence
  sgRNA
  mm03071_Abcc2
actcggatcttggttacaca

SEQ ID NO: 760 - DNA, 20 bp, Artificial Sequence
  sgRNA
  mm03072_Abcc2
gtttaagacgatcatgacaa

SEQ ID NO: 761 - DNA, 20 bp, Artificial Sequence
  sgRNA
  mm03117_Cnr1
gctggatcatgcgaactgcg

SEQ ID NO: 762 - DNA, 20 bp, Artificial Sequence
  sgRNA
  mm03118_Cnr1
ggcaggagacaactccccgt

SEQ ID NO: 763 - DNA, 20 bp, Artificial Sequence
  sgRNA
  mm03119_Cnr1
tgtacctgtcgatggccgtg

SEQ ID NO: 764 - DNA, 20 bp, Artificial Sequence
  sgRNA
  mm03120_Cnr1
aacgaggacaacatccagtg

SEQ ID NO: 765 - DNA, 20 bp, Artificial Sequence
  sgRNA
  mm03125_Cntfr
agacgctcatactgcacgtg

SEQ ID NO: 766 - DNA, 20 bp, Artificial Sequence
  sgRNA
  mm03126_Cntfr
atactgcgaagcttagaact

SEQ ID NO: 767 - DNA, 20 bp, Artificial Sequence
  sgRNA
  mm03127_Cntfr
aacccacatgtagaaggact

SEQ ID NO: 768 - DNA, 20 bp, Artificial Sequence
  sgRNA
  mm03128_Cntfr
ggccgtagtgttgtgaccca

SEQ ID NO: 769 - DNA, 20 bp, Artificial Sequence
  sgRNA
  mm03129_Cntn1
gatcggtacagtatggtcgg

SEQ ID NO: 770 - DNA, 20 bp, Artificial Sequence
  sgRNA
  mm03130_Cntn1
gtgcacggcgcagacaatcg

SEQ ID NO: 771 - DNA, 20 bp, Artificial Sequence
  sgRNA
  mm03131_Cntn1
tacccttcagtatcacaaag

SEQ ID NO: 772 - DNA, 20 bp, Artificial Sequence
  sgRNA
  mm03132_Cntn1
tgaaggaccacacaaacgtg

SEQ ID NO: 773 - DNA, 20 bp, Artificial Sequence
  sgRNA
  mm03161_Col12a1
gttgtgtatcgccctcaagg

SEQ ID NO: 774 - DNA, 20 bp, Artificial Sequence
  sgRNA
  mm03162_Col12a1
cagaacctctgaataccgtg

SEQ ID NO: 775 - DNA, 20 bp, Artificial Sequence
  sgRNA
  mm03163_Col12a1
gtggcgaacttaccatacaa

SEQ ID NO: 776 - DNA, 20 bp, Artificial Sequence
  sgRNA
  mm03164_Col12a1
caatgttcgtgaccttacag

SEQ ID NO: 777 - DNA, 20 bp, Artificial Sequence
  sgRNA
  mm03181_Col2a1
tgggacagcactctccgaag

SEQ ID NO: 778 - DNA, 20 bp, Artificial Sequence
  sgRNA
  mm03182_Col2a1
acatgagatttactcaccgg

SEQ ID NO: 779 - DNA, 20 bp, Artificial Sequence
  sgRNA
  mm03183_Col2a1
cttcttgtcagggtaaccca

SEQ ID NO: 780 - DNA, 20 bp, Artificial Sequence
  sgRNA
  mm03184_Col2a1
caggctaatagacttacaga

SEQ ID NO: 781 - DNA, 20 bp, Artificial Sequence
  sgRNA
  mm03185_Col3a1
gttagccctgcaattccaag

SEQ ID NO: 782 - DNA, 20 bp, Artificial Sequence
  sgRNA
  mm03186_Col3a1
ggcaagaatggagaacgggg

SEQ ID NO: 783 - DNA, 20 bp, Artificial Sequence
  sgRNA
  mm03187_Col3a1
acatcatatgagtcgaattg

SEQ ID NO: 784 - DNA, 20 bp, Artificial Sequence
  sgRNA
  mm03188_Col3a1
ggactgccgttattcccggg

SEQ ID NO: 785 - DNA, 20 bp, Artificial Sequence
  sgRNA
  mm03209_Col5a1
ttggcgtgcccggattaccg

SEQ ID NO: 786 - DNA, 20 bp, Artificial Sequence
  sgRNA
  mm03210_Col5a1
ggagtgtaatagtcatctgg

SEQ ID NO: 787 - DNA, 20 bp, Artificial Sequence
  sgRNA
  mm03211_Col5a1
ttcaaaccgccactcccagg

SEQ ID NO: 788 - DNA, 20 bp, Artificial Sequence
  sgRNA
  mm03212_Col5a1
tggaattccgatgggcccag

SEQ ID NO: 789 - DNA, 20 bp, Artificial Sequence
  sgRNA
  mm03217_Col6a1
aggcaagcgcggaatcgacg

SEQ ID NO: 790 - DNA, 20 bp, Artificial Sequence
  sgRNA
  mm03218_Col6a1
gtggcaatgatacttagacg

SEQ ID NO: 791 - DNA, 20 bp, Artificial Sequence
  sgRNA
  mm03219_Col6a1
caacgacatttcaccccgtg

SEQ ID NO: 792 - DNA, 20 bp, Artificial Sequence
  sgRNA
  mm03220_Col6a1
tcatacccagggtcgcctcg

SEQ ID NO: 793 - DNA, 20 bp, Artificial Sequence
  sgRNA
  mm03221_Col6a2
tgcagctggctgataaactg

SEQ ID NO: 794 - DNA, 20 bp, Artificial Sequence
  sgRNA
  mm03222_Col6a2
tgcaaccaggaggcccaatg

SEQ ID NO: 795 - DNA, 20 bp, Artificial Sequence
  sgRNA
  mm03223_Col6a2
acctaaacgaacaaggcctg

SEQ ID NO: 796 - DNA, 20 bp, Artificial Sequence
  sgRNA
  mm03224_Col6a2
ggctgtcctgaatcccctcg

SEQ ID NO: 797 - DNA, 20 bp, Artificial Sequence
  sgRNA
  mm03249_Col1a1
actgtcttacagggtaacgt

SEQ ID NO: 798 - DNA, 20 bp, Artificial Sequence
  sgRNA
  mm03250_Col1a1
ggggcaccattgtttcctcg

SEQ ID NO: 799 - DNA, 20 bp, Artificial Sequence
  sgRNA
  mm03251_Col1a1
acacttacacgctcgccagg

SEQ ID NO: 800 - DNA, 20 bp, Artificial Sequence
  sgRNA
  mm03252_Col1a1
gatacttacaacagcgccag

SEQ ID NO: 801 - DNA, 20 bp, Artificial Sequence
  sgRNA
  mm03325_Cp
catataagcatcaattaggg

SEQ ID NO: 802 - DNA, 20 bp, Artificial Sequence
  sgRNA
  mm03326_Cp
gctgtgaggagcgacctggt

SEQ ID NO: 803 - DNA, 20 bp, Artificial Sequence
  sgRNA
  mm03327_Cp
atgaaaagtgtagatcctag

SEQ ID NO: 804 - DNA, 20 bp, Artificial Sequence
  sgRNA
  mm03328_Cp
gctgaacaaataccacacga

SEQ ID NO: 805 - DNA, 20 bp, Artificial Sequence
  sgRNA
  mm03329_Cpa3
gagattccttctcactaact

SEQ ID NO: 806 - DNA, 20 bp, Artificial Sequence
  sgRNA
  mm03330_Cpa3
accatgcctcaatgtctaca

SEQ ID NO: 807 - DNA, 20 bp, Artificial Sequence
  sgRNA
  mm03331_Cpa3
gaacttgacccaaagcattg

SEQ ID NO: 808 - DNA, 20 bp, Artificial Sequence
  sgRNA
  mm03332_Cpa3
gaggtcagtgccaatgcagg

SEQ ID NO: 809 - DNA, 20 bp, Artificial Sequence
  sgRNA
  mm03333_Cpd
gctgggcagcaaatacacgt

SEQ ID NO: 810 - DNA, 20 bp, Artificial Sequence
  sgRNA
  mm03334_Cpd
tggcgcgcactggtatgacg

SEQ ID NO: 811 - DNA, 20 bp, Artificial Sequence
  sgRNA
  mm03335_Cpd
atggagatatctgataaccc

SEQ ID NO: 812 - DNA, 20 bp, Artificial Sequence
  sgRNA
  mm03336_Cpd
tttgaagtaactatcgaact

SEQ ID NO: 813 - DNA, 20 bp, Artificial Sequence
  sgRNA
  mm03337_Cpe
tcatcgtcattcttgcgaca

SEQ ID NO: 814 - DNA, 20 bp, Artificial Sequence
  sgRNA
  mm03338_Cpe
cggctttctcaaagccgtcg

SEQ ID NO: 815 - DNA, 20 bp, Artificial Sequence
  sgRNA
  mm03339_Cpe
tttggaaaattgcgtcatca

SEQ ID NO: 816 - DNA, 20 bp, Artificial Sequence
  sgRNA
  mm03340_Cpe
ctttctggtactcgttacac

SEQ ID NO: 817 - DNA, 20 bp, Artificial Sequence
  sgRNA
  mm03377_Cr2
atgttgaccagtttgttgcg

SEQ ID NO: 818 - DNA, 20 bp, Artificial Sequence
  sgRNA
  mm03378_Cr2
ctatacattgcacccctgag

SEQ ID NO: 819 - DNA, 20 bp, Artificial Sequence
  sgRNA
  mm03379_Cr2
agacggatttctataaacca

SEQ ID NO: 820 - DNA, 20 bp, Artificial Sequence
  sgRNA
  mm03380_Cr2
atgcaatgctcatggcacat

SEQ ID NO: 821 - DNA, 20 bp, Artificial Sequence
  sgRNA
  mm03429_Crhr1
gagctggaccacaaaccacg

SEQ ID NO: 822 - DNA, 20 bp, Artificial Sequence
  sgRNA
  mm03430_Crhr1
ggtggagtacgtgagtacga

SEQ ID NO: 823 - DNA, 20 bp, Artificial Sequence
  sgRNA
  mm03431_Crhr1
ggcactcagaataattcaca

SEQ ID NO: 824 - DNA, 20 bp, Artificial Sequence
  sgRNA
  mm03432_Crhr1
cctgcagtgcaatgcctccg

SEQ ID NO: 825 - DNA, 20 bp, Artificial Sequence
  sgRNA
  mm03449_Crlf1
cggtcaggataacacatgtg

SEQ ID NO: 826 - DNA, 20 bp, Artificial Sequence
  sgRNA
  mm03450_Crlf1
gtgcacgtgagccgcgttgg

SEQ ID NO: 827 - DNA, 20 bp, Artificial Sequence
  sgRNA
  mm03451_Crlf1
gtggaagccaccaatcgcct

SEQ ID NO: 828 - DNA, 20 bp, Artificial Sequence
  sgRNA
  mm03452_Crlf1
atccgccccgaggcaccccg

SEQ ID NO: 829 - DNA, 20 bp, Artificial Sequence
  sgRNA
  mm03489_Cr1l
ttgttgagttcaatgcactg

SEQ ID NO: 830 - DNA, 20 bp, Artificial Sequence
  sgRNA
  mm03490_Cr1l
atgcctgggggtatctcaca

SEQ ID NO: 831 - DNA, 20 bp, Artificial Sequence
  sgRNA
  mm03491_Cr1l
ttaattatacttgtaatcaa

SEQ ID NO: 832 - DNA, 20 bp, Artificial Sequence
  sgRNA
  mm03492_Cr1l
aaggcgctctttaacctggt

SEQ ID NO: 833 - DNA, 20 bp, Artificial Sequence
  sgRNA
  mm03513_Cryab
agtccggtgtcaatccagct

SEQ ID NO: 834 - DNA, 20 bp, Artificial Sequence
  sgRNA
  mm03514_Cryab
ctcttggattaggacgaaca

SEQ ID NO: 835 - DNA, 20 bp, Artificial Sequence
  sgRNA
  mm03515_Cryab
ctccgaagaactggtcgaag

SEQ ID NO: 836 - DNA, 20 bp, Artificial Sequence
  sgRNA
  mm03516_Cryab
ggggacgtgattgaggtcca

SEQ ID NO: 837 - DNA, 20 bp, Artificial Sequence
  sgRNA
  mm03577_Csf1
tttgctaagtgctctagccg

SEQ ID NO: 838 - DNA, 20 bp, Artificial Sequence
  sgRNA
  mm03578_Csf1
tccattccctaaatcaacag

SEQ ID NO: 839 - DNA, 20 bp, Artificial Sequence
  sgRNA
  mm03579_Csf1
gtgccaagcagcgaccaccc

SEQ ID NO: 840 - DNA, 20 bp, Artificial Sequence
  sgRNA
  mm03580_Csf1
ggtgtccattcccaatcatg

SEQ ID NO: 841 - DNA, 20 bp, Artificial Sequence
  sgRNA
  mm03581_Csf1r
gataacgttgaatcccactt

SEQ ID NO: 842 - DNA, 20 bp, Artificial Sequence
  sgRNA
  mm03582_Csf1r
aagatcatcgagagatacga

SEQ ID NO: 843 - DNA, 20 bp, Artificial Sequence
  sgRNA
  mm03583_Csf1r
ttcaagctcggtacaacggt

SEQ ID NO: 844 - DNA, 20 bp, Artificial Sequence
  sgRNA
  mm03584_Csf1r
cggataatgaaccctcgcca

SEQ ID NO: 845 - DNA, 20 bp, Artificial Sequence
  sgRNA
  mm03589_Csf2ra
aggacgcggtgacgtcacgt

SEQ ID NO: 846 - DNA, 20 bp, Artificial Sequence
  sgRNA
  mm03590_Csf2ra
cctacttggtcgtgaccggt

SEQ ID NO: 847 - DNA, 20 bp, Artificial Sequence
  sgRNA
  mm03591_Csf2ra
ctagcgtcactaacccagaa

SEQ ID NO: 848 - DNA, 20 bp, Artificial Sequence
  sgRNA
  mm03592_Csf2ra
tgacatccagcgtgacaccg

SEQ ID NO: 849 - DNA, 20 bp, Artificial Sequence
  sgRNA
  mm03641_Vcan
ggcttgtttggatatcgggg

SEQ ID NO: 850 - DNA, 20 bp, Artificial Sequence
  sgRNA
  mm03642_Vcan
tgttaattatagtagcacgc

SEQ ID NO: 851 - DNA, 20 bp, Artificial Sequence
  sgRNA
  mm03643_Vcan
tttccatggatgttactaag

SEQ ID NO: 852 - DNA, 20 bp, Artificial Sequence
  sgRNA
  mm03644_Vcan
tatgtctagtacagtactcg

SEQ ID NO: 853 - DNA, 20 bp, Artificial Sequence
  sgRNA
  mm03645_Ncan
caccccctcaccgaaccgtg

SEQ ID NO: 854 - DNA, 20 bp, Artificial Sequence
  sgRNA
  mm03646_Ncan
gggagattgtgtcagcagag

SEQ ID NO: 855 - DNA, 20 bp, Artificial Sequence
  sgRNA
  mm03647_Ncan
tgggctgtatcgctgccaag

SEQ ID NO: 856 - DNA, 20 bp, Artificial Sequence
  sgRNA
  mm03648_Ncan
ttggggacaagtgtagagcg

SEQ ID NO: 857 - DNA, 20 bp, Artificial Sequence
  sgRNA
  mm03653_Csrp1
ctgggcggtactcactacac

SEQ ID NO: 858 - DNA, 20 bp, Artificial Sequence
  sgRNA
  mm03654_Csrp1
gcacgctgagcacagacaag

SEQ ID NO: 859 - DNA, 20 bp, Artificial Sequence
  sgRNA
  mm03655_Csrp1
ttctccatgcactgccacgg

SEQ ID NO: 860 - DNA, 20 bp, Artificial Sequence
  sgRNA
  mm03656_Csrp1
tagaccgcctggctacagcg

SEQ ID NO: 861 - DNA, 20 bp, Artificial Sequence
  sgRNA
  mm03673_Cst8
ttgacagatcacagaccgaa

SEQ ID NO: 862 - DNA, 20 bp, Artificial Sequence
  sgRNA
  mm03674_Cst8
ccaaacacactgcttcacat

SEQ ID NO: 863 - DNA, 20 bp, Artificial Sequence
  sgRNA
  mm03675_Cst8
catggagtatcttgtccaca

SEQ ID NO: 864 - DNA, 20 bp, Artificial Sequence
  sgRNA
  mm03676_Cst8
tcagtccaagaatgaagtga

SEQ ID NO: 865 - DNA, 20 bp, Artificial Sequence
  sgRNA
  mm03713_Ctsb
caatggccgagtcaacgtgg

SEQ ID NO: 866 - DNA, 20 bp, Artificial Sequence
  sgRNA
  mm03714_Ctsb
ttgacatggtgctcgcaggg

SEQ ID NO: 867 - DNA, 20 bp, Artificial Sequence
  sgRNA
  mm03715_Ctsb
tcctcaccgaacgcaaccct

SEQ ID NO: 868 - DNA, 20 bp, Artificial Sequence
  sgRNA
  mm03716_Ctsb
tgtagactccacctgaaacc

SEQ ID NO: 869 - DNA, 20 bp, Artificial Sequence
  sgRNA
  mm03717_Ctsc
ctgcaagatacaacctcctg

SEQ ID NO: 870 - DNA, 20 bp, Artificial Sequence
  sgRNA
  mm03718_Ctsc
ggcagtaactgatagctgtg

SEQ ID NO: 871 - DNA, 20 bp, Artificial Sequence
  sgRNA
  mm03719_Ctsc
tcacaaccacaactttgtga

SEQ ID NO: 872 - DNA, 20 bp, Artificial Sequence
  sgRNA
  mm03720_Ctsc
ctgtatttcatcagtcatcg

SEQ ID NO: 873 - DNA, 20 bp, Artificial Sequence
  sgRNA
  mm03721_Ctsd
tatccgtcggactatgacgg

SEQ ID NO: 874 - DNA, 20 bp, Artificial Sequence
  sgRNA
  mm03722_Ctsd
tgactccaagtactaccacg

SEQ ID NO: 875 - DNA, 20 bp, Artificial Sequence
  sgRNA
  mm03723_Ctsd
gactgtgaaacactgcggcg

SEQ ID NO: 876 - DNA, 20 bp, Artificial Sequence
  sgRNA
  mm03724_Ctsd
acgtcctttgacatccacta

SEQ ID NO: 877 - DNA, 20 bp, Artificial Sequence
  sgRNA
  mm03741_Ctsl
ttggggatcttaagcatcag

SEQ ID NO: 878 - DNA, 20 bp, Artificial Sequence
  sgRNA
  mm03742_Ctsl
aatgatccagctacacaacg

SEQ ID NO: 879 - DNA, 20 bp, Artificial Sequence
  sgRNA
  mm03743_Ctsl
caattaccttcgcttcatag

SEQ ID NO: 880 - DNA, 20 bp, Artificial Sequence
  sgRNA
  mm03744_Ctsl
ttagtgcagagtggcaccag

SEQ ID NO: 881 - DNA, 20 bp, Artificial Sequence
  sgRNA
  mm03745_Ctss
gaagaaatcttgtgtcggat

SEQ ID NO: 882 - DNA, 20 bp, Artificial Sequence
  sgRNA
  mm03746_Ctss
caccgtggctttgtagggat

SEQ ID NO: 883 - DNA, 20 bp, Artificial Sequence
  sgRNA
  mm03747_Ctss
gagatcccaatggtagtcca

SEQ ID NO: 884 - DNA, 20 bp, Artificial Sequence
  sgRNA
  mm03748_Ctss
atcgttcatgcccacttggt

SEQ ID NO: 885 - DNA, 20 bp, Artificial Sequence
  sgRNA
  mm03773_Cxadr
gcatcactacacccgaacag

SEQ ID NO: 886 - DNA, 20 bp, Artificial Sequence
  sgRNA
  mm03774_Cxadr
actctcagtcccgaagacca

SEQ ID NO: 887 - DNA, 20 bp, Artificial Sequence
  sgRNA
  mm03775_Cxadr
aactactatccggatctgaa

SEQ ID NO: 888 - DNA, 20 bp, Artificial Sequence
  sgRNA
  mm03776_Cxadr
acgctagcctccaaccgagc

SEQ ID NO: 889 - DNA, 20 bp, Artificial Sequence
  sgRNA
  mm03817_Cyp1a2
caatggcggtctcatccccg

SEQ ID NO: 890 - DNA, 20 bp, Artificial Sequence
  sgRNA
  mm03818_Cyp1a2
gcactaccaagacttcaaca

SEQ ID NO: 891 - DNA, 20 bp, Artificial Sequence
  sgRNA
  mm03819_Cyp1a2
gaacatcgtgaataacagca

SEQ ID NO: 892 - DNA, 20 bp, Artificial Sequence
  sgRNA
  mm03820_Cyp1a2
cttcgaaccagtcagccagg

SEQ ID NO: 893 - DNA, 20 bp, Artificial Sequence
  sgRNA
  mm03977_Cd55
ctcttatacgtatagccagg

SEQ ID NO: 894 - DNA, 20 bp, Artificial Sequence
  sgRNA
  mm03978_Cd55
ctgctgtccccaactgtacg

SEQ ID NO: 895 - DNA, 20 bp, Artificial Sequence
  sgRNA
  mm03979_Cd55
tgtgacagaacagaaagtag

SEQ ID NO: 896 - DNA, 20 bp, Artificial Sequence
  sgRNA
  mm03980_Cd55
cgaaaacaacctccactccc

SEQ ID NO: 897 - DNA, 20 bp, Artificial Sequence
  sgRNA
  mm03985_Dag1
tggttaggttctcccccacg

SEQ ID NO: 898 - DNA, 20 bp, Artificial Sequence
  sgRNA
  mm03986_Dag1
gtctggaatgccaaccacgg

SEQ ID NO: 899 - DNA, 20 bp, Artificial Sequence
  sgRNA
  mm03987_Dag1
gacctcgatagagaacacac

SEQ ID NO: 900 - DNA, 20 bp, Artificial Sequence
  sgRNA
  mm03988_Dag1
ggcgtaggcactatccgcga

SEQ ID NO: 901 - DNA, 20 bp, Artificial Sequence
  sgRNA
  mm04005_Slc6a3
tagatgatgaagatcaaccc

SEQ ID NO: 902 - DNA, 20 bp, Artificial Sequence
  sgRNA
  mm04006_Slc6a3
gctcgtcagggagttaatgg

SEQ ID NO: 903 - DNA, 20 bp, Artificial Sequence
  sgRNA
  mm04007_Slc6a3
cagggagggtgactccacgc

SEQ ID NO: 904 - DNA, 20 bp, Artificial Sequence
  sgRNA
  mm04008_Slc6a3
ttactcaaaatactcagcag

SEQ ID NO: 905 - DNA, 20 bp, Artificial Sequence
  sgRNA
  mm04049_Dcc
gcaaaggataataatcaacg

SEQ ID NO: 906 - DNA, 20 bp, Artificial Sequence
  sgRNA
  mm04050_Dcc
cacctggttacgaggcgagg

SEQ ID NO: 907 - DNA, 20 bp, Artificial Sequence
  sgRNA
  mm04051_Dcc
cacagaaagactacccgcag

SEQ ID NO: 908 - DNA, 20 bp, Artificial Sequence
  sgRNA
  mm04052_Dcc
aacccatgccaacaatacac

SEQ ID NO: 909 - DNA, 20 bp, Artificial Sequence
  sgRNA
  mm04061_Dcn
tagatatcaggggattgtca

SEQ ID NO: 910 - DNA, 20 bp, Artificial Sequence
  sgRNA
  mm04062_Dcn
ttgagggatcgcagttatgt

SEQ ID NO: 911 - DNA, 20 bp, Artificial Sequence
  sgRNA
  mm04063_Dcn
taggtttggacaaagtgccc

SEQ ID NO: 912 - DNA, 20 bp, Artificial Sequence
  sgRNA
  mm04064_Dcn
cctgtctaagaaccaactaa

SEQ ID NO: 913 - DNA, 20 bp, Artificial Sequence
  sgRNA
  mm04193_Dgcr2
gggcagtttgcatgtcacgg

SEQ ID NO: 914 - DNA, 20 bp, Artificial Sequence
  sgRNA
  mm04194_Dgcr2
agaggcccgtccttatggga

SEQ ID NO: 915 - DNA, 20 bp, Artificial Sequence
  sgRNA
  mm04195_Dgcr2
ttcctagggaaatgcccaag

SEQ ID NO: 916 - DNA, 20 bp, Artificial Sequence
  sgRNA
  mm04196_Dgcr2
cggtactgctgacacccctg

SEQ ID NO: 917 - DNA, 20 bp, Artificial Sequence
  sgRNA
  mm04249_Dlk1
cctaacccatgcgagaacga

SEQ ID NO: 918 - DNA, 20 bp, Artificial Sequence
  sgRNA
  mm04250_Dlk1
tatttacccattgatcacgc

SEQ ID NO: 919 - DNA, 20 bp, Artificial Sequence
  sgRNA
  mm04251_Dlk1
cctcgcagaatccatactgg

SEQ ID NO: 920 - DNA, 20 bp, Artificial Sequence
  sgRNA
  mm04252_Dlk1
cacgtgggacccatgaacgg

SEQ ID NO: 921 - DNA, 20 bp, Artificial Sequence
  sgRNA
  mm04297_Dmd
aaggcataactcttgaatcg

SEQ ID NO: 922 - DNA, 20 bp, Artificial Sequence
  sgRNA
  mm04298_Dmd
catggatgaactgatcaatg

SEQ ID NO: 923 - DNA, 20 bp, Artificial Sequence
  sgRNA
  mm04299_Dmd
aggaccgtttgacataaagg

SEQ ID NO: 924 - DNA, 20 bp, Artificial Sequence
  sgRNA
  mm04300_Dmd
agaatgtacaaggaacgaca

SEQ ID NO: 925 - DNA, 20 bp, Artificial Sequence
  sgRNA
  mm04305_Tmc1
tgccgtacggtaaaccccag

SEQ ID NO: 926 - DNA, 20 bp, Artificial Sequence
  sgRNA
  mm04306_Tmc1
tgaaggccaatattaccctg

SEQ ID NO: 927 - DNA, 20 bp, Artificial Sequence
  sgRNA
  mm04307_Tmc1
ttcagcaaataagtcaaaca

SEQ ID NO: 928 - DNA, 20 bp, Artificial Sequence
  sgRNA
  mm04308_Tmc1
tgaagttctcaaaatctcgg

SEQ ID NO: 929 - DNA, 20 bp, Artificial Sequence
  sgRNA
  mm04401_Dpep1
tcacccgtcgatgaccggtg

SEQ ID NO: 930 - DNA, 20 bp, Artificial Sequence
  sgRNA
  mm04402_Dpep1
gacaactggcttgtggacag

SEQ ID NO: 931 - DNA, 20 bp, Artificial Sequence
  sgRNA
  mm04403_Dpep1
agtggccagtctgatcggcg

SEQ ID NO: 932 - DNA, 20 bp, Artificial Sequence
  sgRNA
  mm04404_Dpep1
atgtatgcggaccagaactg

SEQ ID NO: 933 - DNA, 20 bp, Artificial Sequence
  sgRNA
  mm04413_Dpp4
ctacgatgtagagtgtagag

SEQ ID NO: 934 - DNA, 20 bp, Artificial Sequence
  sgRNA
  mm04414_Dpp4
cttggaatacaactacgtga

SEQ ID NO: 935 - DNA, 20 bp, Artificial Sequence
  sgRNA
  mm04415_Dpp4
gtcgatgtgatcctatgact

SEQ ID NO: 936 - DNA, 20 bp, Artificial Sequence
  sgRNA
  mm04416_Dpp4
tagaaggagtattcaatgag

SEQ ID NO: 937 - DNA, 20 bp, Artificial Sequence
  sgRNA
  mm04417_Dpp6
gtgaccaccaatgagcgatg

SEQ ID NO: 938 - DNA, 20 bp, Artificial Sequence
  sgRNA
  mm04418_Dpp6
gcggagcgactgtgacgagg

SEQ ID NO: 939 - DNA, 20 bp, Artificial Sequence
  sgRNA
  mm04419_Dpp6
tttgccttctattaacaccg

SEQ ID NO: 940 - DNA, 20 bp, Artificial Sequence
  sgRNA
  mm04420_Dpp6
ggtgttatgcacagtaacag

SEQ ID NO: 941 - DNA, 20 bp, Artificial Sequence
  sgRNA
  mm04473_Dsc2
tggtgtgatcactaccacgt

SEQ ID NO: 942 - DNA, 20 bp, Artificial Sequence
  sgRNA
  mm04474_Dsc2
gcattggagggatacactcg

SEQ ID NO: 943 - DNA, 20 bp, Artificial Sequence
  sgRNA
  mm04475_Dsc2
tcttacctgcatctaacgca

SEQ ID NO: 944 - DNA, 20 bp, Artificial Sequence
  sgRNA
  mm04476_Dsc2
tcatctcacttacctctact

SEQ ID NO: 945 - DNA, 20 bp, Artificial Sequence
  sgRNA
  mm04489_Dsg2
gtcttcaacagtgataacga

SEQ ID NO: 946 - DNA, 20 bp, Artificial Sequence
  sgRNA
  mm04490_Dsg2
tctgtgtgtcagtctcaatg

SEQ ID NO: 947 - DNA, 20 bp, Artificial Sequence
  sgRNA
  mm04491_Dsg2
gaagtggaaaataacgcacc

SEQ ID NO: 948 - DNA, 20 bp, Artificial Sequence
  sgRNA
  mm04492_Dsg2
tcaaagacgaatatgccgaa

SEQ ID NO: 949 - DNA, 20 bp, Artificial Sequence
  sgRNA
  mm04505_Slc26a2
gagccgacaccatgactccg

SEQ ID NO: 950 - DNA, 20 bp, Artificial Sequence
  sgRNA
  mm04506_Slc26a2
atggccggagagctttccgt

SEQ ID NO: 951 - DNA, 20 bp, Artificial Sequence
  sgRNA
  mm04507_Slc26a2
actgtgccttatgattggtg

SEQ ID NO: 952 - DNA, 20 bp, Artificial Sequence
  sgRNA
  mm04508_Slc26a2
tccaaaatgagaagccaatg

SEQ ID NO: 953 - DNA, 20 bp, Artificial Sequence
  sgRNA
  mm04613_Ecel1
cctgtcctcaccattccgag

SEQ ID NO: 954 - DNA, 20 bp, Artificial Sequence
  sgRNA
  mm04614_Ecel1
cctgtacctagctcaagacg

SEQ ID NO: 955 - DNA, 20 bp, Artificial Sequence
  sgRNA
  mm04615_Ecel1
acctcgcgtcgattccagcg

SEQ ID NO: 956 - DNA, 20 bp, Artificial Sequence
  sgRNA
  mm04616_Ecel1
gcttgtcgtcggggatagcg

SEQ ID NO: 957 - DNA, 20 bp, Artificial Sequence
  sgRNA
  mm04617_Ecm1
caagcttcaaacagtctagg

SEQ ID NO: 958 - DNA, 20 bp, Artificial Sequence
  sgRNA
  mm04618_Ecm1
gccagtcttcctcgtacaca

SEQ ID NO: 959 - DNA, 20 bp, Artificial Sequence
  sgRNA
  mm04619_Ecm1
gtccggtgtgggcaaccccg

SEQ ID NO: 960 - DNA, 20 bp, Artificial Sequence
  sgRNA
  mm04620_Ecm1
gctctggcgtcatctctcgc

SEQ ID NO: 961 - DNA, 20 bp, Artificial Sequence
  sgRNA
  mm04629_Ect2
agcatactcgtacaatacag

SEQ ID NO: 962 - DNA, 20 bp, Artificial Sequence
  sgRNA
  mm04630_Ect2
taggagtgtatattaccttg

SEQ ID NO: 963 - DNA, 20 bp, Artificial Sequence
  sgRNA
  mm04631_Ect2
agaatggatttataaagcgt

SEQ ID NO: 964 - DNA, 20 bp, Artificial Sequence
  sgRNA
  mm04632_Ect2
acttctagaagacttagcac

SEQ ID NO: 965 - DNA, 20 bp, Artificial Sequence
  sgRNA
  mm04641_S1pr1
gtccggcattacaactacac

SEQ ID NO: 966 - DNA, 20 bp, Artificial Sequence
  sgRNA
  mm04642_S1pr1
gcctgctaataggtccgaga

SEQ ID NO: 967 - DNA, 20 bp, Artificial Sequence
  sgRNA
  mm04643_S1pr1
ctgaagatgaaactacacaa

SEQ ID NO: 968 - DNA, 20 bp, Artificial Sequence
  sgRNA
  mm04644_S1pr1
ggcaggtgtgagcttgtaag

SEQ ID NO: 969 - DNA, 20 bp, Artificial Sequence
  sgRNA
  mm04645_S1pr3
gggaacattacgattacgtg

SEQ ID NO: 970 - DNA, 20 bp, Artificial Sequence
  sgRNA
  mm04646_S1pr3
aatcactacggtccgcagaa

SEQ ID NO: 971 - DNA, 20 bp, Artificial Sequence
  sgRNA
  mm04647_S1pr3
gccagcacatcccaatcaga

SEQ ID NO: 972 - DNA, 20 bp, Artificial Sequence
  sgRNA
  mm04648_S1pr3
gcgcgcatacaagatgacga

SEQ ID NO: 973 - DNA, 20 bp, Artificial Sequence
  sgRNA
  mm04649_S1pr4
cagcagcacgttgaccacgt

SEQ ID NO: 974 - DNA, 20 bp, Artificial Sequence
  sgRNA
  mm04650_S1pr4
acatagcccttggagtagag

SEQ ID NO: 975 - DNA, 20 bp, Artificial Sequence
  sgRNA
  mm04651_S1pr4
gattgtagtgcaggacaatg

SEQ ID NO: 976 - DNA, 20 bp, Artificial Sequence
  sgRNA
  mm04652_S1pr4
ctctaaagatggccccgtag

SEQ ID NO: 977 - DNA, 20 bp, Artificial Sequence
  sgRNA
  mm04669_Ednra
ccttggagaccttatctacg

SEQ ID NO: 978 - DNA, 20 bp, Artificial Sequence
  sgRNA
  mm04670_Ednra
gagagcacagaggttcaaga

SEQ ID NO: 979 - DNA, 20 bp, Artificial Sequence
  sgRNA
  mm04671_Ednra
aaggggtgaagtcttccatg

SEQ ID NO: 980 - DNA, 20 bp, Artificial Sequence
  sgRNA
  mm04672_Ednra
cctagcaatggctcaatgca

SEQ ID NO: 981 - DNA, 20 bp, Artificial Sequence
  sgRNA
  mm04673_Ednrb
tcaatatttcgttggcacgg

SEQ ID NO: 982 - DNA, 20 bp, Artificial Sequence
  sgRNA
  mm04674_Ednrb
gtagatgattcttagcagcg

SEQ ID NO: 983 - DNA, 20 bp, Artificial Sequence
  sgRNA
  mm04675_Ednrb
atgattacgtcggactacaa

SEQ ID NO: 984 - DNA, 20 bp, Artificial Sequence
  sgRNA
  mm04676_Ednrb
gtcacttctcgggactaaag

SEQ ID NO: 985 - DNA, 20 bp, Artificial Sequence
  sgRNA
  mm04693_Eef2
gttgtgagctgctatacgag

SEQ ID NO: 986 - DNA, 20 bp, Artificial Sequence
  sgRNA
  mm04694_Eef2
cctacggcgagggcgagagt

SEQ ID NO: 987 - DNA, 20 bp, Artificial Sequence
  sgRNA
  mm04695_Eef2
ccgattgaggacgtgccatg

SEQ ID NO: 988 - DNA, 20 bp, Artificial Sequence
  sgRNA
  mm04696_Eef2
agtcagccaatagcccagat

SEQ ID NO: 989 - DNA, 20 bp, Artificial Sequence
  sgRNA
  mm04705_Efna2
ggttccagtagactgcgtat

SEQ ID NO: 990 - DNA, 20 bp, Artificial Sequence
  sgRNA
  mm04706_Efna2
tatctactgcccacactacg

SEQ ID NO: 991 - DNA, 20 bp, Artificial Sequence
  sgRNA
  mm04707_Efna2
gccgctgcgtgcgcgcaacg

SEQ ID NO: 992 - DNA, 20 bp, Artificial Sequence
  sgRNA
  mm04708_Efna2
tggcggcggctataccgtgg

SEQ ID NO: 993 - DNA, 20 bp, Artificial Sequence
  sgRNA
  mm04709_Efna3
tgttccagtataccgcatgc

SEQ ID NO: 994 - DNA, 20 bp, Artificial Sequence
  sgRNA
  mm04710_Efna3
agtagtattcttggccggca

SEQ ID NO: 995 - DNA, 20 bp, Artificial Sequence
  sgRNA
  mm04711_Efna3
ggccctgagctgttgtagtg

SEQ ID NO: 996 - DNA, 20 bp, Artificial Sequence
  sgRNA
  mm04712_Efna3
ctgtacatggtgaacctgag

SEQ ID NO: 997 - DNA, 20 bp, Artificial Sequence
  sgRNA
  mm04717_Efna5
tgttccagtagacggcgtag

SEQ ID NO: 998 - DNA, 20 bp, Artificial Sequence
  sgRNA
  mm04718_Efna5
ggacagagtcctcatagtga

SEQ ID NO: 999 - DNA, 20 bp, Artificial Sequence
  sgRNA
  mm04719_Efna5
tccgttgtctgggattgcag

SEQ ID NO: 1000 - DNA, 20 bp, Artificial Sequence
  sgRNA
  mm04720_Efna5
tgagcgctacgtcctgtaca

SEQ ID NO: 1001 - DNA, 20 bp, Artificial Sequence
  sgRNA
  mm04721_Efnb1
cacatgtaatgtagtaatcg

SEQ ID NO: 1002 - DNA, 20 bp, Artificial Sequence
  sgRNA
  mm04722_Efnb1
atcgttatgaaggttgggca

SEQ ID NO: 1003 - DNA, 20 bp, Artificial Sequence
  sgRNA
  mm04723_Efnb1
tacagcttgtagtactcgta

SEQ ID NO: 1004 - DNA, 20 bp, Artificial Sequence
  sgRNA
  mm04724_Efnb1
caggttcttggccaacggcg

SEQ ID NO: 1005 - DNA, 20 bp, Artificial Sequence
  sgRNA
  mm04729_Efnb3
ggagggacaccataccaggt

SEQ ID NO: 1006 - DNA, 20 bp, Artificial Sequence
  sgRNA
  mm04730_Efnb3
ggaggcgtgtgcctaaccag

SEQ ID NO: 1007 - DNA, 20 bp, Artificial Sequence
  sgRNA
  mm04731_Efnb3
ggggacaaagtagatctagc

SEQ ID NO: 1008 - DNA, 20 bp, Artificial Sequence
  sgRNA
  mm04732_Efnb3
aattatgtagtaatcgtggt

SEQ ID NO: 1009 - DNA, 20 bp, Artificial Sequence
  sgRNA
  mm04749_Egfr
accagacagtcactctctcg

SEQ ID NO: 1010 - DNA, 20 bp, Artificial Sequence
  sgRNA
  mm04750_Egfr
tgggcctgactactacgaag

SEQ ID NO: 1011 - DNA, 20 bp, Artificial Sequence
  sgRNA
  mm04751_Egfr
catgaataggccaatcccaa

SEQ ID NO: 1012 - DNA, 20 bp, Artificial Sequence
  sgRNA
  mm04752_Egfr
gagaacctagaaataatacg

SEQ ID NO: 1013 - DNA, 20 bp, Artificial Sequence
  sgRNA
  mm04753_Rhbdf1
attcacgtttgcgacgccga

SEQ ID NO: 1014 - DNA, 20 bp, Artificial Sequence
  sgRNA
  mm04754_Rhbdf1
gatgtccacgtacccagatg

SEQ ID NO: 1015 - DNA, 20 bp, Artificial Sequence
  sgRNA
  mm04755_Rhbdf1
caccacctcccctctacgtg

SEQ ID NO: 1016 - DNA, 20 bp, Artificial Sequence
  sgRNA
  mm04756_Rhbdf1
cttcacccacaccgccaacg

SEQ ID NO: 1017 - DNA, 20 bp, Artificial Sequence
  sgRNA
  mm04869_Aimp1
ctggcagaaattcataacgg

SEQ ID NO: 1018 - DNA, 20 bp, Artificial Sequence
  sgRNA
  mm04870_Aimp1
tccagacgcgatgcgtcgat

SEQ ID NO: 1019 - DNA, 20 bp, Artificial Sequence
  sgRNA
  mm04871_Aimp1
tgatgcagattcactgtatg

SEQ ID NO: 1020 - DNA, 20 bp, Artificial Sequence
  sgRNA
  mm04872_Aimp1
tacaaaagagcagatcaaag

SEQ ID NO: 1021 - DNA, 20 bp, Artificial Sequence
  sgRNA
  mm04873_Emb
agtcgttgatcgcttacgtg

SEQ ID NO: 1022 - DNA, 20 bp, Artificial Sequence
  sgRNA
  mm04874_Emb
aagtcacccgtagtctcaag

SEQ ID NO: 1023 - DNA, 20 bp, Artificial Sequence
  sgRNA
  mm04875_Emb
acaccttaaccagtcagtac

SEQ ID NO: 1024 - DNA, 20 bp, Artificial Sequence
  sgRNA
  mm04876_Emb
ttaaattggacttggtacat

SEQ ID NO: 1025 - DNA, 20 bp, Artificial Sequence
  sgRNA
  mm04885_Emp1
atgcataccttcattgccgt

SEQ ID NO: 1026 - DNA, 20 bp, Artificial Sequence
  sgRNA
  mm04886_Emp1
attacgcaaatgcatctgta

SEQ ID NO: 1027 - DNA, 20 bp, Artificial Sequence
  sgRNA
  mm04887_Emp1
atactcacagcacaccagca

SEQ ID NO: 1028 - DNA, 20 bp, Artificial Sequence
  sgRNA
  mm04888_Emp1
gcataatggcagtggcaatg

SEQ ID NO: 1029 - DNA, 20 bp, Artificial Sequence
  sgRNA
  mm04889_Emp2
ggagtgccgtggacacgatg

SEQ ID NO: 1030 - DNA, 20 bp, Artificial Sequence
  sgRNA
  mm04890_Emp2
aggttattctgtgatgcagg

SEQ ID NO: 1031 - DNA, 20 bp, Artificial Sequence
  sgRNA
  mm04891_Emp2
acaggaacttacattgtcaa

SEQ ID NO: 1032 - DNA, 20 bp, Artificial Sequence
  sgRNA
  mm04892_Emp2
tgagctggatgatggacgtc

SEQ ID NO: 1033 - DNA, 20 bp, Artificial Sequence
  sgRNA
  mm04897_Adgre1
acccaagatccattacaatg

SEQ ID NO: 1034 - DNA, 20 bp, Artificial Sequence
  sgRNA
  mm04898_Adgre1
ttggcaaagagaatccagct

SEQ ID NO: 1035 - DNA, 20 bp, Artificial Sequence
  sgRNA
  mm04899_Adgre1
tattactgcacctgtaaacg

SEQ ID NO: 1036 - DNA, 20 bp, Artificial Sequence
  sgRNA
  mm04900_Adgre1
aaggaggagacatccactct

SEQ ID NO: 1037 - DNA, 20 bp, Artificial Sequence
  sgRNA
  mm04933_Eng
tcagggacatgagtagcacg

SEQ ID NO: 1038 - DNA, 20 bp, Artificial Sequence
  sgRNA
  mm04934_Eng
caagtgcaatgggatttccg

SEQ ID NO: 1039 - DNA, 20 bp, Artificial Sequence
  sgRNA
  mm04935_Eng
cacaccccaaggcctgatag

SEQ ID NO: 1040 - DNA, 20 bp, Artificial Sequence
  sgRNA
  mm04936_Eng
gtggttgatgtcgatgaacc

SEQ ID NO: 1041 - DNA, 20 bp, Artificial Sequence
  sgRNA
  mm04937_Eno2
gccatcgcggtaaaactcag

SEQ ID NO: 1042 - DNA, 20 bp, Artificial Sequence
  sgRNA
  mm04938_Eno2
ggtgtaccacaccctcaagg

SEQ ID NO: 1043 - DNA, 20 bp, Artificial Sequence
  sgRNA
  mm04939_Eno2
tccttcccgatacatcactg

SEQ ID NO: 1044 - DNA, 20 bp, Artificial Sequence
  sgRNA
  mm04940_Eno2
aaacagcgttacttaggcaa

SEQ ID NO: 1045 - DNA, 20 bp, Artificial Sequence
  sgRNA
  mm04945_Enpep
tagatgaggccgatagtagg

SEQ ID NO: 1046 - DNA, 20 bp, Artificial Sequence
  sgRNA
  mm04946_Enpep
gggagtcgtcctcttgcacg

SEQ ID NO: 1047 - DNA, 20 bp, Artificial Sequence
  sgRNA
  mm04947_Enpep
tgttgggttcgtcgaaacaa

SEQ ID NO: 1048 - DNA, 20 bp, Artificial Sequence
  sgRNA
  mm04948_Enpep
gggagcaggtaccaattcga

SEQ ID NO: 1049 - DNA, 20 bp, Artificial Sequence
  sgRNA
  mm04989_Epha1
ccatgatatcagatacagcg

SEQ ID NO: 1050 - DNA, 20 bp, Artificial Sequence
  sgRNA
  mm04990_Epha1
gctgtggctaaaaccctatg

SEQ ID NO: 1051 - DNA, 20 bp, Artificial Sequence
  sgRNA
  mm04991_Epha1
aagctaagtagaggccacgg

SEQ ID NO: 1052 - DNA, 20 bp, Artificial Sequence
  sgRNA
  mm04992_Epha1
agaatggcaccagatggtgt

SEQ ID NO: 1053 - DNA, 20 bp, Artificial Sequence
  sgRNA
  mm04993_Epha2
cttcttgtagtagacgcgaa

SEQ ID NO: 1054 - DNA, 20 bp, Artificial Sequence
  sgRNA
  mm04994_Epha2
cgagatccacccatcctgtg

SEQ ID NO: 1055 - DNA, 20 bp, Artificial Sequence
  sgRNA
  mm04995_Epha2
cgtgtgcaagacatggacag

SEQ ID NO: 1056 - DNA, 20 bp, Artificial Sequence
  sgRNA
  mm04996_Epha2
tgtttggttaatactgacgc

SEQ ID NO: 1057 - DNA, 20 bp, Artificial Sequence
  sgRNA
  mm04997_Epha3
actccagtccaggataaccg

SEQ ID NO: 1058 - DNA, 20 bp, Artificial Sequence
  sgRNA
  mm04998_Epha3
agcagttcatgagttcgcga

SEQ ID NO: 1059 - DNA, 20 bp, Artificial Sequence
  sgRNA
  mm04999_Epha3
acagccaaaataattggctg

SEQ ID NO: 1060 - DNA, 20 bp, Artificial Sequence
  sgRNA
  mm05000_Epha3
ctgactgcggcatactgtct

SEQ ID NO: 1061 - DNA, 20 bp, Artificial Sequence
  sgRNA
  mm05001_Epha4
tgactggatcacccgcgaag

SEQ ID NO: 1062 - DNA, 20 bp, Artificial Sequence
  sgRNA
  mm05002_Epha4
aaactgggctagatttcgaa

SEQ ID NO: 1063 - DNA, 20 bp, Artificial Sequence
  sgRNA
  mm05003_Epha4
tcaggacatttcttacaacg

SEQ ID NO: 1064 - DNA, 20 bp, Artificial Sequence
  sgRNA
  mm05004_Epha4
tgacaaccaaccaagcaggt

SEQ ID NO: 1065 - DNA, 20 bp, Artificial Sequence
  sgRNA
  mm05017_Ephb2
agcaggtgatcggagcaggt

SEQ ID NO: 1066 - DNA, 20 bp, Artificial Sequence
  sgRNA
  mm05018_Ephb2
catcaaactctactgtaacg

SEQ ID NO: 1067 - DNA, 20 bp, Artificial Sequence
  sgRNA
  mm05019_Ephb2
ttgtgcaaggcatgtctaag

SEQ ID NO: 1068 - DNA, 20 bp, Artificial Sequence
  sgRNA
  mm05020_Ephb2
aggtcactgatgtagatgcg

SEQ ID NO: 1069 - DNA, 20 bp, Artificial Sequence
  sgRNA
  mm05021_Ephb3
acaacgtagagtttgtacct

SEQ ID NO: 1070 - DNA, 20 bp, Artificial Sequence
  sgRNA
  mm05022_Ephb3
ctaccgtgcagactcagact

SEQ ID NO: 1071 - DNA, 20 bp, Artificial Sequence
  sgRNA
  mm05023_Ephb3
tgtgtcctgtgtcaagatcg

SEQ ID NO: 1072 - DNA, 20 bp, Artificial Sequence
  sgRNA
  mm05024_Ephb3
cccggacctgaactacgtag

SEQ ID NO: 1073 - DNA, 20 bp, Artificial Sequence
  sgRNA
  mm05025_Ephb4
ggcagcgtacagcataagtg

SEQ ID NO: 1074 - DNA, 20 bp, Artificial Sequence
  sgRNA
  mm05026_Ephb4
ggtaatacccaattcgacac

SEQ ID NO: 1075 - DNA, 20 bp, Artificial Sequence
  sgRNA
  mm05027_Ephb4
acattgacaggctcaaaagg

SEQ ID NO: 1076 - DNA, 20 bp, Artificial Sequence
  sgRNA
  mm05028_Ephb4
agcgtatcgtggcatacacg

SEQ ID NO: 1077 - DNA, 20 bp, Artificial Sequence
  sgRNA
  mm05029_Ephb6
agagtcgagtgttagttggg

SEQ ID NO: 1078 - DNA, 20 bp, Artificial Sequence
  sgRNA
  mm05030_Ephb6
acacactttgtggaacggcg

SEQ ID NO: 1079 - DNA, 20 bp, Artificial Sequence
  sgRNA
  mm05031_Ephb6
agggctcaaccgtgtcacag

SEQ ID NO: 1080 - DNA, 20 bp, Artificial Sequence
  sgRNA
  mm05032_Ephb6
acctcaaaccatagctcccg

SEQ ID NO: 1081 - DNA, 20 bp, Artificial Sequence
  sgRNA
  mm05041_Stx2
cagtggatctgcggatacga

SEQ ID NO: 1082 - DNA, 20 bp, Artificial Sequence
  sgRNA
  mm05042_Stx2
aaaactgctaacaggatccg

SEQ ID NO: 1083 - DNA, 20 bp, Artificial Sequence
  sgRNA
  mm05043_Stx2
tatcagattcacaaatcact

SEQ ID NO: 1084 - DNA, 20 bp, Artificial Sequence
  sgRNA
  mm05044_Stx2
gtcattaaatacccacctga

SEQ ID NO: 1085 - DNA, 20 bp, Artificial Sequence
  sgRNA
  mm05057_Epo
gaggctacgtagaccactga

SEQ ID NO: 1086 - DNA, 20 bp, Artificial Sequence
  sgRNA
  mm05058_Epo
tgaggcgtgggggagcacag

SEQ ID NO: 1087 - DNA, 20 bp, Artificial Sequence
  sgRNA
  mm05059_Epo
gcgacagtcgagttctggag

SEQ ID NO: 1088 - DNA, 20 bp, Artificial Sequence
  sgRNA
  mm05060_Epo
ctatgcttggaaaagaatgg

SEQ ID NO: 1089 - DNA, 20 bp, Artificial Sequence
  sgRNA
  mm05061_Epor
gcgtcactactgaccgctag

SEQ ID NO: 1090 - DNA, 20 bp, Artificial Sequence
  sgRNA
  mm05062_Epor
gtccacttcatatcggatgt

SEQ ID NO: 1091 - DNA, 20 bp, Artificial Sequence
  sgRNA
  mm05063_Epor
agcgtgatggttgtctgtgg

SEQ ID NO: 1092 - DNA, 20 bp, Artificial Sequence
  sgRNA
  mm05064_Epor
tggatgatgcggtgatagcg

SEQ ID NO: 1093 - DNA, 20 bp, Artificial Sequence
  sgRNA
  mm05093_Erbb2
ttggaatcctaatcaaacga

SEQ ID NO: 1094 - DNA, 20 bp, Artificial Sequence
  sgRNA
  mm05094_Erbb2
ctgtcccccgaacaaccaag

SEQ ID NO: 1095 - DNA, 20 bp, Artificial Sequence
  sgRNA
  mm05095_Erbb2
ctgactgcagttgacacact

SEQ ID NO: 1096 - DNA, 20 bp, Artificial Sequence
  sgRNA
  mm05096_Erbb2
tcaatgagtaagcaccactg

SEQ ID NO: 1097 - DNA, 20 bp, Artificial Sequence
  sgRNA
  mm05097_Erbb3
gcccttacctaacctccgag

SEQ ID NO: 1098 - DNA, 20 bp, Artificial Sequence
  sgRNA
  mm05098_Erbb3
tccaacctgacgaccatcgg

SEQ ID NO: 1099 - DNA, 20 bp, Artificial Sequence
  sgRNA
  mm05099_Erbb3
ctagggtatgtattacctcg

SEQ ID NO: 1100 - DNA, 20 bp, Artificial Sequence
  sgRNA
  mm05100_Erbb3
tggactctagcaatatcgat

SEQ ID NO: 1101 - DNA, 20 bp, Artificial Sequence
  sgRNA
  mm05101_Erbb4
atggcagcagtcactaacgt

SEQ ID NO: 1102 - DNA, 20 bp, Artificial Sequence
  sgRNA
  mm05102_Erbb4
gtagagcccttaactcccag

SEQ ID NO: 1103 - DNA, 20 bp, Artificial Sequence
  sgRNA
  mm05103_Erbb4
ttgctgatcctcaaacaaca

SEQ ID NO: 1104 - DNA, 20 bp, Artificial Sequence
  sgRNA
  mm05104_Erbb4
aaagaaatgtacccgcagga

SEQ ID NO: 1105 - DNA, 20 bp, Artificial Sequence
  sgRNA
  mm05205_Mpzl2
tgtggaaatttacacctccg

SEQ ID NO: 1106 - DNA, 20 bp, Artificial Sequence
  sgRNA
  mm05206_Mpzl2
agttagcgcatctcccacag

SEQ ID NO: 1107 - DNA, 20 bp, Artificial Sequence
  sgRNA
  mm05207_Mpzl2
aatttccgacctcgagatgg

SEQ ID NO: 1108 - DNA, 20 bp, Artificial Sequence
  sgRNA
  mm05208_Mpzl2
cggacggttcaaagaccggg

SEQ ID NO: 1109 - DNA, 20 bp, Artificial Sequence
  sgRNA
  mm05285_F2r
gttcccgtaaaacgctgcgg

SEQ ID NO: 1110 - DNA, 20 bp, Artificial Sequence
  sgRNA
  mm05286_F2r
gattccttagaaagaatgag

SEQ ID NO: 1111 - DNA, 20 bp, Artificial Sequence
  sgRNA
  mm05287_F2r
ggttctcactgaggacgtcg

SEQ ID NO: 1112 - DNA, 20 bp, Artificial Sequence
  sgRNA
  mm05288_F2r
agtagtagctgatcttgaag

SEQ ID NO: 1113 - DNA, 20 bp, Artificial Sequence
  sgRNA
  mm05301_F3
gaggtcgcactcggtgtctg

SEQ ID NO: 1114 - DNA, 20 bp, Artificial Sequence
  sgRNA
  mm05302_F3
agatggtagaaaactgaacg

SEQ ID NO: 1115 - DNA, 20 bp, Artificial Sequence
  sgRNA
  mm05303_F3
catgaactgagttcctccgt

SEQ ID NO: 1116 - DNA, 20 bp, Artificial Sequence
  sgRNA
  mm05304_F3
tcggtaaggtaaaaactttg

SEQ ID NO: 1117 - DNA, 20 bp, Artificial Sequence
  sgRNA
  mm05365_Fap
accacctaccctcaccacgt

SEQ ID NO: 1118 - DNA, 20 bp, Artificial Sequence
  sgRNA
  mm05366_Fap
atgcactcgtctgctatggt

SEQ ID NO: 1119 - DNA, 20 bp, Artificial Sequence
  sgRNA
  mm05367_Fap
aatgctattcaaattacaag

SEQ ID NO: 1120 - DNA, 20 bp, Artificial Sequence
  sgRNA
  mm05368_Fap
catagatactgaattggacg

SEQ ID NO: 1121 - DNA, 20 bp, Artificial Sequence
  sgRNA
  mm05369_Fas
cagttaagagttcatactca

SEQ ID NO: 1122 - DNA, 20 bp, Artificial Sequence
  sgRNA
  mm05370_Fas
tatttatatatcgaaagtac

SEQ ID NO: 1123 - DNA, 20 bp, Artificial Sequence
  sgRNA
  mm05371_Fas
catttgcatactcacacgac

SEQ ID NO: 1124 - DNA, 20 bp, Artificial Sequence
  sgRNA
  mm05372_Fas
gaggactgcaaaatgaatgg

SEQ ID NO: 1125 - DNA, 20 bp, Artificial Sequence
  sgRNA
  mm05373_Fasl
aggaccacaacacaaatctg

SEQ ID NO: 1126 - DNA, 20 bp, Artificial Sequence
  sgRNA
  mm05374_Fasl
cttcactccagagatcagag

SEQ ID NO: 1127 - DNA, 20 bp, Artificial Sequence
  sgRNA
  mm05375_Fasl
cctctgaaaaaaaagagccg

SEQ ID NO: 1128 - DNA, 20 bp, Artificial Sequence
  sgRNA
  mm05376_Fasl
ggaactggcagaactccgtg

SEQ ID NO: 1129 - DNA, 20 bp, Artificial Sequence
  sgRNA
  mm05405_Fbln2
gtggcagtgtagatagagtg

SEQ ID NO: 1130 - DNA, 20 bp, Artificial Sequence
  sgRNA
  mm05406_Fbln2
tactacgactgcgtacaagg

SEQ ID NO: 1131 - DNA, 20 bp, Artificial Sequence
  sgRNA
  mm05407_Fbln2
aacgcacataggaagtgtgt

SEQ ID NO: 1132 - DNA, 20 bp, Artificial Sequence
  sgRNA
  mm05408_Fbln2
ctgcacgagagtctgcaccg

SEQ ID NO: 1133 - DNA, 20 bp, Artificial Sequence
  sgRNA
  mm05409_Fbn1
gaatgcagcataatgaacgg

SEQ ID NO: 1134 - DNA, 20 bp, Artificial Sequence
  sgRNA
  mm05410_Fbn1
gcttaccgatgcattcgcca

SEQ ID NO: 1135 - DNA, 20 bp, Artificial Sequence
  sgRNA
  mm05411_Fbn1
agcccatgtcgcattcacag

SEQ ID NO: 1136 - DNA, 20 bp, Artificial Sequence
  sgRNA
  mm05412_Fbn1
gagctgtgtagcagtaacca

SEQ ID NO: 1137 - DNA, 20 bp, Artificial Sequence
  sgRNA
  mm05413_Fbn2
gttgaggttacgaagccacg

SEQ ID NO: 1138 - DNA, 20 bp, Artificial Sequence
  sgRNA
  mm05414_Fbn2
cagacttggtcaccgcaccc

SEQ ID NO: 1139 - DNA, 20 bp, Artificial Sequence
  sgRNA
  mm05415_Fbn2
gagtgtatgataatgaatgg

SEQ ID NO: 1140 - DNA, 20 bp, Artificial Sequence
  sgRNA
  mm05416_Fbn2
aaggtgtgacttgcgaaggt

SEQ ID NO: 1141 - DNA, 20 bp, Artificial Sequence
  sgRNA
  mm05429_Fcer1a
gtgtacttgaatgtaacgca

SEQ ID NO: 1142 - DNA, 20 bp, Artificial Sequence
  sgRNA
  mm05430_Fcer1a
gaagaactggaatgtccgca

SEQ ID NO: 1143 - DNA, 20 bp, Artificial Sequence
  sgRNA
  mm05431_Fcer1a
gtaaatattctaatccatgg

SEQ ID NO: 1144 - DNA, 20 bp, Artificial Sequence
  sgRNA
  mm05432_Fcer1a
agtgccaccgttcaagacag

SEQ ID NO: 1145 - DNA, 20 bp, Artificial Sequence
  sgRNA
  mm05433_Ms4a2
ttgtcagtagcatcgctgca

SEQ ID NO: 1146 - DNA, 20 bp, Artificial Sequence
  sgRNA
  mm05434_Ms4a2
aaagtctgaaacatagagta

SEQ ID NO: 1147 - DNA, 20 bp, Artificial Sequence
  sgRNA
  mm05435_Ms4a2
aaactaggctatccattctg

SEQ ID NO: 1148 - DNA, 20 bp, Artificial Sequence
  sgRNA
  mm05436_Ms4a2
caggcaacacaaattctggt

SEQ ID NO: 1149 - DNA, 20 bp, Artificial Sequence
  sgRNA
  mm05437_Fcer1g
cctactctactgtcgactca

SEQ ID NO: 1150 - DNA, 20 bp, Artificial Sequence
  sgRNA
  mm05438_Fcer1g
actccagatccaggtccgaa

SEQ ID NO: 1151 - DNA, 20 bp, Artificial Sequence
  sgRNA
  mm05439_Fcer1g
tccaggatatagcagagctg

SEQ ID NO: 1152 - DNA, 20 bp, Artificial Sequence
  sgRNA
  mm05440_Fcer1g
tttggtggaacaagcaggta

SEQ ID NO: 1153 - DNA, 20 bp, Artificial Sequence
  sgRNA
  mm05441_Fcer2a
gaacctgaccggactccagg

SEQ ID NO: 1154 - DNA, 20 bp, Artificial Sequence
  sgRNA
  mm05442_Fcer2a
cttccccctagactgggaaa

SEQ ID NO: 1155 - DNA, 20 bp, Artificial Sequence
  sgRNA
  mm05443_Fcer2a
acgtgggacacagctcatgt

SEQ ID NO: 1156 - DNA, 20 bp, Artificial Sequence
  sgRNA
  mm05444_Fcer2a
cgattctctagagaaactcc

SEQ ID NO: 1157 - DNA, 20 bp, Artificial Sequence
  sgRNA
  mm05445_Fcgr1
agagtaccatatagcaaggg

SEQ ID NO: 1158 - DNA, 20 bp, Artificial Sequence
  sgRNA
  mm05446_Fcgr1
tgggatgctataactaggcg

SEQ ID NO: 1159 - DNA, 20 bp, Artificial Sequence
  sgRNA
  mm05447_Fcgr1
tggaaaatactgacccatgg

SEQ ID NO: 1160 - DNA, 20 bp, Artificial Sequence
  sgRNA
  mm05448_Fcgr1
gaataaactggtgtacaatg

SEQ ID NO: 1161 - DNA, 20 bp, Artificial Sequence
  sgRNA
  mm05449_Fcgr2b
aggtcccgacttacttagca

SEQ ID NO: 1162 - DNA, 20 bp, Artificial Sequence
  sgRNA
  mm05450_Fcgr2b
cggtgacactgacatgcgaa

SEQ ID NO: 1163 - DNA, 20 bp, Artificial Sequence
  sgRNA
  mm05451_Fcgr2b
ttccagaaacaccagctgag

SEQ ID NO: 1164 - DNA, 20 bp, Artificial Sequence
  sgRNA
  mm05452_Fcgr2b
actgcaaaggaagtctagga

SEQ ID NO: 1165 - DNA, 20 bp, Artificial Sequence
  sgRNA
  mm05453_Fcgr3
tggtgacactgatgtgcgaa

SEQ ID NO: 1166 - DNA, 20 bp, Artificial Sequence
  sgRNA
  mm05454_Fcgr3
atgcacactctggaagccaa

SEQ ID NO: 1167 - DNA, 20 bp, Artificial Sequence
  sgRNA
  mm05455_Fcgr3
tggtgaaactggacccccca

SEQ ID NO: 1168 - DNA, 20 bp, Artificial Sequence
  sgRNA
  mm05456_Fcgr3
tgctgctccagacccctcag

SEQ ID NO: 1169 - DNA, 20 bp, Artificial Sequence
  sgRNA
  mm05457_Fcgrt
aagaatcggcaattggactg

SEQ ID NO: 1170 - DNA, 20 bp, Artificial Sequence
  sgRNA
  mm05458_Fcgrt
gggcactgaggaattatccg

SEQ ID NO: 1171 - DNA, 20 bp, Artificial Sequence
  sgRNA
  mm05459_Fcgrt
cgtgagatgatacatcagtg

SEQ ID NO: 1172 - DNA, 20 bp, Artificial Sequence
  sgRNA
  mm05460_Fcgrt
aggtggcctagcagtcgctc

SEQ ID NO: 1173 - DNA, 20 bp, Artificial Sequence
  sgRNA
  mm05465_Fcnb
ccggcattacctaccctggg

SEQ ID NO: 1174 - DNA, 20 bp, Artificial Sequence
  sgRNA
  mm05466_Fcnb
gggactggacctcatacaag

SEQ ID NO: 1175 - DNA, 20 bp, Artificial Sequence
  sgRNA
  mm05467_Fcnb
ctgaaggtcctagatctgga

SEQ ID NO: 1176 - DNA, 20 bp, Artificial Sequence
  sgRNA
  mm05468_Fcnb
atgtcacacagcacagtcag

SEQ ID NO: 1177 - DNA, 20 bp, Artificial Sequence
  sgRNA
  mm05513_Fgf10
tttctcacgattgagaagaa

SEQ ID NO: 1178 - DNA, 20 bp, Artificial Sequence
  sgRNA
  mm05514_Fgf10
tgtcctggagataacatcag

SEQ ID NO: 1179 - DNA, 20 bp, Artificial Sequence
  sgRNA
  mm05515_Fgf10
ccagtgcgggaaggcatgtg

SEQ ID NO: 1180 - DNA, 20 bp, Artificial Sequence
  sgRNA
  mm05516_Fgf10
aggagaacagccttctccag

SEQ ID NO: 1181 - DNA, 20 bp, Artificial Sequence
  sgRNA
  mm05537_Fgf17
ctctgctgtcaaacacaggt

SEQ ID NO: 1182 - DNA, 20 bp, Artificial Sequence
  sgRNA
  mm05538_Fgf17
gtgaataccagctctacagc

SEQ ID NO: 1183 - DNA, 20 bp, Artificial Sequence
  sgRNA
  mm05539_Fgf17
tcgcatctctgccaccgcag

SEQ ID NO: 1184 - DNA, 20 bp, Artificial Sequence
  sgRNA
  mm05540_Fgf17
aaccagtacgtgagggacca

SEQ ID NO: 1185 - DNA, 20 bp, Artificial Sequence
  sgRNA
  mm05565_Fgf8
gggaatgcaccttaccgaag

SEQ ID NO: 1186 - DNA, 20 bp, Artificial Sequence
  sgRNA
  mm05566_Fgf8
atgctgtgtaaaattaggtg

SEQ ID NO: 1187 - DNA, 20 bp, Artificial Sequence
  sgRNA
  mm05567_Fgf8
cgagttcgcggcgcagagac

SEQ ID NO: 1188 - DNA, 20 bp, Artificial Sequence
  sgRNA
  mm05568_Fgf8
agagctggtaggtccggatg

SEQ ID NO: 1189 - DNA, 20 bp, Artificial Sequence
  sgRNA
  mm05573_Fgfbp1
ctggtgaaccccaacgcacg

SEQ ID NO: 1190 - DNA, 20 bp, Artificial Sequence
  sgRNA
  mm05574_Fgfbp1
ttctgggccttccctaacga

SEQ ID NO: 1191 - DNA, 20 bp, Artificial Sequence
  sgRNA
  mm05575_Fgfbp1
acatctaaatctctgacgca

SEQ ID NO: 1192 - DNA, 20 bp, Artificial Sequence
  sgRNA
  mm05576_Fgfbp1
aacacaagaaaactcctgat

SEQ ID NO: 1193 - DNA, 20 bp, Artificial Sequence
  sgRNA
  mm05577_Fgfr1
tggagttaataccaccgaca

SEQ ID NO: 1194 - DNA, 20 bp, Artificial Sequence
  sgRNA
  mm05578_Fgfr1
gcatcgtggagaatgagtat

SEQ ID NO: 1195 - DNA, 20 bp, Artificial Sequence
  sgRNA
  mm05579_Fgfr1
tctccgagatcagatccgac

SEQ ID NO: 1196 - DNA, 20 bp, Artificial Sequence
  sgRNA
  mm05580_Fgfr1
tctcgtggcagctcccagcg

SEQ ID NO: 1197 - DNA, 20 bp, Artificial Sequence
  sgRNA
  mm05581_Fgfr2
caactctagcgattccccgg

SEQ ID NO: 1198 - DNA, 20 bp, Artificial Sequence
  sgRNA
  mm05582_Fgfr2
ggagacccctgctagcatcg

SEQ ID NO: 1199 - DNA, 20 bp, Artificial Sequence
  sgRNA
  mm05583_Fgfr2
ggtgccacacctagagactc

SEQ ID NO: 1200 - DNA, 20 bp, Artificial Sequence
  sgRNA
  mm05584_Fgfr2
ggccgccggtgttaacacca

SEQ ID NO: 1201 - DNA, 20 bp, Artificial Sequence
  sgRNA
  mm05585_Fgfr3
gtatagttgccacgatcgga

SEQ ID NO: 1202 - DNA, 20 bp, Artificial Sequence
  sgRNA
  mm05586_Fgfr3
gaggctggcagcgtgtacgc

SEQ ID NO: 1203 - DNA, 20 bp, Artificial Sequence
  sgRNA
  mm05587_Fgfr3
tgacaaggacctgtcggacc

SEQ ID NO: 1204 - DNA, 20 bp, Artificial Sequence
  sgRNA
  mm05588_Fgfr3
tctgttacctgtcgcttaag

SEQ ID NO: 1205 - DNA, 20 bp, Artificial Sequence
  sgRNA
  mm05637_Smc2
cctcatggaacattgagtgg

SEQ ID NO: 1206 - DNA, 20 bp, Artificial Sequence
  sgRNA
  mm05638_Smc2
atgaagaagctaaattacga

SEQ ID NO: 1207 - DNA, 20 bp, Artificial Sequence
  sgRNA
  mm05639_Smc2
caccaaggaacgctcagctg

SEQ ID NO: 1208 - DNA, 20 bp, Artificial Sequence
  sgRNA
  mm05640_Smc2
tcatgagcttcaaatcccaa

SEQ ID NO: 1209 - DNA, 20 bp, Artificial Sequence
  sgRNA
  mm05673_Fkbp10
gctggatgtccacaacccga

SEQ ID NO: 1210 - DNA, 20 bp, Artificial Sequence
  sgRNA
  mm05674_Fkbp10
gcggcctacgcccacaacga

SEQ ID NO: 1211 - DNA, 20 bp, Artificial Sequence
  sgRNA
  mm05675_Fkbp10
tacaatacctatgtcgggca

SEQ ID NO: 1212 - DNA, 20 bp, Artificial Sequence
  sgRNA
  mm05676_Fkbp10
gaccacgtcaaaatagaggg

SEQ ID NO: 1213 - DNA, 20 bp, Artificial Sequence
  sgRNA
  mm05737_Flt1
agtgatggagtaatcttgag

SEQ ID NO: 1214 - DNA, 20 bp, Artificial Sequence
  sgRNA
  mm05738_Flt1
cctcgtattgagctccgtgg

SEQ ID NO: 1215 - DNA, 20 bp, Artificial Sequence
  sgRNA
  mm05739_Flt1
cttaccatacacatgcacgg

SEQ ID NO: 1216 - DNA, 20 bp, Artificial Sequence
  sgRNA
  mm05740_Flt1
tctattgtaggcaaatcgct

SEQ ID NO: 1217 - DNA, 20 bp, Artificial Sequence
  sgRNA
  mm05741_Flt3
cagtactctaaatatgagtg

SEQ ID NO: 1218 - DNA, 20 bp, Artificial Sequence
  sgRNA
  mm05742_Flt3
cccactttcaggaataactg

SEQ ID NO: 1219 - DNA, 20 bp, Artificial Sequence
  sgRNA
  mm05743_Flt3
tccacgtgcatcggattcgt

SEQ ID NO: 1220 - DNA, 20 bp, Artificial Sequence
  sgRNA
  mm05744_Flt3
ctatgaatatgaccttaagt

SEQ ID NO: 1221 - DNA, 20 bp, Artificial Sequence
  sgRNA
  mm05745_Flt3l
taaagattacccagtcactg

SEQ ID NO: 1222 - DNA, 20 bp, Artificial Sequence
  sgRNA
  mm05746_Flt3l
gctaacctggaaggtacatg

SEQ ID NO: 1223 - DNA, 20 bp, Artificial Sequence
  sgRNA
  mm05747_Flt3l
gcaccgagagaaattctggc

SEQ ID NO: 1224 - DNA, 20 bp, Artificial Sequence
  sgRNA
  mm05748_Flt3l
cagttgctctatccagcgct

SEQ ID NO: 1225 - DNA, 20 bp, Artificial Sequence
  sgRNA
  mm05749_Flt4
agctgtccagactctcgatg

SEQ ID NO: 1226 - DNA, 20 bp, Artificial Sequence
  sgRNA
  mm05750_Flt4
cagtttgaatatcccccgag

SEQ ID NO: 1227 - DNA, 20 bp, Artificial Sequence
  sgRNA
  mm05751_Flt4
ctcacctcttacaaacacat

SEQ ID NO: 1228 - DNA, 20 bp, Artificial Sequence
  sgRNA
  mm05752_Flt4
gggtctacactctcgccctg

SEQ ID NO: 1229 - DNA, 20 bp, Artificial Sequence
  sgRNA
  mm05765_Fmod
gagttataaccaccttcgga

SEQ ID NO: 1230 - DNA, 20 bp, Artificial Sequence
  sgRNA
  mm05766_Fmod
acaatgagatccaggaagtg

SEQ ID NO: 1231 - DNA, 20 bp, Artificial Sequence
  sgRNA
  mm05767_Fmod
ggacccgtgagatctggttg

SEQ ID NO: 1232 - DNA, 20 bp, Artificial Sequence
  sgRNA
  mm05768_Fmod
tgccatgtagagcgacccag

SEQ ID NO: 1233 - DNA, 20 bp, Artificial Sequence
  sgRNA
  mm05773_Fn1
cattccaccttacaacaccg

SEQ ID NO: 1234 - DNA, 20 bp, Artificial Sequence
  sgRNA
  mm05774_Fn1
tgggacgtcctacgtcgtgg

SEQ ID NO: 1235 - DNA, 20 bp, Artificial Sequence
  sgRNA
  mm05775_Fn1
ttatggtggcaattcaaacg

SEQ ID NO: 1236 - DNA, 20 bp, Artificial Sequence
  sgRNA
  mm05776_Fn1
gtgaatcgcagatccgtggg

SEQ ID NO: 1237 - DNA, 20 bp, Artificial Sequence
  sgRNA
  mm05789_Folr1
gacaatttacacgaccaggt

SEQ ID NO: 1238 - DNA, 20 bp, Artificial Sequence
  sgRNA
  mm05790_Folr1
agttcggggaacactcatag

SEQ ID NO: 1239 - DNA, 20 bp, Artificial Sequence
  sgRNA
  mm05791_Folr1
ccagttgaaccggtacaggt

SEQ ID NO: 1240 - DNA, 20 bp, Artificial Sequence
  sgRNA
  mm05792_Folr1
ctccacctactccttacccg

SEQ ID NO: 1241 - DNA, 20 bp, Artificial Sequence
  sgRNA
  mm05793_Folr2
catccatgcaaacgttgagt

SEQ ID NO: 1242 - DNA, 20 bp, Artificial Sequence
  sgRNA
  mm05794_Folr2
ctcccgtctgtacttcaact

SEQ ID NO: 1243 - DNA, 20 bp, Artificial Sequence
  sgRNA
  mm05795_Folr2
aacgctctttacgccaactc

SEQ ID NO: 1244 - DNA, 20 bp, Artificial Sequence
  sgRNA
  mm05796_Folr2
gagagactggcataaaggct

SEQ ID NO: 1245 - DNA, 20 bp, Artificial Sequence
  sgRNA
  mm05857_Fshr
tcttacagatatcggagact

SEQ ID NO: 1246 - DNA, 20 bp, Artificial Sequence
  sgRNA
  mm05858_Fshr
atccatgtgaagacatcatg

SEQ ID NO: 1247 - DNA, 20 bp, Artificial Sequence
  sgRNA
  mm05859_Fshr
aggttacacataaggaaccg

SEQ ID NO: 1248 - DNA, 20 bp, Artificial Sequence
  sgRNA
  mm05860_Fshr
acagttcaatggcgttccgg

SEQ ID NO: 1249 - DNA, 20 bp, Artificial Sequence
  sgRNA
  mm05873_Fstl1
cctggatcttggatccagtg

SEQ ID NO: 1250 - DNA, 20 bp, Artificial Sequence
  sgRNA
  mm05874_Fstl1
accggtcacctacctcgccg

SEQ ID NO: 1251 - DNA, 20 bp, Artificial Sequence
  sgRNA
  mm05875_Fstl1
acctcaatgcagaggcacgt

SEQ ID NO: 1252 - DNA, 20 bp, Artificial Sequence
  sgRNA
  mm05876_Fstl1
ggcgccgtcggagctcatcg

SEQ ID NO: 1253 - DNA, 20 bp, Artificial Sequence
  sgRNA
  mm05901_Fut4
gcgtccacgagtggccaccg

SEQ ID NO: 1254 - DNA, 20 bp, Artificial Sequence
  sgRNA
  mm05902_Fut4
cgcgtgttcgacgaccagga

SEQ ID NO: 1255 - DNA, 20 bp, Artificial Sequence
  sgRNA
  mm05903_Fut4
aatcgccctcccatactcca

SEQ ID NO: 1256 - DNA, 20 bp, Artificial Sequence
  sgRNA
  mm05904_Fut4
gctgttccaccaccgcgacc

SEQ ID NO: 1257 - DNA, 20 bp, Artificial Sequence
  sgRNA
  mm05933_Fzd1
agcccgctagcccaacgccg

SEQ ID NO: 1258 - DNA, 20 bp, Artificial Sequence
  sgRNA
  mm05934_Fzd1
accagtaatccgcagcacgg

SEQ ID NO: 1259 - DNA, 20 bp, Artificial Sequence
  sgRNA
  mm05935_Fzd1
tcacgtacctagtggacatg

SEQ ID NO: 1260 - DNA, 20 bp, Artificial Sequence
  sgRNA
  mm05936_Fzd1
gctgggccacacgaatcagg

SEQ ID NO: 1261 - DNA, 20 bp, Artificial Sequence
  sgRNA
  mm05941_Fzd4
ttggcacataaaccgaacaa

SEQ ID NO: 1262 - DNA, 20 bp, Artificial Sequence
  sgRNA
  mm05942_Fzd4
ggttctggcacatggcgatg

SEQ ID NO: 1263 - DNA, 20 bp, Artificial Sequence
  sgRNA
  mm05943_Fzd4
acatactgagaaatatgatg

SEQ ID NO: 1264 - DNA, 20 bp, Artificial Sequence
  sgRNA
  mm05944_Fzd4
ctggtccttccatgcacatg

SEQ ID NO: 1265 - DNA, 20 bp, Artificial Sequence
  sgRNA
  mm05945_Fzd5
ccagttcaaccatgacacgc

SEQ ID NO: 1266 - DNA, 20 bp, Artificial Sequence
  sgRNA
  mm05946_Fzd5
ggaatcgttccatgtcaatg

SEQ ID NO: 1267 - DNA, 20 bp, Artificial Sequence
  sgRNA
  mm05947_Fzd5
gtcacacccactctacaaca

SEQ ID NO: 1268 - DNA, 20 bp, Artificial Sequence
  sgRNA
  mm05948_Fzd5
gtactgtgcataacctgcga

SEQ ID NO: 1269 - DNA, 20 bp, Artificial Sequence
  sgRNA
  mm05961_Fzd9
cccgcacgcactctgtatgg

SEQ ID NO: 1270 - DNA, 20 bp, Artificial Sequence
  sgRNA
  mm05962_Fzd9
gacctggtcggtgcacattg

SEQ ID NO: 1271 - DNA, 20 bp, Artificial Sequence
  sgRNA
  mm05963_Fzd9
gagtgtggcatgcgaccagg

SEQ ID NO: 1272 - DNA, 20 bp, Artificial Sequence
  sgRNA
  mm05964_Fzd9
tacttccacatggcagcgtg

SEQ ID NO: 1273 - DNA, 20 bp, Artificial Sequence
  sgRNA
  mm05997_Gaa
accatccccactttacagcg

SEQ ID NO: 1274 - DNA, 20 bp, Artificial Sequence
  sgRNA
  mm05998_Gaa
gagttacaggccctacgacg

SEQ ID NO: 1275 - DNA, 20 bp, Artificial Sequence
  sgRNA
  mm05999_Gaa
ctaacctggaggtcaacggg

SEQ ID NO: 1276 - DNA, 20 bp, Artificial Sequence
  sgRNA
  mm06000_Gaa
acctgagctctacagagtcg

SEQ ID NO: 1277 - DNA, 20 bp, Artificial Sequence
  sgRNA
  mm06025_Gabra3
tttgtgaaacaagatattgg

SEQ ID NO: 1278 - DNA, 20 bp, Artificial Sequence
  sgRNA
  mm06026_Gabra3
ccatatcagtgtctgacaca

SEQ ID NO: 1279 - DNA, 20 bp, Artificial Sequence
  sgRNA
  mm06027_Gabra3
ccacaatggtaaaaaatcag

SEQ ID NO: 1280 - DNA, 20 bp, Artificial Sequence
  sgRNA
  mm06028_Gabra3
agtcatgatacatggcaagt

SEQ ID NO: 1281 - DNA, 20 bp, Artificial Sequence
  sgRNA
  mm06033_Gabra6
ggaagttaaccaatctcatg

SEQ ID NO: 1282 - DNA, 20 bp, Artificial Sequence
  sgRNA
  mm06034_Gabra6
gggacttctactgagtaaag

SEQ ID NO: 1283 - DNA, 20 bp, Artificial Sequence
  sgRNA
  mm06035_Gabra6
tctactctgaaaatgtcagt

SEQ ID NO: 1284 - DNA, 20 bp, Artificial Sequence
  sgRNA
  mm06036_Gabra6
ttaagctcagaatctcagca

SEQ ID NO: 1285 - DNA, 20 bp, Artificial Sequence
  sgRNA
  mm06045_Gabrb3
cctcacgcttgacaatcgag

SEQ ID NO: 1286 - DNA, 20 bp, Artificial Sequence
  sgRNA
  mm06046_Gabrb3
cctggtagatggctacacta

SEQ ID NO: 1287 - DNA, 20 bp, Artificial Sequence
  sgRNA
  mm06047_Gabrb3
cgcctgagacccgacttcgg

SEQ ID NO: 1288 - DNA, 20 bp, Artificial Sequence
  sgRNA
  mm06048_Gabrb3
cgaaaactcaatgaaagtcg

SEQ ID NO: 1289 - DNA, 20 bp, Artificial Sequence
  sgRNA
  mm06057_Gabrg1
acttatgctcaacagcaaca

SEQ ID NO: 1290 - DNA, 20 bp, Artificial Sequence
  sgRNA
  mm06058_Gabrg1
cattccgtgtattctaacag

SEQ ID NO: 1291 - DNA, 20 bp, Artificial Sequence
  sgRNA
  mm06059_Gabrg1
tttaactatgaacaaaacat

SEQ ID NO: 1292 - DNA, 20 bp, Artificial Sequence
  sgRNA
  mm06060_Gabrg1
acatctgtttcaatcactgt

SEQ ID NO: 1293 - DNA, 20 bp, Artificial Sequence
  sgRNA
  mm06061_Gabrg2
aacaaacttcgacctgacat

SEQ ID NO: 1294 - DNA, 20 bp, Artificial Sequence
  sgRNA
  mm06062_Gabrg2
ggttgaatagcaatatggtg

SEQ ID NO: 1295 - DNA, 20 bp, Artificial Sequence
  sgRNA
  mm06063_Gabrg2
tcctgctatcgctctaccca

SEQ ID NO: 1296 - DNA, 20 bp, Artificial Sequence
  sgRNA
  mm06064_Gabrg2
tacaactggagaactccagg

SEQ ID NO: 1297 - DNA, 20 bp, Artificial Sequence
  sgRNA
  mm06077_Slc6a12
ctgaatcactcatcggccag

SEQ ID NO: 1298 - DNA, 20 bp, Artificial Sequence
  sgRNA
  mm06078_Slc6a12
tcttgggcctcatgtaggtg

SEQ ID NO: 1299 - DNA, 20 bp, Artificial Sequence
  sgRNA
  mm06079_Slc6a12
gatggagtttgtgctgtcag

SEQ ID NO: 1300 - DNA, 20 bp, Artificial Sequence
  sgRNA
  mm06080_Slc6a12
gggaatacccatttctgaag

SEQ ID NO: 1301 - DNA, 20 bp, Artificial Sequence
  sgRNA
  mm06101_B4galnt1
tctagcagatcgagtctcgg

SEQ ID NO: 1302 - DNA, 20 bp, Artificial Sequence
  sgRNA
  mm06102_B4galnt1
tgaccgtagggtaaaagcgt

SEQ ID NO: 1303 - DNA, 20 bp, Artificial Sequence
  sgRNA
  mm06103_B4galnt1
gttcgcaggtcggaacctgg

SEQ ID NO: 1304 - DNA, 20 bp, Artificial Sequence
  sgRNA
  mm06104_B4galnt1
tgcagttgtgaatccaaggg

SEQ ID NO: 1305 - DNA, 20 bp, Artificial Sequence
  sgRNA
  mm06109_Galnt1
ctagtgcagaaacctcatga

SEQ ID NO: 1306 - DNA, 20 bp, Artificial Sequence
  sgRNA
  mm06110_Galnt1
atagtgacatgctcccatgt

SEQ ID NO: 1307 - DNA, 20 bp, Artificial Sequence
  sgRNA
  mm06111_Galnt1
tgacactttcgagtacatgg

SEQ ID NO: 1308 - DNA, 20 bp, Artificial Sequence
  sgRNA
  mm06112_Galnt1
taaccttcctacaacaagtg

SEQ ID NO: 1309 - DNA, 20 bp, Artificial Sequence
  sgRNA
  mm06141_Gapdh
gctgtggcgtgatggccgtg

SEQ ID NO: 1310 - DNA, 20 bp, Artificial Sequence
  sgRNA
  mm06142_Gapdh
aaacaggcccacttgaaggg

SEQ ID NO: 1311 - DNA, 20 bp, Artificial Sequence
  sgRNA
  mm06143_Gapdh
tgccatttgcagtggcaaag

SEQ ID NO: 1312 - DNA, 20 bp, Artificial Sequence
  sgRNA
  mm06144_Gapdh
ggccggtgctgagtatgtcg

SEQ ID NO: 1313 - DNA, 20 bp, Artificial Sequence
  sgRNA
  mm06145_Gapdhs
gccagctagagagctgacag

SEQ ID NO: 1314 - DNA, 20 bp, Artificial Sequence
  sgRNA
  mm06146_Gapdhs
ggttgaggatccaccaccca

SEQ ID NO: 1315 - DNA, 20 bp, Artificial Sequence
  sgRNA
  mm06147_Gapdhs
aacttgtctggctctatctg

SEQ ID NO: 1316 - DNA, 20 bp, Artificial Sequence
  sgRNA
  mm06148_Gapdhs
ctctatagggaatccctacg

SEQ ID NO: 1317 - DNA, 20 bp, Artificial Sequence
  sgRNA
  mm06149_Gart
actcgtagttgtcggaccag

SEQ ID NO: 1318 - DNA, 20 bp, Artificial Sequence
  sgRNA
  mm06150_Gart
tgacggcttcagttgtactg

SEQ ID NO: 1319 - DNA, 20 bp, Artificial Sequence
  sgRNA
  mm06151_Gart
gctagaaaggatcaccgaag

SEQ ID NO: 1320 - DNA, 20 bp, Artificial Sequence
  sgRNA
  mm06152_Gart
ggcaaagtagtgaccagcgg

SEQ ID NO: 1321 - DNA, 20 bp, Artificial Sequence
  sgRNA
  mm06197_Gba
cgttacgagagcactcgacg

SEQ ID NO: 1322 - DNA, 20 bp, Artificial Sequence
  sgRNA
  mm06198_Gba
ggataactggaagtcgttag

SEQ ID NO: 1323 - DNA, 20 bp, Artificial Sequence
  sgRNA
  mm06199_Gba
gactggcaaagagtgaaatg

SEQ ID NO: 1324 - DNA, 20 bp, Artificial Sequence
  sgRNA
  mm06200_Gba
cggagaatgaacctacagca

SEQ ID NO: 1325 - DNA, 20 bp, Artificial Sequence
  sgRNA
  mm06301_Gdf3
cacgtagcataagtcctgcg

SEQ ID NO: 1326 - DNA, 20 bp, Artificial Sequence
  sgRNA
  mm06302_Gdf3
cgcaggttatagtaggacct

SEQ ID NO: 1327 - DNA, 20 bp, Artificial Sequence
  sgRNA
  mm06303_Gdf3
tcaaagaggacagatactcc

SEQ ID NO: 1328 - DNA, 20 bp, Artificial Sequence
  sgRNA
  mm06304_Gdf3
caatctgcccaccttagggt

SEQ ID NO: 1329 - DNA, 20 bp, Artificial Sequence
  sgRNA
  mm06337_Gfap
agagattcgcactcaatacg

SEQ ID NO: 1330 - DNA, 20 bp, Artificial Sequence
  sgRNA
  mm06338_Gfap
tccaagatgaaaccaacctg

SEQ ID NO: 1331 - DNA, 20 bp, Artificial Sequence
  sgRNA
  mm06339_Gfap
tgcgggacgcagcgtctgtg

SEQ ID NO: 1332 - DNA, 20 bp, Artificial Sequence
  sgRNA
  mm06340_Gfap
tctcgatgtagctagcaaag

SEQ ID NO: 1333 - DNA, 20 bp, Artificial Sequence
  sgRNA
  mm06357_Gfra1
gcaccaagtaccgcacactg

SEQ ID NO: 1334 - DNA, 20 bp, Artificial Sequence
  sgRNA
  mm06358_Gfra1
cttaccaatcagtcccgagt

SEQ ID NO: 1335 - DNA, 20 bp, Artificial Sequence
  sgRNA
  mm06359_Gfra1
catatggggaatcttccagt

SEQ ID NO: 1336 - DNA, 20 bp, Artificial Sequence
  sgRNA
  mm06360_Gfra1
tcaaggcctccatagcgctg

SEQ ID NO: 1337 - DNA, 20 bp, Artificial Sequence
  sgRNA
  mm06361_Gfra2
atgcctggtagttgtccgca

SEQ ID NO: 1338 - DNA, 20 bp, Artificial Sequence
  sgRNA
  mm06362_Gfra2
tctattggagcatccatctg

SEQ ID NO: 1339 - DNA, 20 bp, Artificial Sequence
  sgRNA
  mm06363_Gfra2
ggccaataaggagtgccagg

SEQ ID NO: 1340 - DNA, 20 bp, Artificial Sequence
  sgRNA
  mm06364_Gfra2
ccgggccaatgagctgtgtg

SEQ ID NO: 1341 - DNA, 20 bp, Artificial Sequence
  sgRNA
  mm06365_Gfra3
ccgcagatccaggcaattgg

SEQ ID NO: 1342 - DNA, 20 bp, Artificial Sequence
  sgRNA
  mm06366_Gfra3
ggtccaataaatgtccagac

SEQ ID NO: 1343 - DNA, 20 bp, Artificial Sequence
  sgRNA
  mm06367_Gfra3
gacatggcagactcctctaa

SEQ ID NO: 1344 - DNA, 20 bp, Artificial Sequence
  sgRNA
  mm06368_Gfra3
cctgcgcaaggcctacgggg

SEQ ID NO: 1345 - DNA, 20 bp, Artificial Sequence
  sgRNA
  mm06373_Ggh
agattcaggttattcccgag

SEQ ID NO: 1346 - DNA, 20 bp, Artificial Sequence
  sgRNA
  mm06374_Ggh
agactctatatacttcacat

SEQ ID NO: 1347 - DNA, 20 bp, Artificial Sequence
  sgRNA
  mm06375_Ggh
cctacaaccatggctccgag

SEQ ID NO: 1348 - DNA, 20 bp, Artificial Sequence
  sgRNA
  mm06376_Ggh
catgtgataccttcacagag

SEQ ID NO: 1349 - DNA, 20 bp, Artificial Sequence
  sgRNA
  mm06385_B4galt1
ggccagagaggtaatagacg

SEQ ID NO: 1350 - DNA, 20 bp, Artificial Sequence
  sgRNA
  mm06386_B4galt1
cagggctggagtcgagaccc

SEQ ID NO: 1351 - DNA, 20 bp, Artificial Sequence
  sgRNA
  mm06387_B4galt1
gctcaatattggctttcaag

SEQ ID NO: 1352 - DNA, 20 bp, Artificial Sequence
  sgRNA
  mm06388_B4galt1
tgatgtggacctcattccga

SEQ ID NO: 1353 - DNA, 20 bp, Artificial Sequence
  sgRNA
  mm06389_Ggt1
actgacgtatcaccgtatcg

SEQ ID NO: 1354 - DNA, 20 bp, Artificial Sequence
  sgRNA
  mm06390_Ggt1
cgtacagggtcgcatcaccg

SEQ ID NO: 1355 - DNA, 20 bp, Artificial Sequence
  sgRNA
  mm06391_Ggt1
gaattcaggctcatagtagg

SEQ ID NO: 1356 - DNA, 20 bp, Artificial Sequence
  sgRNA
  mm06392_Ggt1
cgaccacgtgtactccaggg

SEQ ID NO: 1357 - DNA, 20 bp, Artificial Sequence
  sgRNA
  mm06397_Ghr
attgattctttgcagaactg

SEQ ID NO: 1358 - DNA, 20 bp, Artificial Sequence
  sgRNA
  mm06398_Ghr
gcttccaatatgttcgtctg

SEQ ID NO: 1359 - DNA, 20 bp, Artificial Sequence
  sgRNA
  mm06399_Ghr
aattgctcatgaatggaccc

SEQ ID NO: 1360 - DNA, 20 bp, Artificial Sequence
  sgRNA
  mm06400_Ghr
gtccagttgaggccaatggg

SEQ ID NO: 1361 - DNA, 20 bp, Artificial Sequence
  sgRNA
  mm06405_Ghrhr
acgtaccagtgcatagcacg

SEQ ID NO: 1362 - DNA, 20 bp, Artificial Sequence
  sgRNA
  mm06406_Ghrhr
aggtggcaaacagctgcgtg

SEQ ID NO: 1363 - DNA, 20 bp, Artificial Sequence
  sgRNA
  mm06407_Ghrhr
gatggcaatagccacgcaga

SEQ ID NO: 1364 - DNA, 20 bp, Artificial Sequence
  sgRNA
  mm06408_Ghrhr
catggtggccaaatgtgaga

SEQ ID NO: 1365 - DNA, 20 bp, Artificial Sequence
  sgRNA
  mm06489_Ostm1
catcagccgaaacatcgggg

SEQ ID NO: 1366 - DNA, 20 bp, Artificial Sequence
  sgRNA
  mm06490_Ostm1
ttgcctaacaaacaatggtg

SEQ ID NO: 1367 - DNA, 20 bp, Artificial Sequence
  sgRNA
  mm06491_Ostm1
agcgctgcgcaccatacagg

SEQ ID NO: 1368 - DNA, 20 bp, Artificial Sequence
  sgRNA
  mm06492_Ostm1
cagaatgcagatagttctca

SEQ ID NO: 1369 - DNA, 20 bp, Artificial Sequence
  sgRNA
  mm06521_Glp1r
agaaatggagagaataccgg

SEQ ID NO: 1370 - DNA, 20 bp, Artificial Sequence
  sgRNA
  mm06522_Glp1r
cctgtacattatctacacag

SEQ ID NO: 1371 - DNA, 20 bp, Artificial Sequence
  sgRNA
  mm06523_Glp1r
acattcacgaaggaacctgg

SEQ ID NO: 1372 - DNA, 20 bp, Artificial Sequence
  sgRNA
  mm06524_Glp1r
cactccgacaggtccctcca

SEQ ID NO: 1373 - DNA, 20 bp, Artificial Sequence
  sgRNA
  mm06525_Glra1
ccacttccacgaaatcacca

SEQ ID NO: 1374 - DNA, 20 bp, Artificial Sequence
  sgRNA
  mm06526_Glra1
ttccatcgctgagacaacca

SEQ ID NO: 1375 - DNA, 20 bp, Artificial Sequence
  sgRNA
  mm06527_Glra1
atgctgcaccagctcgtgtg

SEQ ID NO: 1376 - DNA, 20 bp, Artificial Sequence
  sgRNA
  mm06528_Glra1
tcctggataagctcatgggg

SEQ ID NO: 1377 - DNA, 20 bp, Artificial Sequence
  sgRNA
  mm06533_Glrb
aggttactacacttgtgtgg

SEQ ID NO: 1378 - DNA, 20 bp, Artificial Sequence
  sgRNA
  mm06534_Glrb
ggaaacagagttaagtctag

SEQ ID NO: 1379 - DNA, 20 bp, Artificial Sequence
  sgRNA
  mm06535_Glrb
cacagcgtactccacgaggg

SEQ ID NO: 1380 - DNA, 20 bp, Artificial Sequence
  sgRNA
  mm06536_Glrb
ccaccatgtataagtgcttg

SEQ ID NO: 1381 - DNA, 20 bp, Artificial Sequence
  sgRNA
  mm06553_Slc6a9
atacctctgctatcgcaacg

SEQ ID NO: 1382 - DNA, 20 bp, Artificial Sequence
  sgRNA
  mm06554_Slc6a9
gtagtacatgatacccgtga

SEQ ID NO: 1383 - DNA, 20 bp, Artificial Sequence
  sgRNA
  mm06555_Slc6a9
atggtggtgtccacatacat

SEQ ID NO: 1384 - DNA, 20 bp, Artificial Sequence
  sgRNA
  mm06556_Slc6a9
tgtgctaccagcgtctacgc

SEQ ID NO: 1385 - DNA, 20 bp, Artificial Sequence
  sgRNA
  mm06633_Gnb2l1
gatagggttgctgctgttcg

SEQ ID NO: 1386 - DNA, 20 bp, Artificial Sequence
  sgRNA
  mm06634_Gnb2l1
aagctaaagaccaaccacat

SEQ ID NO: 1387 - DNA, 20 bp, Artificial Sequence
  sgRNA
  mm06635_Gnb2l1
tgtctgcaagtacacggtcc

SEQ ID NO: 1388 - DNA, 20 bp, Artificial Sequence
  sgRNA
  mm06636_Gnb2l1
cttgcctccagaagcacaga

SEQ ID NO: 1389 - DNA, 20 bp, Artificial Sequence
  sgRNA
  mm06669_Bscl2
gtttcatgttataccagagg

SEQ ID NO: 1390 - DNA, 20 bp, Artificial Sequence
  sgRNA
  mm06670_Bscl2
cctgggcccacagtaaggcg

SEQ ID NO: 1391 - DNA, 20 bp, Artificial Sequence
  sgRNA
  mm06671_Bscl2
caaaggatcagacaaagacg

SEQ ID NO: 1392 - DNA, 20 bp, Artificial Sequence
  sgRNA
  mm06672_Bscl2
aatgtctcactggctaagag

SEQ ID NO: 1393 - DNA, 20 bp, Artificial Sequence
  sgRNA
  mm06713_Got2
tggaggtcccatttcaacat

SEQ ID NO: 1394 - DNA, 20 bp, Artificial Sequence
  sgRNA
  mm06714_Got2
tttctgcccaaaccatcctg

SEQ ID NO: 1395 - DNA, 20 bp, Artificial Sequence
  sgRNA
  mm06715_Got2
catcctcctcaccttcacca

SEQ ID NO: 1396 - DNA, 20 bp, Artificial Sequence
  sgRNA
  mm06716_Got2
agctcaccttccggacactg

SEQ ID NO: 1397 - DNA, 20 bp, Artificial Sequence
  sgRNA
  mm06717_Gp1ba
caaggacacaactcctaacg

SEQ ID NO: 1398 - DNA, 20 bp, Artificial Sequence
  sgRNA
  mm06718_Gp1ba
tggcttcgcacaataccaaa

SEQ ID NO: 1399 - DNA, 20 bp, Artificial Sequence
  sgRNA
  mm06719_Gp1ba
cacctgggcgagaaccaact

SEQ ID NO: 1400 - DNA, 20 bp, Artificial Sequence
  sgRNA
  mm06720_Gp1ba
tgcaggcaatgcccatccta

SEQ ID NO: 1401 - DNA, 20 bp, Artificial Sequence
  sgRNA
  mm06725_Lrp2
gatatgaccgttgttcgacg

SEQ ID NO: 1402 - DNA, 20 bp, Artificial Sequence
  sgRNA
  mm06726_Lrp2
tggatggcaattattccgag

SEQ ID NO: 1403 - DNA, 20 bp, Artificial Sequence
  sgRNA
  mm06727_Lrp2
gtatcctattggacacacgc

SEQ ID NO: 1404 - DNA, 20 bp, Artificial Sequence
  sgRNA
  mm06728_Lrp2
tgataggcgcaacgactgtg

SEQ ID NO: 1405 - DNA, 20 bp, Artificial Sequence
  sgRNA
  mm06729_Pdpn
taccaacgcagagagagcgt

SEQ ID NO: 1406 - DNA, 20 bp, Artificial Sequence
  sgRNA
  mm06730_Pdpn
gaagatgatattgtgacccc

SEQ ID NO: 1407 - DNA, 20 bp, Artificial Sequence
  sgRNA
  mm06731_Pdpn
agtggtgactagccactctg

SEQ ID NO: 1408 - DNA, 20 bp, Artificial Sequence
  sgRNA
  mm06732_Pdpn
ttctctgtgatcatggtctg

SEQ ID NO: 1409 - DNA, 20 bp, Artificial Sequence
  sgRNA
  mm06733_Gp49a
aatgaatctgccaaatagtg

SEQ ID NO: 1410 - DNA, 20 bp, Artificial Sequence
  sgRNA
  mm06734_Gp49a
agaacaaaagtagcatgggt

SEQ ID NO: 1411 - DNA, 20 bp, Artificial Sequence
  sgRNA
  mm06735_Gp49a
gtgagtccagggtccacgag

SEQ ID NO: 1412 - DNA, 20 bp, Artificial Sequence
  sgRNA
  mm06736_Gp49a
aaaggatatggaaactccag

SEQ ID NO: 1413 - DNA, 20 bp, Artificial Sequence
  sgRNA
  mm06737_Lilrb4
tttatacagatgataatact

SEQ ID NO: 1414 - DNA, 20 bp, Artificial Sequence
  sgRNA
  mm06738_Lilrb4
agaacaaaagtagcatagga

SEQ ID NO: 1415 - DNA, 20 bp, Artificial Sequence
  sgRNA
  mm06739_Lilrb4
ctgatccaggaaggaaagca

SEQ ID NO: 1416 - DNA, 20 bp, Artificial Sequence
  sgRNA
  mm06740_Lilrb4
agcatgacaacctcatatgc

SEQ ID NO: 1417 - DNA, 20 bp, Artificial Sequence
  sgRNA
  mm06741_Gp5
tctgttcgagaaccccctgg

SEQ ID NO: 1418 - DNA, 20 bp, Artificial Sequence
  sgRNA
  mm06742_Gp5
atcttatccaggatcgcacg

SEQ ID NO: 1419 - DNA, 20 bp, Artificial Sequence
  sgRNA
  mm06743_Gp5
gaatggaccagggcatattg

SEQ ID NO: 1420 - DNA, 20 bp, Artificial Sequence
  sgRNA
  mm06744_Gp5
gaggtttccggatagagtca

SEQ ID NO: 1421 - DNA, 20 bp, Artificial Sequence
  sgRNA
  mm06749_Gpc1
gctgcgcctctactaccgtg

SEQ ID NO: 1422 - DNA, 20 bp, Artificial Sequence
  sgRNA
  mm06750_Gpc1
cccgaggagaagcgtcgccg

SEQ ID NO: 1423 - DNA, 20 bp, Artificial Sequence
  sgRNA
  mm06751_Gpc1
gcacatttcggcaatagtcg

SEQ ID NO: 1424 - DNA, 20 bp, Artificial Sequence
  sgRNA
  mm06752_Gpc1
ccgcaggcgcagttctcgag

SEQ ID NO: 1425 - DNA, 20 bp, Artificial Sequence
  sgRNA
  mm06753_Gpc3
ttgcggtggttattgcaatg

SEQ ID NO: 1426 - DNA, 20 bp, Artificial Sequence
  sgRNA
  mm06754_Gpc3
cttgggttctgatatcaacg

SEQ ID NO: 1427 - DNA, 20 bp, Artificial Sequence
  sgRNA
  mm06755_Gpc3
ggtcacgtcttgctcctcgg

SEQ ID NO: 1428 - DNA, 20 bp, Artificial Sequence
  sgRNA
  mm06756_Gpc3
cttactaaacttgaggtggt

SEQ ID NO: 1429 - DNA, 20 bp, Artificial Sequence
  sgRNA
  mm06757_Gpc4
ccctctatgagatcaacggt

SEQ ID NO: 1430 - DNA, 20 bp, Artificial Sequence
  sgRNA
  mm06758_Gpc4
tattgctcaaacatcatgcg

SEQ ID NO: 1431 - DNA, 20 bp, Artificial Sequence
  sgRNA
  mm06759_Gpc4
tgtagtaagcaaagtgtccg

SEQ ID NO: 1432 - DNA, 20 bp, Artificial Sequence
  sgRNA
  mm06760_Gpc4
taaagatgatttcaaaaccg

SEQ ID NO: 1433 - DNA, 20 bp, Artificial Sequence
  sgRNA
  mm06765_S1pr2
aatcagcgatatcagccaag

SEQ ID NO: 1434 - DNA, 20 bp, Artificial Sequence
  sgRNA
  mm06766_S1pr2
catcgccatcgagagacaag

SEQ ID NO: 1435 - DNA, 20 bp, Artificial Sequence
  sgRNA
  mm06767_S1pr2
ggaacactacaattacacca

SEQ ID NO: 1436 - DNA, 20 bp, Artificial Sequence
  sgRNA
  mm06768_S1pr2
cagaagattctccaccacga

SEQ ID NO: 1437 - DNA, 20 bp, Artificial Sequence
  sgRNA
  mm06773_Lpar1
tctttggctatgttcgccag

SEQ ID NO: 1438 - DNA, 20 bp, Artificial Sequence
  sgRNA
  mm06774_Lpar1
ggagactgactgttagcacg

SEQ ID NO: 1439 - DNA, 20 bp, Artificial Sequence
  sgRNA
  mm06775_Lpar1
aagtaggagtcactgtagag

SEQ ID NO: 1440 - DNA, 20 bp, Artificial Sequence
  sgRNA
  mm06776_Lpar1
acgaatgagcaaccggcgcg

SEQ ID NO: 1441 - DNA, 20 bp, Artificial Sequence
  sgRNA
  mm06777_Cmklr1
actcgcaagtagtttccaca

SEQ ID NO: 1442 - DNA, 20 bp, Artificial Sequence
  sgRNA
  mm06778_Cmklr1
ggccgttgcctaggagaccg

SEQ ID NO: 1443 - DNA, 20 bp, Artificial Sequence
  sgRNA
  mm06779_Cmklr1
ggaggaggcgagtccgtggg

SEQ ID NO: 1444 - DNA, 20 bp, Artificial Sequence
  sgRNA
  mm06780_Cmklr1
agacgctggtgtacatgttg

SEQ ID NO: 1445 - DNA, 20 bp, Artificial Sequence
  sgRNA
  mm06797_Gpm6b
gtgttgctcaagaattgcca

SEQ ID NO: 1446 - DNA, 20 bp, Artificial Sequence
  sgRNA
  mm06798_Gpm6b
ccactcccagcacataggtg

SEQ ID NO: 1447 - DNA, 20 bp, Artificial Sequence
  sgRNA
  mm06799_Gpm6b
tactcacacttcactcagca

SEQ ID NO: 1448 - DNA, 20 bp, Artificial Sequence
  sgRNA
  mm06800_Gpm6b
acagatctgctccacacccg

SEQ ID NO: 1449 - DNA, 20 bp, Artificial Sequence
  sgRNA
  mm06861_Gsr
ggctatgcaacattcgcaga

SEQ ID NO: 1450 - DNA, 20 bp, Artificial Sequence
  sgRNA
  mm06862_Gsr
cggcccccacgatgacgctg

SEQ ID NO: 1451 - DNA, 20 bp, Artificial Sequence
  sgRNA
  mm06863_Gsr
gctgtgagggtaaattcagt

SEQ ID NO: 1452 - DNA, 20 bp, Artificial Sequence
  sgRNA
  mm06864_Gsr
aacatctggaatcatggtcg

SEQ ID NO: 1453 - DNA, 20 bp, Artificial Sequence
  sgRNA
  mm06913_Gria1
atgttcacaatatcgatctg

SEQ ID NO: 1454 - DNA, 20 bp, Artificial Sequence
  sgRNA
  mm06914_Gria1
cgtcgctgacaatctcaagt

SEQ ID NO: 1455 - DNA, 20 bp, Artificial Sequence
  sgRNA
  mm06915_Gria1
tgtcaacattctaacaacca

SEQ ID NO: 1456 - DNA, 20 bp, Artificial Sequence
  sgRNA
  mm06916_Gria1
agtttaacgagaaagggcgc

SEQ ID NO: 1457 - DNA, 20 bp, Artificial Sequence
  sgRNA
  mm06917_Gria2
tgtcagtctgaactccgaag

SEQ ID NO: 1458 - DNA, 20 bp, Artificial Sequence
  sgRNA
  mm06918_Gria2
ttggacagcatcataagtca

SEQ ID NO: 1459 - DNA, 20 bp, Artificial Sequence
  sgRNA
  mm06919_Gria2
agctcaaaacaaatggaccc

SEQ ID NO: 1460 - DNA, 20 bp, Artificial Sequence
  sgRNA
  mm06920_Gria2
caggtgactgctatcaatgt

SEQ ID NO: 1461 - DNA, 20 bp, Artificial Sequence
  sgRNA
  mm06921_Gria4
tgcatacattggtgtcagcg

SEQ ID NO: 1462 - DNA, 20 bp, Artificial Sequence
  sgRNA
  mm06922_Gria4
gcatgtcagtgcgatatgtg

SEQ ID NO: 1463 - DNA, 20 bp, Artificial Sequence
  sgRNA
  mm06923_Gria4
acgtagagttaattacacaa

SEQ ID NO: 1464 - DNA, 20 bp, Artificial Sequence
  sgRNA
  mm06924_Gria4
tgcacctctgacaatcacgt

SEQ ID NO: 1465 - DNA, 20 bp, Artificial Sequence
  sgRNA
  mm06925_Grid1
ggccaataatccgttccagg

SEQ ID NO: 1466 - DNA, 20 bp, Artificial Sequence
  sgRNA
  mm06926_Grid1
gaaactccataacccctgtg

SEQ ID NO: 1467 - DNA, 20 bp, Artificial Sequence
  sgRNA
  mm06927_Grid1
attcaaatatgagatatacc

SEQ ID NO: 1468 - DNA, 20 bp, Artificial Sequence
  sgRNA
  mm06928_Grid1
ggaccagatccaggatctcg

SEQ ID NO: 1469 - DNA, 20 bp, Artificial Sequence
  sgRNA
  mm06929_Grid2
gatcccatttgcaatcgtgg

SEQ ID NO: 1470 - DNA, 20 bp, Artificial Sequence
  sgRNA
  mm06930_Grid2
aaactggagaacaacatgcg

SEQ ID NO: 1471 - DNA, 20 bp, Artificial Sequence
  sgRNA
  mm06931_Grid2
gtaataatcctagatatccg

SEQ ID NO: 1472 - DNA, 20 bp, Artificial Sequence
  sgRNA
  mm06932_Grid2
caaatatggaagcccacaag

SEQ ID NO: 1473 - DNA, 20 bp, Artificial Sequence
  sgRNA
  mm06933_Grik2
aagcgagtcccaaagcgcca

SEQ ID NO: 1474 - DNA, 20 bp, Artificial Sequence
  sgRNA
  mm06934_Grik2
acagtggcgtaaatatgaca

SEQ ID NO: 1475 - DNA, 20 bp, Artificial Sequence
  sgRNA
  mm06935_Grik2
cgaacataggtaatagccag

SEQ ID NO: 1476 - DNA, 20 bp, Artificial Sequence
  sgRNA
  mm06936_Grik2
ctgtgtatcatatgttaacg

SEQ ID NO: 1477 - DNA, 20 bp, Artificial Sequence
  sgRNA
  mm06945_Grin1
aacatcactgatccaccgcg

SEQ ID NO: 1478 - DNA, 20 bp, Artificial Sequence
  sgRNA
  mm06946_Grin1
gtggacatctggtatcctcg

SEQ ID NO: 1479 - DNA, 20 bp, Artificial Sequence
  sgRNA
  mm06947_Grin1
ctgtcctatgacaacaagcg

SEQ ID NO: 1480 - DNA, 20 bp, Artificial Sequence
  sgRNA
  mm06948_Grin1
aaccaggccaataagcgaca

SEQ ID NO: 1481 - DNA, 20 bp, Artificial Sequence
  sgRNA
  mm06949_Grin2a
atggtaaaagaaggcccatg

SEQ ID NO: 1482 - DNA, 20 bp, Artificial Sequence
  sgRNA
  mm06950_Grin2a
agaagaaatcgtagccggtg

SEQ ID NO: 1483 - DNA, 20 bp, Artificial Sequence
  sgRNA
  mm06951_Grin2a
atcttgacaaacttccgaca

SEQ ID NO: 1484 - DNA, 20 bp, Artificial Sequence
  sgRNA
  mm06952_Grin2a
tgtgtgcgacctcatgtccg

SEQ ID NO: 1485 - DNA, 20 bp, Artificial Sequence
  sgRNA
  mm06953_Grin2b
tatcctacgcttgctccgaa

SEQ ID NO: 1486 - DNA, 20 bp, Artificial Sequence
  sgRNA
  mm06954_Grin2b
ggcaccggttgtaacccaca

SEQ ID NO: 1487 - DNA, 20 bp, Artificial Sequence
  sgRNA
  mm06955_Grin2b
acatcatggaagaatacgac

SEQ ID NO: 1488 - DNA, 20 bp, Artificial Sequence
  sgRNA
  mm06956_Grin2b
tgactggctacggctacaca

SEQ ID NO: 1489 - DNA, 20 bp, Artificial Sequence
  sgRNA
  mm06977_Grn
cctatccaagaactacacca

SEQ ID NO: 1490 - DNA, 20 bp, Artificial Sequence
  sgRNA
  mm06978_Grn
ccctgcacaaaagaccaaca

SEQ ID NO: 1491 - DNA, 20 bp, Artificial Sequence
  sgRNA
  mm06979_Grn
gacactggacagcacccaag

SEQ ID NO: 1492 - DNA, 20 bp, Artificial Sequence
  sgRNA
  mm06980_Grn
cacctagtgaagtcatcaca

SEQ ID NO: 1493 - DNA, 20 bp, Artificial Sequence
  sgRNA
  mm06985_Pdia3
cttcaccagagactcaatgt

SEQ ID NO: 1494 - DNA, 20 bp, Artificial Sequence
  sgRNA
  mm06986_Pdia3
atagtccacatcatagtaag

SEQ ID NO: 1495 - DNA, 20 bp, Artificial Sequence
  sgRNA
  mm06987_Pdia3
ctgctacttacccaccactg

SEQ ID NO: 1496 - DNA, 20 bp, Artificial Sequence
  sgRNA
  mm06988_Pdia3
aaacacctgtaataagtatg

SEQ ID NO: 1497 - DNA, 20 bp, Artificial Sequence
  sgRNA
  mm06989_Hspa5
tgtgttcaagaacggccgcg

SEQ ID NO: 1498 - DNA, 20 bp, Artificial Sequence
  sgRNA
  mm06990_Hspa5
ccgtggcataaaccccgatg

SEQ ID NO: 1499 - DNA, 20 bp, Artificial Sequence
  sgRNA
  mm06991_Hspa5
tgtgcagaaactccggcgtg

SEQ ID NO: 1500 - DNA, 20 bp, Artificial Sequence
  sgRNA
  mm06992_Hspa5
cattccaagtgcgtccgatg

SEQ ID NO: 1501 - DNA, 20 bp, Artificial Sequence
  sgRNA
  mm07157_Gypa
tcttcaaataaccactcctg

SEQ ID NO: 1502 - DNA, 20 bp, Artificial Sequence
  sgRNA
  mm07158_Gypa
tcagcaacaatgtcaacacc

SEQ ID NO: 1503 - DNA, 20 bp, Artificial Sequence
  sgRNA
  mm07159_Gypa
catatcaacatacctagtgc

SEQ ID NO: 1504 - DNA, 20 bp, Artificial Sequence
  sgRNA
  mm07160_Gypa
acgcagcagacacttcagta

SEQ ID NO: 1505 - DNA, 20 bp, Artificial Sequence
  sgRNA
  mm07165_Gzma
caagaacttacacgttacag

SEQ ID NO: 1506 - DNA, 20 bp, Artificial Sequence
  sgRNA
  mm07166_Gzma
atgatgaatatacacgtgag

SEQ ID NO: 1507 - DNA, 20 bp, Artificial Sequence
  sgRNA
  mm07167_Gzma
gccatatacggtcttgagtg

SEQ ID NO: 1508 - DNA, 20 bp, Artificial Sequence
  sgRNA
  mm07168_Gzma
gatgccgagtagcaggatgg

SEQ ID NO: 1509 - DNA, 20 bp, Artificial Sequence
  sgRNA
  mm07197_H13
ggtattcggcaccaacgtga

SEQ ID NO: 1510 - DNA, 20 bp, Artificial Sequence
  sgRNA
  mm07198_H13
ccccagccaacggcacgacg

SEQ ID NO: 1511 - DNA, 20 bp, Artificial Sequence
  sgRNA
  mm07199_H13
gaaaaaacttattcatgaag

SEQ ID NO: 1512 - DNA, 20 bp, Artificial Sequence
  sgRNA
  mm07200_H13
tgagtttgacactaaggacc

SEQ ID NO: 1513 - DNA, 20 bp, Artificial Sequence
  sgRNA
  mm07201_Hist1h1d
tcttcagcccgagcttgatg

SEQ ID NO: 1514 - DNA, 20 bp, Artificial Sequence
  sgRNA
  mm07202_Hist1h1d
ttccggtgaggctaagccca

SEQ ID NO: 1515 - DNA, 20 bp, Artificial Sequence
  sgRNA
  mm07203_Hist1h1d
agaagaccggcgccgctgct

SEQ ID NO: 1516 - DNA, 20 bp, Artificial Sequence
  sgRNA
  mm07204_Hist1h1d
tgtcttctccacaggtgcag

SEQ ID NO: 1517 - DNA, 20 bp, Artificial Sequence
  sgRNA
  mm07209_H2-Aa
aatccatcagccgaccacgt

SEQ ID NO: 1518 - DNA, 20 bp, Artificial Sequence
  sgRNA
  mm07210_H2-Aa
gctgtagtaaaacacaactt

SEQ ID NO: 1519 - DNA, 20 bp, Artificial Sequence
  sgRNA
  mm07211_H2-Aa
aattccaccccagctaccaa

SEQ ID NO: 1520 - DNA, 20 bp, Artificial Sequence
  sgRNA
  mm07212_H2-Aa
aatagcaagtcagtcgcaga

SEQ ID NO: 1521 - DNA, 20 bp, Artificial Sequence
  sgRNA
  mm07213_H2-Ab1
ggtgtgcagacacaactacg

SEQ ID NO: 1522 - DNA, 20 bp, Artificial Sequence
  sgRNA
  mm07214_H2-Ab1
cagatacatctacaaccggg

SEQ ID NO: 1523 - DNA, 20 bp, Artificial Sequence
  sgRNA
  mm07215_H2-Ab1
tcgtatgcgctgcgtcccgt

SEQ ID NO: 1524 - DNA, 20 bp, Artificial Sequence
  sgRNA
  mm07216_H2-Ab1
agcagaccagagtgttgtgg

SEQ ID NO: 1525 - DNA, 20 bp, Artificial Sequence
  sgRNA
  mm07217_H2-D1
ggccccgactcagacccgcg

SEQ ID NO: 1526 - DNA, 20 bp, Artificial Sequence
  sgRNA
  mm07218_H2-D1
cgacgcaagtgggagcagag

SEQ ID NO: 1527 - DNA, 20 bp, Artificial Sequence
  sgRNA
  mm07219_H2-D1
tagccgacagagatgtaccg

SEQ ID NO: 1528 - DNA, 20 bp, Artificial Sequence
  sgRNA
  mm07220_H2-D1
gtgagcctgaggaacctgct

SEQ ID NO: 1529 - DNA, 20 bp, Artificial Sequence
  sgRNA
  mm07241_H2-M2
atagccaacagtcatgtagt

SEQ ID NO: 1530 - DNA, 20 bp, Artificial Sequence
  sgRNA
  mm07242_H2-M2
agagtgggaggcaactaatg

SEQ ID NO: 1531 - DNA, 20 bp, Artificial Sequence
  sgRNA
  mm07243_H2-M2
caggttctcacaccatccaa

SEQ ID NO: 1532 - DNA, 20 bp, Artificial Sequence
  sgRNA
  mm07244_H2-M2
tgcgatgtcgaagtaccgca

SEQ ID NO: 1533 - DNA, 20 bp, Artificial Sequence
  sgRNA
  mm07245_H2-M3
actgcgctatttccacactg

SEQ ID NO: 1534 - DNA, 20 bp, Artificial Sequence
  sgRNA
  mm07246_H2-M3
atagcattgaggaaattccg

SEQ ID NO: 1535 - DNA, 20 bp, Artificial Sequence
  sgRNA
  mm07247_H2-M3
aaagtgccagagcaaacctt

SEQ ID NO: 1536 - DNA, 20 bp, Artificial Sequence
  sgRNA
  mm07248_H2-M3
ggaaagaccagagtactgga

SEQ ID NO: 1537 - DNA, 20 bp, Artificial Sequence
  sgRNA
  mm07253_H2-DMa
gtttggcaagcccaacacgt

SEQ ID NO: 1538 - DNA, 20 bp, Artificial Sequence
  sgRNA
  mm07254_H2-DMa
atagagtgtgccggaatgtg

SEQ ID NO: 1539 - DNA, 20 bp, Artificial Sequence
  sgRNA
  mm07255_H2-DMa
aggacgggattcccaacata

SEQ ID NO: 1540 - DNA, 20 bp, Artificial Sequence
  sgRNA
  mm07256_H2-DMa
tctgcaaagtcaggcagtcg

SEQ ID NO: 1541 - DNA, 20 bp, Artificial Sequence
  sgRNA
  mm07273_H2-Q1
gctgcggtatttcgagacct

SEQ ID NO: 1542 - DNA, 20 bp, Artificial Sequence
  sgRNA
  mm07274_H2-Q1
tcagatgggcgccttcaaag

SEQ ID NO: 1543 - DNA, 20 bp, Artificial Sequence
  sgRNA
  mm07275_H2-Q1
agtattgggaacggaacaca

SEQ ID NO: 1544 - DNA, 20 bp, Artificial Sequence
  sgRNA
  mm07276_H2-Q1
gaaacacaggacctacctgg

SEQ ID NO: 1545 - DNA, 20 bp, Artificial Sequence
  sgRNA
  mm07277_H2-Q10
tacctgcaatacgcatacga

SEQ ID NO: 1546 - DNA, 20 bp, Artificial Sequence
  sgRNA
  mm07278_H2-Q10
ccccaggctcacactccatg

SEQ ID NO: 1547 - DNA, 20 bp, Artificial Sequence
  sgRNA
  mm07279_H2-Q10
tggtgctgcagagtattaca

SEQ ID NO: 1548 - DNA, 20 bp, Artificial Sequence
  sgRNA
  mm07280_H2-Q10
taaccgacaataatgaaccg

SEQ ID NO: 1549 - DNA, 20 bp, Artificial Sequence
  sgRNA
  mm07281_H2-Q2
tgacatcaccttgagaactg

SEQ ID NO: 1550 - DNA, 20 bp, Artificial Sequence
  sgRNA
  mm07282_H2-Q2
gtattgggagcggaacacac

SEQ ID NO: 1551 - DNA, 20 bp, Artificial Sequence
  sgRNA
  mm07283_H2-Q2
tggaggtcgattgcttgacg

SEQ ID NO: 1552 - DNA, 20 bp, Artificial Sequence
  sgRNA
  mm07284_H2-Q2
gaaactgactgagacacgcg

SEQ ID NO: 1553 - DNA, 20 bp, Artificial Sequence
  sgRNA
  mm07285_H2-Q4
tggtgctacagagaaaagca

SEQ ID NO: 1554 - DNA, 20 bp, Artificial Sequence
  sgRNA
  mm07286_H2-Q4
gatatgagccgcgggcaccg

SEQ ID NO: 1555 - DNA, 20 bp, Artificial Sequence
  sgRNA
  mm07287_H2-Q4
gaccctgatcgagatccgcg

SEQ ID NO: 1556 - DNA, 20 bp, Artificial Sequence
  sgRNA
  mm07288_H2-Q4
tgtcggttacgtggacaaca

SEQ ID NO: 1557 - DNA, 20 bp, Artificial Sequence
  sgRNA
  mm07289_H2-Q7
ctggttgtagtagctctgtg

SEQ ID NO: 1558 - DNA, 20 bp, Artificial Sequence
  sgRNA
  mm07290_H2-Q7
tggtattgcagagaaagacc

SEQ ID NO: 1559 - DNA, 20 bp, Artificial Sequence
  sgRNA
  mm07291_H2-Q7
gtggacggcggtggacatgg

SEQ ID NO: 1560 - DNA, 20 bp, Artificial Sequence
  sgRNA
  mm07292_H2-Q7
cgtgcgcttcgacagcgatg

SEQ ID NO: 1561 - DNA, 20 bp, Artificial Sequence
  sgRNA
  mm07297_H2-T23
tactacaatcagagtaacga

SEQ ID NO: 1562 - DNA, 20 bp, Artificial Sequence
  sgRNA
  mm07298_H2-T23
ctgaagatgaagtcaccctg

SEQ ID NO: 1563 - DNA, 20 bp, Artificial Sequence
  sgRNA
  mm07299_H2-T23
gtgtctcatttcccagccgt

SEQ ID NO: 1564 - DNA, 20 bp, Artificial Sequence
  sgRNA
  mm07300_H2-T23
cttgtgcttagagatctgtg

SEQ ID NO: 1565 - DNA, 20 bp, Artificial Sequence
  sgRNA
  mm07409_Hcn1
gagtacctatccgatcgagt

SEQ ID NO: 1566 - DNA, 20 bp, Artificial Sequence
  sgRNA
  mm07410_Hcn1
taatcagatacatacaccag

SEQ ID NO: 1567 - DNA, 20 bp, Artificial Sequence
  sgRNA
  mm07411_Hcn1
gtgtgcttcaaggtggacgg

SEQ ID NO: 1568 - DNA, 20 bp, Artificial Sequence
  sgRNA
  mm07412_Hcn1
cagagcagacgacaacaccg

SEQ ID NO: 1569 - DNA, 20 bp, Artificial Sequence
  sgRNA
  mm07465_Hbegf
actctcaccggtcaccaacg

SEQ ID NO: 1570 - DNA, 20 bp, Artificial Sequence
  sgRNA
  mm07466_Hbegf
caaggactactgcatccacg

SEQ ID NO: 1571 - DNA, 20 bp, Artificial Sequence
  sgRNA
  mm07467_Hbegf
acaaaccagctgctacccac

SEQ ID NO: 1572 - DNA, 20 bp, Artificial Sequence
  sgRNA
  mm07468_Hbegf
gtggagcacttacttgcaag

SEQ ID NO: 1573 - DNA, 20 bp, Artificial Sequence
  sgRNA
  mm07477_Heph
catgtgcaagggtgatactg

SEQ ID NO: 1574 - DNA, 20 bp, Artificial Sequence
  sgRNA
  mm07478_Heph
ttggagcatctacatgcgag

SEQ ID NO: 1575 - DNA, 20 bp, Artificial Sequence
  sgRNA
  mm07479_Heph
gtttataaggaatacagtga

SEQ ID NO: 1576 - DNA, 20 bp, Artificial Sequence
  sgRNA
  mm07480_Heph
aaaagtcacatactactgga

SEQ ID NO: 1577 - DNA, 20 bp, Artificial Sequence
  sgRNA
  mm07505_Hexa
acgccccggtgagggaatcg

SEQ ID NO: 1578 - DNA, 20 bp, Artificial Sequence
  sgRNA
  mm07506_Hexa
aggaggtcattgaatacgca

SEQ ID NO: 1579 - DNA, 20 bp, Artificial Sequence
  sgRNA
  mm07507_Hexa
agtgaagctctcatatggga

SEQ ID NO: 1580 - DNA, 20 bp, Artificial Sequence
  sgRNA
  mm07508_Hexa
agcaaggtgttaataaccca

SEQ ID NO: 1581 - DNA, 20 bp, Artificial Sequence
  sgRNA
  mm07509_Hexb
gctcagctcgaaatctagca

SEQ ID NO: 1582 - DNA, 20 bp, Artificial Sequence
  sgRNA
  mm07510_Hexb
tacaccaaacgatgtccgga

SEQ ID NO: 1583 - DNA, 20 bp, Artificial Sequence
  sgRNA
  mm07511_Hexb
gcggagatgtacaacagccg

SEQ ID NO: 1584 - DNA, 20 bp, Artificial Sequence
  sgRNA
  mm07512_Hexb
taacgctccccaaacgctgt

SEQ ID NO: 1585 - DNA, 20 bp, Artificial Sequence
  sgRNA
  mm07521_Hfe
tgctccacgtacccttactg

SEQ ID NO: 1586 - DNA, 20 bp, Artificial Sequence
  sgRNA
  mm07522_Hfe
ttcctcccgcactcacgcgg

SEQ ID NO: 1587 - DNA, 20 bp, Artificial Sequence
  sgRNA
  mm07523_Hfe
gatccgtgccaaacagaaca

SEQ ID NO: 1588 - DNA, 20 bp, Artificial Sequence
  sgRNA
  mm07524_Hfe
catgaagacaacagtaccag

SEQ ID NO: 1589 - DNA, 20 bp, Artificial Sequence
  sgRNA
  mm07573_Hhip
ttgaagtgagggttactccg

SEQ ID NO: 1590 - DNA, 20 bp, Artificial Sequence
  sgRNA
  mm07574_Hhip
aagactacgagaaagtgggg

SEQ ID NO: 1591 - DNA, 20 bp, Artificial Sequence
  sgRNA
  mm07575_Hhip
tgcgacttccagaaacaccc

SEQ ID NO: 1592 - DNA, 20 bp, Artificial Sequence
  sgRNA
  mm07576_Hhip
gtgggtagaagccaccacac

SEQ ID NO: 1593 - DNA, 20 bp, Artificial Sequence
  sgRNA
  mm07669_Hmgcr
tcatcatcctgacgataacg

SEQ ID NO: 1594 - DNA, 20 bp, Artificial Sequence
  sgRNA
  mm07670_Hmgcr
cattaggtcgtggctcgatg

SEQ ID NO: 1595 - DNA, 20 bp, Artificial Sequence
  sgRNA
  mm07671_Hmgcr
gccaaattggacgaccctca

SEQ ID NO: 1596 - DNA, 20 bp, Artificial Sequence
  sgRNA
  mm07672_Hmgcr
aactgccagagagaaacact

SEQ ID NO: 1597 - DNA, 20 bp, Artificial Sequence
  sgRNA
  mm07749_Hnrnpk
gatgatatgagccctcgtcg

SEQ ID NO: 1598 - DNA, 20 bp, Artificial Sequence
  sgRNA
  mm07750_Hnrnpk
ctgttgggacataccgctcg

SEQ ID NO: 1599 - DNA, 20 bp, Artificial Sequence
  sgRNA
  mm07751_Hnrnpk
atccctaccttggaagaggt

SEQ ID NO: 1600 - DNA, 20 bp, Artificial Sequence
  sgRNA
  mm07752_Hnrnpk
atacctcagatataaggtca

SEQ ID NO: 1601 - DNA, 20 bp, Artificial Sequence
  sgRNA
  mm07925_Lipc
ttatcatgatcatccacggg

SEQ ID NO: 1602 - DNA, 20 bp, Artificial Sequence
  sgRNA
  mm07926_Lipc
aggagaaaggcgctcgttgg

SEQ ID NO: 1603 - DNA, 20 bp, Artificial Sequence
  sgRNA
  mm07927_Lipc
cataacccagagtgttgcaa

SEQ ID NO: 1604 - DNA, 20 bp, Artificial Sequence
  sgRNA
  mm07928_Lipc
ggtgtagtgctggtatgcca

SEQ ID NO: 1605 - DNA, 20 bp, Artificial Sequence
  sgRNA
  mm07929_Hpn
ggtgggtcccatcataacgc

SEQ ID NO: 1606 - DNA, 20 bp, Artificial Sequence
  sgRNA
  mm07930_Hpn
ggagctagagaggtggacca

SEQ ID NO: 1607 - DNA, 20 bp, Artificial Sequence
  sgRNA
  mm07931_Hpn
ctcacgctccaatgccaggg

SEQ ID NO: 1608 - DNA, 20 bp, Artificial Sequence
  sgRNA
  mm07932_Hpn
acccccagttgcacagcatg

SEQ ID NO: 1609 - DNA, 20 bp, Artificial Sequence
  sgRNA
  mm07985_Hspa8
ttagaccgttaccaacgctg

SEQ ID NO: 1610 - DNA, 20 bp, Artificial Sequence
  sgRNA
  mm07986_Hspa8
gaaagcaacatagcttggcg

SEQ ID NO: 1611 - DNA, 20 bp, Artificial Sequence
  sgRNA
  mm07987_Hspa8
tggtggtattgcgcttgatg

SEQ ID NO: 1612 - DNA, 20 bp, Artificial Sequence
  sgRNA
  mm07988_Hspa8
ctacagggtccagtgtgcca

SEQ ID NO: 1613 - DNA, 20 bp, Artificial Sequence
  sgRNA
  mm08061_Hspd1
cggagaagctctaagcacgc

SEQ ID NO: 1614 - DNA, 20 bp, Artificial Sequence
  sgRNA
  mm08062_Hspd1
tcttgaactaggtgtgatgt

SEQ ID NO: 1615 - DNA, 20 bp, Artificial Sequence
  sgRNA
  mm08063_Hspd1
agggacaatggactgaacac

SEQ ID NO: 1616 - DNA, 20 bp, Artificial Sequence
  sgRNA
  mm08064_Hspd1
tgacttaggaaaagttgggg

SEQ ID NO: 1617 - DNA, 20 bp, Artificial Sequence
  sgRNA
  mm08069_Hspa2
caagagcattaatcccgacg

SEQ ID NO: 1618 - DNA, 20 bp, Artificial Sequence
  sgRNA
  mm08070_Hspa2
gaagcactggccgttccgag

SEQ ID NO: 1619 - DNA, 20 bp, Artificial Sequence
  sgRNA
  mm08071_Hspa2
gagatcgactcgctctacga

SEQ ID NO: 1620 - DNA, 20 bp, Artificial Sequence
  sgRNA
  mm08072_Hspa2
ggtcaggatggacacatcga

SEQ ID NO: 1621 - DNA, 20 bp, Artificial Sequence
  sgRNA
  mm08073_Hsp90ab1
cattagagatcaactcgcgg

SEQ ID NO: 1622 - DNA, 20 bp, Artificial Sequence
  sgRNA
  mm08074_Hsp90ab1
cctcggagtcaaccacaccg

SEQ ID NO: 1623 - DNA, 20 bp, Artificial Sequence
  sgRNA
  mm08075_Hsp90ab1
aggtcgaagggagcccgccg

SEQ ID NO: 1624 - DNA, 20 bp, Artificial Sequence
  sgRNA
  mm08076_Hsp90ab1
tgaagatgtgggatccgatg

SEQ ID NO: 1625 - DNA, 20 bp, Artificial Sequence
  sgRNA
  mm08077_Hsp90aa1
gcttcagcttggaattcacg

SEQ ID NO: 1626 - DNA, 20 bp, Artificial Sequence
  sgRNA
  mm08078_Hsp90aa1
cagtaaactggactcgggga

SEQ ID NO: 1627 - DNA, 20 bp, Artificial Sequence
  sgRNA
  mm08079_Hsp90aa1
cctacttactcagatactca

SEQ ID NO: 1628 - DNA, 20 bp, Artificial Sequence
  sgRNA
  mm08080_Hsp90aa1
agaccaaacagagtatttgg

SEQ ID NO: 1629 - DNA, 20 bp, Artificial Sequence
  sgRNA
  mm08093_Sdc2
ggggaagcagcactagtgag

SEQ ID NO: 1630 - DNA, 20 bp, Artificial Sequence
  sgRNA
  mm08094_Sdc2
gtcacctgaagaaactgaca

SEQ ID NO: 1631 - DNA, 20 bp, Artificial Sequence
  sgRNA
  mm08095_Sdc2
ccttgacaatagctccattg

SEQ ID NO: 1632 - DNA, 20 bp, Artificial Sequence
  sgRNA
  mm08096_Sdc2
gatgactattcttctgcctc

SEQ ID NO: 1633 - DNA, 20 bp, Artificial Sequence
  sgRNA
  mm08097_Hspg2
tctacggctacaccacatgt

SEQ ID NO: 1634 - DNA, 20 bp, Artificial Sequence
  sgRNA
  mm08098_Hspg2
gggaggacgaggattcaatg

SEQ ID NO: 1635 - DNA, 20 bp, Artificial Sequence
  sgRNA
  mm08099_Hspg2
tactatggggatgcccaacg

SEQ ID NO: 1636 - DNA, 20 bp, Artificial Sequence
  sgRNA
  mm08100_Hspg2
gtgcgctatgaactggcacg

SEQ ID NO: 1637 - DNA, 20 bp, Artificial Sequence
  sgRNA
  mm08129_Htr2c
tattgatattgcccaaacga

SEQ ID NO: 1638 - DNA, 20 bp, Artificial Sequence
  sgRNA
  mm08130_Htr2c
acatcagggtttgacggcgt

SEQ ID NO: 1639 - DNA, 20 bp, Artificial Sequence
  sgRNA
  mm08131_Htr2c
aaacaagcgtccaccatcgg

SEQ ID NO: 1640 - DNA, 20 bp, Artificial Sequence
  sgRNA
  mm08132_Htr2c
aagaaagaaaagcggcctag

SEQ ID NO: 1641 - DNA, 20 bp, Artificial Sequence
  sgRNA
  mm08133_Htr3a
cctggctaactacaagaagg

SEQ ID NO: 1642 - DNA, 20 bp, Artificial Sequence
  sgRNA
  mm08134_Htr3a
ctgccggtaccatatgtagg

SEQ ID NO: 1643 - DNA, 20 bp, Artificial Sequence
  sgRNA
  mm08135_Htr3a
ggactcacaactcattgatg

SEQ ID NO: 1644 - DNA, 20 bp, Artificial Sequence
  sgRNA
  mm08136_Htr3a
aggacatcaacattaccctg

SEQ ID NO: 1645 - DNA, 20 bp, Artificial Sequence
  sgRNA
  mm08185_Hyal2
aaagttgcggctgtgtacgg

SEQ ID NO: 1646 - DNA, 20 bp, Artificial Sequence
  sgRNA
  mm08186_Hyal2
gaacactctccgttacgtca

SEQ ID NO: 1647 - DNA, 20 bp, Artificial Sequence
  sgRNA
  mm08187_Hyal2
gggacgcgtgaagacgtaca

SEQ ID NO: 1648 - DNA, 20 bp, Artificial Sequence
  sgRNA
  mm08188_Hyal2
accttctactacgaccgtct

SEQ ID NO: 1649 - DNA, 20 bp, Artificial Sequence
  sgRNA
  mm08201_Icam1
gtgaagtgtgaagcccacag

SEQ ID NO: 1650 - DNA, 20 bp, Artificial Sequence
  sgRNA
  mm08202_Icam1
gccctgccactcacaataca

SEQ ID NO: 1651 - DNA, 20 bp, Artificial Sequence
  sgRNA
  mm08203_Icam1
gagaacaatgccagcccttg

SEQ ID NO: 1652 - DNA, 20 bp, Artificial Sequence
  sgRNA
  mm08204_Icam1
gcggtgctccaccatccacg

SEQ ID NO: 1653 - DNA, 20 bp, Artificial Sequence
  sgRNA
  mm08205_Icam2
tcttcacccacaaacacccg

SEQ ID NO: 1654 - DNA, 20 bp, Artificial Sequence
  sgRNA
  mm08206_Icam2
ggaccatatgtagacctcaa

SEQ ID NO: 1655 - DNA, 20 bp, Artificial Sequence
  sgRNA
  mm08207_Icam2
aactgcgcagccccagacat

SEQ ID NO: 1656 - DNA, 20 bp, Artificial Sequence
  sgRNA
  mm08208_Icam2
atgttggaagagcatcctca

SEQ ID NO: 1657 - DNA, 20 bp, Artificial Sequence
  sgRNA
  mm08269_Cxcl10
actcacatgatctcaacacg

SEQ ID NO: 1658 - DNA, 20 bp, Artificial Sequence
  sgRNA
  mm08270_Cxcl10
cagcggaccgtccttgcgag

SEQ ID NO: 1659 - DNA, 20 bp, Artificial Sequence
  sgRNA
  mm08271_Cxcl10
actgcatccatatcgatgac

SEQ ID NO: 1660 - DNA, 20 bp, Artificial Sequence
  sgRNA
  mm08272_Cxcl10
tgacgggccagtgagaatga

SEQ ID NO: 1661 - DNA, 20 bp, Artificial Sequence
  sgRNA
  mm08333_Ifnar1
acagttgacataaacaagca

SEQ ID NO: 1662 - DNA, 20 bp, Artificial Sequence
  sgRNA
  mm08334_Ifnar1
cttctaaacgtacttctggg

SEQ ID NO: 1663 - DNA, 20 bp, Artificial Sequence
  sgRNA
  mm08335_Ifnar1
tctccatgtacaagcctcag

SEQ ID NO: 1664 - DNA, 20 bp, Artificial Sequence
  sgRNA
  mm08336_Ifnar1
gtgcagtgtataagcaccac

SEQ ID NO: 1665 - DNA, 20 bp, Artificial Sequence
  sgRNA
  mm08337_Ifnar2
caaagacgaaaatctgacga

SEQ ID NO: 1666 - DNA, 20 bp, Artificial Sequence
  sgRNA
  mm08338_Ifnar2
gccatcgtcatagtgcacag

SEQ ID NO: 1667 - DNA, 20 bp, Artificial Sequence
  sgRNA
  mm08339_Ifnar2
taacctggataatccctgaa

SEQ ID NO: 1668 - DNA, 20 bp, Artificial Sequence
  sgRNA
  mm08340_Ifnar2
actgtggaattacgattatg

SEQ ID NO: 1669 - DNA, 20 bp, Artificial Sequence
  sgRNA
  mm08345_Ifng
tctatgccacttgagttctg

SEQ ID NO: 1670 - DNA, 20 bp, Artificial Sequence
  sgRNA
  mm08346_Ifng
gtttctggctgttactgcca

SEQ ID NO: 1671 - DNA, 20 bp, Artificial Sequence
  sgRNA
  mm08347_Ifng
tgctgaagaaggtagtaatc

SEQ ID NO: 1672 - DNA, 20 bp, Artificial Sequence
  sgRNA
  mm08348_Ifng
tcaagacttcaaagagtctg

SEQ ID NO: 1673 - DNA, 20 bp, Artificial Sequence
  sgRNA
  mm08365_Cd79b
tgacctggttccgaaagcga

SEQ ID NO: 1674 - DNA, 20 bp, Artificial Sequence
  sgRNA
  mm08366_Cd79b
tcccccaggattcagcacgt

SEQ ID NO: 1675 - DNA, 20 bp, Artificial Sequence
  sgRNA
  mm08367_Cd79b
cataatgtcaccgacagctg

SEQ ID NO: 1676 - DNA, 20 bp, Artificial Sequence
  sgRNA
  mm08368_Cd79b
cgaggtttgcagccaaaaag

SEQ ID NO: 1677 - DNA, 20 bp, Artificial Sequence
  sgRNA
  mm08373_Igf1r
agaaccgaatcatcataacg

SEQ ID NO: 1678 - DNA, 20 bp, Artificial Sequence
  sgRNA
  mm08374_Igf1r
ggaaaacgaccatatccgtg

SEQ ID NO: 1679 - DNA, 20 bp, Artificial Sequence
  sgRNA
  mm08375_Igf1r
ctatggtggagaggtaacag

SEQ ID NO: 1680 - DNA, 20 bp, Artificial Sequence
  sgRNA
  mm08376_Igf1r
ctgcttattaacatccggag

SEQ ID NO: 1681 - DNA, 20 bp, Artificial Sequence
  sgRNA
  mm08381_Igf2r
aggacattgactccacacga

SEQ ID NO: 1682 - DNA, 20 bp, Artificial Sequence
  sgRNA
  mm08382_Igf2r
tgaaaatgaactatactggg

SEQ ID NO: 1683 - DNA, 20 bp, Artificial Sequence
  sgRNA
  mm08383_Igf2r
gtcacaccgtctgtccactg

SEQ ID NO: 1684 - DNA, 20 bp, Artificial Sequence
  sgRNA
  mm08384_Igf2r
ggacagacgaggatcagtgt

SEQ ID NO: 1685 - DNA, 20 bp, Artificial Sequence
  sgRNA
  mm08401_Igfbp3
ggcgtctacacggagcgctg

SEQ ID NO: 1686 - DNA, 20 bp, Artificial Sequence
  sgRNA
  mm08402_Igfbp3
acggttcgcagcgcaccacg

SEQ ID NO: 1687 - DNA, 20 bp, Artificial Sequence
  sgRNA
  mm08403_Igfbp3
ggaacttggaatcggtcact

SEQ ID NO: 1688 - DNA, 20 bp, Artificial Sequence
  sgRNA
  mm08404_Igfbp3
ccgaggaggagcacaatgct

SEQ ID NO: 1689 - DNA, 20 bp, Artificial Sequence
  sgRNA
  mm08425_Igll1
ctgttccagatcatcccacg

SEQ ID NO: 1690 - DNA, 20 bp, Artificial Sequence
  sgRNA
  mm08426_Igll1
gctcaccaaacacactagtg

SEQ ID NO: 1691 - DNA, 20 bp, Artificial Sequence
  sgRNA
  mm08427_Igll1
ccaaagacataccaaaactg

SEQ ID NO: 1692 - DNA, 20 bp, Artificial Sequence
  sgRNA
  mm08428_Igll1
ggagaacttcacactgcctg

SEQ ID NO: 1693 - DNA, 20 bp, Artificial Sequence
  sgRNA
  mm08437_Cd74
gctgatgcgtccaatgtcca

SEQ ID NO: 1694 - DNA, 20 bp, Artificial Sequence
  sgRNA
  mm08438_Cd74
ccatgtgatgcatctgctca

SEQ ID NO: 1695 - DNA, 20 bp, Artificial Sequence
  sgRNA
  mm08439_Cd74
catggatggcgtgaactgga

SEQ ID NO: 1696 - DNA, 20 bp, Artificial Sequence
  sgRNA
  mm08440_Cd74
agccgtggagctctgtacac

SEQ ID NO: 1697 - DNA, 20 bp, Artificial Sequence
  sgRNA
  mm08457_Il10rb
tggcggatgaacattcggag

SEQ ID NO: 1698 - DNA, 20 bp, Artificial Sequence
  sgRNA
  mm08458_Il10rb
atttcaagaacattctacag

SEQ ID NO: 1699 - DNA, 20 bp, Artificial Sequence
  sgRNA
  mm08459_Il10rb
cggaggacctcagagtcgta

SEQ ID NO: 1700 - DNA, 20 bp, Artificial Sequence
  sgRNA
  mm08460_Il10rb
agagaagtcgcactgagtcg

SEQ ID NO: 1701 - DNA, 20 bp, Artificial Sequence
  sgRNA
  mm08473_Il12rb1
gtcggtgaggaaccaaaccg

SEQ ID NO: 1702 - DNA, 20 bp, Artificial Sequence
  sgRNA
  mm08474_Il12rb1
cctccgaaccatacccacac

SEQ ID NO: 1703 - DNA, 20 bp, Artificial Sequence
  sgRNA
  mm08475_Il12rb1
tgagaagacatcgttcccag

SEQ ID NO: 1704 - DNA, 20 bp, Artificial Sequence
  sgRNA
  mm08476_Il12rb1
tcaaggtgtcacaatcacac

SEQ ID NO: 1705 - DNA, 20 bp, Artificial Sequence
  sgRNA
  mm08477_Il12rb2
actgagaacacgaacaccag

SEQ ID NO: 1706 - DNA, 20 bp, Artificial Sequence
  sgRNA
  mm08478_Il12rb2
attaacatagtggacctatg

SEQ ID NO: 1707 - DNA, 20 bp, Artificial Sequence
  sgRNA
  mm08479_Il12rb2
agagcagacatgttgtccgg

SEQ ID NO: 1708 - DNA, 20 bp, Artificial Sequence
  sgRNA
  mm08480_Il12rb2
ctatcaggtgacgttacaag

SEQ ID NO: 1709 - DNA, 20 bp, Artificial Sequence
  sgRNA
  mm08481_Il13
accatgctgccgttgcacag

SEQ ID NO: 1710 - DNA, 20 bp, Artificial Sequence
  sgRNA
  mm08482_Il13
agagacacagatcttggcac

SEQ ID NO: 1711 - DNA, 20 bp, Artificial Sequence
  sgRNA
  mm08483_Il13
agatgttggtcagggaatcc

SEQ ID NO: 1712 - DNA, 20 bp, Artificial Sequence
  sgRNA
  mm08484_Il13
caggttccttaccccgccag

SEQ ID NO: 1713 - DNA, 20 bp, Artificial Sequence
  sgRNA
  mm08493_Il15
atatcttacatctatccagt

SEQ ID NO: 1714 - DNA, 20 bp, Artificial Sequence
  sgRNA
  mm08494_Il15
gaaacacaagtagcacgaga

SEQ ID NO: 1715 - DNA, 20 bp, Artificial Sequence
  sgRNA
  mm08495_Il15
aatgtgtactcacttgaata

SEQ ID NO: 1716 - DNA, 20 bp, Artificial Sequence
  sgRNA
  mm08496_Il15
gtcactgtcagtgtataaag

SEQ ID NO: 1717 - DNA, 20 bp, Artificial Sequence
  sgRNA
  mm08505_Il17a
ctcagcgtgtccaaacactg

SEQ ID NO: 1718 - DNA, 20 bp, Artificial Sequence
  sgRNA
  mm08506_Il17a
gaacggttgaggtagtctga

SEQ ID NO: 1719 - DNA, 20 bp, Artificial Sequence
  sgRNA
  mm08507_Il17a
cttacgtactggagagtcca

SEQ ID NO: 1720 - DNA, 20 bp, Artificial Sequence
  sgRNA
  mm08508_Il17a
ctgagcttcccagatcacag

SEQ ID NO: 1721 - DNA, 20 bp, Artificial Sequence
  sgRNA
  mm08509_Il17ra
actgaagtagcaaacaacgt

SEQ ID NO: 1722 - DNA, 20 bp, Artificial Sequence
  sgRNA
  mm08510_Il17ra
atgaggccatacacccacag

SEQ ID NO: 1723 - DNA, 20 bp, Artificial Sequence
  sgRNA
  mm08511_Il17ra
gaaggtctggatcgtctact

SEQ ID NO: 1724 - DNA, 20 bp, Artificial Sequence
  sgRNA
  mm08512_Il17ra
gacctggagatgtttgaacc

SEQ ID NO: 1725 - DNA, 20 bp, Artificial Sequence
  sgRNA
  mm08521_Il1a
atgtatgcctactcgtcggg

SEQ ID NO: 1726 - DNA, 20 bp, Artificial Sequence
  sgRNA
  mm08522_Il1a
ttacctgattcagagagaga

SEQ ID NO: 1727 - DNA, 20 bp, Artificial Sequence
  sgRNA
  mm08523_Il1a
tccataacccatgatctgga

SEQ ID NO: 1728 - DNA, 20 bp, Artificial Sequence
  sgRNA
  mm08524_Il1a
ggacatctttgacgtttcag

SEQ ID NO: 1729 - DNA, 20 bp, Artificial Sequence
  sgRNA
  mm08529_Il1r1
agcatacaattgtagccgtg

SEQ ID NO: 1730 - DNA, 20 bp, Artificial Sequence
  sgRNA
  mm08530_Il1r1
cagcaagacccccatatcag

SEQ ID NO: 1731 - DNA, 20 bp, Artificial Sequence
  sgRNA
  mm08531_Il1r1
cgtatgtcctatacgttccg

SEQ ID NO: 1732 - DNA, 20 bp, Artificial Sequence
  sgRNA
  mm08532_Il1r1
actgtgttagagaatgaccc

SEQ ID NO: 1733 - DNA, 20 bp, Artificial Sequence
  sgRNA
  mm08533_Il1r2
tgtcggagtgaggtgccaag

SEQ ID NO: 1734 - DNA, 20 bp, Artificial Sequence
  sgRNA
  mm08534_Il1r2
agggcacactagtaacccgg

SEQ ID NO: 1735 - DNA, 20 bp, Artificial Sequence
  sgRNA
  mm08535_Il1r2
gactatcagtcttgaccctg

SEQ ID NO: 1736 - DNA, 20 bp, Artificial Sequence
  sgRNA
  mm08536_Il1r2
gggcttctccgatgtaatgg

SEQ ID NO: 1737 - DNA, 20 bp, Artificial Sequence
  sgRNA
  mm08541_Il1rap
tacacagtagaactcgcctg

SEQ ID NO: 1738 - DNA, 20 bp, Artificial Sequence
  sgRNA
  mm08542_Il1rap
tttcataatgtactacccga

SEQ ID NO: 1739 - DNA, 20 bp, Artificial Sequence
  sgRNA
  mm08543_Il1rap
tggtccaccagacctcattg

SEQ ID NO: 1740 - DNA, 20 bp, Artificial Sequence
  sgRNA
  mm08544_Il1rap
catcaagaaagtcaccccgg

SEQ ID NO: 1741 - DNA, 20 bp, Artificial Sequence
  sgRNA
  mm08549_Il18r1
tcaccgatcacaaattcatg

SEQ ID NO: 1742 - DNA, 20 bp, Artificial Sequence
  sgRNA
  mm08550_Il18r1
ctgtccaccataatgggaca

SEQ ID NO: 1743 - DNA, 20 bp, Artificial Sequence
  sgRNA
  mm08551_Il18r1
attctggccagttgagatgg

SEQ ID NO: 1744 - DNA, 20 bp, Artificial Sequence
  sgRNA
  mm08552_Il18r1
tgtcaacttctatctaggaa

SEQ ID NO: 1745 - DNA, 20 bp, Artificial Sequence
  sgRNA
  mm08557_Il2ra
gtgtctgtatgacccacccg

SEQ ID NO: 1746 - DNA, 20 bp, Artificial Sequence
  sgRNA
  mm08558_Il2ra
atcttgcagatgctaatagc

SEQ ID NO: 1747 - DNA, 20 bp, Artificial Sequence
  sgRNA
  mm08559_Il2ra
gagaggtttccgaagactaa

SEQ ID NO: 1748 - DNA, 20 bp, Artificial Sequence
  sgRNA
  mm08560_Il2ra
gaatcttcatgtttccaagg

SEQ ID NO: 1749 - DNA, 20 bp, Artificial Sequence
  sgRNA
  mm08561_Il2rb
ggacctccttgacataaatg

SEQ ID NO: 1750 - DNA, 20 bp, Artificial Sequence
  sgRNA
  mm08562_Il2rb
tctccgtcgagcacttccag

SEQ ID NO: 1751 - DNA, 20 bp, Artificial Sequence
  sgRNA
  mm08563_Il2rb
aagctcaacgaaacaatacc

SEQ ID NO: 1752 - DNA, 20 bp, Artificial Sequence
  sgRNA
  mm08564_Il2rb
aggtatctgagccatgacat

SEQ ID NO: 1753 - DNA, 20 bp, Artificial Sequence
  sgRNA
  mm08565_Il2rg
ttccacagattgggttatag

SEQ ID NO: 1754 - DNA, 20 bp, Artificial Sequence
  sgRNA
  mm08566_Il2rg
ggagcaacagagatcgaagc

SEQ ID NO: 1755 - DNA, 20 bp, Artificial Sequence
  sgRNA
  mm08567_Il2rg
cccgattaccaagattctgt

SEQ ID NO: 1756 - DNA, 20 bp, Artificial Sequence
  sgRNA
  mm08568_Il2rg
catacctatagtgcagcgtg

SEQ ID NO: 1757 - DNA, 20 bp, Artificial Sequence
  sgRNA
  mm08573_Il3ra
ttgcactccactgtcaacgt

SEQ ID NO: 1758 - DNA, 20 bp, Artificial Sequence
  sgRNA
  mm08574_Il3ra
ggatgttctggcgtgatgtg

SEQ ID NO: 1759 - DNA, 20 bp, Artificial Sequence
  sgRNA
  mm08575_Il3ra
gacaacagctgcggtccgtg

SEQ ID NO: 1760 - DNA, 20 bp, Artificial Sequence
  sgRNA
  mm08576_Il3ra
cggcgctgacatcacgacag

SEQ ID NO: 1761 - DNA, 20 bp, Artificial Sequence
  sgRNA
  mm08577_Il4
cagagagtgagctcgtctgt

SEQ ID NO: 1762 - DNA, 20 bp, Artificial Sequence
  sgRNA
  mm08578_Il4
tgtaccaggagccatatcca

SEQ ID NO: 1763 - DNA, 20 bp, Artificial Sequence
  sgRNA
  mm08579_Il4
ctagagttcttcttcaagca

SEQ ID NO: 1764 - DNA, 20 bp, Artificial Sequence
  sgRNA
  mm08580_Il4
aatcacttgagagagatcat

SEQ ID NO: 1765 - DNA, 20 bp, Artificial Sequence
  sgRNA
  mm08593_Il6
tataccacttcacaagtcgg

SEQ ID NO: 1766 - DNA, 20 bp, Artificial Sequence
  sgRNA
  mm08594_Il6
cctacttcacaagtccggag

SEQ ID NO: 1767 - DNA, 20 bp, Artificial Sequence
  sgRNA
  mm08595_Il6
atggtactccagaagaccag

SEQ ID NO: 1768 - DNA, 20 bp, Artificial Sequence
  sgRNA
  mm08596_Il6
acatgttctctgggaaatcg

SEQ ID NO: 1769 - DNA, 20 bp, Artificial Sequence
  sgRNA
  mm08597_Il6ra
ctgtgcgttgcaaacagtgt

SEQ ID NO: 1770 - DNA, 20 bp, Artificial Sequence
  sgRNA
  mm08598_Il6ra
ggggcaaatcagggtaacgg

SEQ ID NO: 1771 - DNA, 20 bp, Artificial Sequence
  sgRNA
  mm08599_Il6ra
caggtatggctgataccaca

SEQ ID NO: 1772 - DNA, 20 bp, Artificial Sequence
  sgRNA
  mm08600_Il6ra
caccccctctccaaccacga

SEQ ID NO: 1773 - DNA, 20 bp, Artificial Sequence
  sgRNA
  mm08601_Il6st
taactcccgtattcgccacg

SEQ ID NO: 1774 - DNA, 20 bp, Artificial Sequence
  sgRNA
  mm08602_Il6st
tctaagtacctttatccacg

SEQ ID NO: 1775 - DNA, 20 bp, Artificial Sequence
  sgRNA
  mm08603_Il6st
atccggtccattaaggacag

SEQ ID NO: 1776 - DNA, 20 bp, Artificial Sequence
  sgRNA
  mm08604_Il6st
gagtagtgatacgttgtaca

SEQ ID NO: 1777 - DNA, 20 bp, Artificial Sequence
  sgRNA
  mm08609_Il7r
gggagactaggccatacgac

SEQ ID NO: 1778 - DNA, 20 bp, Artificial Sequence
  sgRNA
  mm08610_Il7r
agacctagaagatgcagacg

SEQ ID NO: 1779 - DNA, 20 bp, Artificial Sequence
  sgRNA
  mm08611_Il7r
cagaacccaagaatcaaggt

SEQ ID NO: 1780 - DNA, 20 bp, Artificial Sequence
  sgRNA
  mm08612_Il7r
cctttgaagtaatcgttatg

SEQ ID NO: 1781 - DNA, 20 bp, Artificial Sequence
  sgRNA
  mm08637_Lrig1
gtagcgaacctaagactgtg

SEQ ID NO: 1782 - DNA, 20 bp, Artificial Sequence
  sgRNA
  mm08638_Lrig1
tgtccttcaacaacctcacg

SEQ ID NO: 1783 - DNA, 20 bp, Artificial Sequence
  sgRNA
  mm08639_Lrig1
ggtacaatcgaggataccag

SEQ ID NO: 1784 - DNA, 20 bp, Artificial Sequence
  sgRNA
  mm08640_Lrig1
gagcatttgatggtctgtcg

SEQ ID NO: 1785 - DNA, 20 bp, Artificial Sequence
  sgRNA
  mm08705_Insr
cgaggattacctgcacaacg

SEQ ID NO: 1786 - DNA, 20 bp, Artificial Sequence
  sgRNA
  mm08706_Insr
gtgataccagagcataggag

SEQ ID NO: 1787 - DNA, 20 bp, Artificial Sequence
  sgRNA
  mm08707_Insr
cacactgcacctctcatctg

SEQ ID NO: 1788 - DNA, 20 bp, Artificial Sequence
  sgRNA
  mm08708_Insr
tatagccagacgggcactcg

SEQ ID NO: 1789 - DNA, 20 bp, Artificial Sequence
  sgRNA
  mm08773_Itga2
tggccagtataatttgctcg

SEQ ID NO: 1790 - DNA, 20 bp, Artificial Sequence
  sgRNA
  mm08774_Itga2
tacaactacaacatccacga

SEQ ID NO: 1791 - DNA, 20 bp, Artificial Sequence
  sgRNA
  mm08775_Itga2
tcagagctatcgaattcgca

SEQ ID NO: 1792 - DNA, 20 bp, Artificial Sequence
  sgRNA
  mm08776_Itga2
tttcaatgtggccgacgaag

SEQ ID NO: 1793 - DNA, 20 bp, Artificial Sequence
  sgRNA
  mm08777_Itga2b
gcctatctgccacaccacgg

SEQ ID NO: 1794 - DNA, 20 bp, Artificial Sequence
  sgRNA
  mm08778_Itga2b
gccacaaaagggtacccggg

SEQ ID NO: 1795 - DNA, 20 bp, Artificial Sequence
  sgRNA
  mm08779_Itga2b
cctacacagcgtgtccatcg

SEQ ID NO: 1796 - DNA, 20 bp, Artificial Sequence
  sgRNA
  mm08780_Itga2b
cgatgtctacagcaccacga

SEQ ID NO: 1797 - DNA, 20 bp, Artificial Sequence
  sgRNA
  mm08781_Itga3
ggctatggagaatcacactg

SEQ ID NO: 1798 - DNA, 20 bp, Artificial Sequence
  sgRNA
  mm08782_Itga3
gtgggcaagtgctatgtgcg

SEQ ID NO: 1799 - DNA, 20 bp, Artificial Sequence
  sgRNA
  mm08783_Itga3
gtacacagcaccagtccggt

SEQ ID NO: 1800 - DNA, 20 bp, Artificial Sequence
  sgRNA
  mm08784_Itga3
aggtagctgtacaaagcgca

SEQ ID NO: 1801 - DNA, 20 bp, Artificial Sequence
  sgRNA
  mm08785_Itga5
tttgctgtcaaattgaatgg

SEQ ID NO: 1802 - DNA, 20 bp, Artificial Sequence
  sgRNA
  mm08786_Itga5
gtcttacatagccataggtg

SEQ ID NO: 1803 - DNA, 20 bp, Artificial Sequence
  sgRNA
  mm08787_Itga5
gacccacagaatgacccagt

SEQ ID NO: 1804 - DNA, 20 bp, Artificial Sequence
  sgRNA
  mm08788_Itga5
gtcgtatttatattcccggg

SEQ ID NO: 1805 - DNA, 20 bp, Artificial Sequence
  sgRNA
  mm08789_Itga6
gaggggacatcgccttactt

SEQ ID NO: 1806 - DNA, 20 bp, Artificial Sequence
  sgRNA
  mm08790_Itga6
gcagagggcgaacagaacag

SEQ ID NO: 1807 - DNA, 20 bp, Artificial Sequence
  sgRNA
  mm08791_Itga6
gagtatatatttgacggaga

SEQ ID NO: 1808 - DNA, 20 bp, Artificial Sequence
  sgRNA
  mm08792_Itga6
ggagactggagtttctgcga

SEQ ID NO: 1809 - DNA, 20 bp, Artificial Sequence
  sgRNA
  mm08793_Itga7
ggttcggagaccatatgaca

SEQ ID NO: 1810 - DNA, 20 bp, Artificial Sequence
  sgRNA
  mm08794_Itga7
gtgtatgtgtacatgaacca

SEQ ID NO: 1811 - DNA, 20 bp, Artificial Sequence
  sgRNA
  mm08795_Itga7
cccactcaatgcgaacaggg

SEQ ID NO: 1812 - DNA, 20 bp, Artificial Sequence
  sgRNA
  mm08796_Itga7
cttagattatatgttagatg

SEQ ID NO: 1813 - DNA, 20 bp, Artificial Sequence
  sgRNA
  mm08797_Itgae
tactcaccaaaacaccattg

SEQ ID NO: 1814 - DNA, 20 bp, Artificial Sequence
  sgRNA
  mm08798_Itgae
tccttctatccgtcgcacaa

SEQ ID NO: 1815 - DNA, 20 bp, Artificial Sequence
  sgRNA
  mm08799_Itgae
atacggtcaggtcaaccaca

SEQ ID NO: 1816 - DNA, 20 bp, Artificial Sequence
  sgRNA
  mm08800_Itgae
ctgtgcgagttgatattgaa

SEQ ID NO: 1817 - DNA, 20 bp, Artificial Sequence
  sgRNA
  mm08801_Itgal
cataacccgctacatcatcg

SEQ ID NO: 1818 - DNA, 20 bp, Artificial Sequence
  sgRNA
  mm08802_Itgal
cgctgcctagcagaacatcg

SEQ ID NO: 1819 - DNA, 20 bp, Artificial Sequence
  sgRNA
  mm08803_Itgal
gaaacacggagtcaagctca

SEQ ID NO: 1820 - DNA, 20 bp, Artificial Sequence
  sgRNA
  mm08804_Itgal
aacaccaagggaccaaaagg

SEQ ID NO: 1821 - DNA, 20 bp, Artificial Sequence
  sgRNA
  mm08805_Itgam
agggatgaccctgatcaccg

SEQ ID NO: 1822 - DNA, 20 bp, Artificial Sequence
  sgRNA
  mm08806_Itgam
tgggcgcctatgatccgctg

SEQ ID NO: 1823 - DNA, 20 bp, Artificial Sequence
  sgRNA
  mm08807_Itgam
cctgcgcctcaattatacac

SEQ ID NO: 1824 - DNA, 20 bp, Artificial Sequence
  sgRNA
  mm08808_Itgam
ggtcattcgctacgtaattg

SEQ ID NO: 1825 - DNA, 20 bp, Artificial Sequence
  sgRNA
  mm08809_Itgav
ggtgccatctcaaatcctcg

SEQ ID NO: 1826 - DNA, 20 bp, Artificial Sequence
  sgRNA
  mm08810_Itgav
tcatggaccgaggttccgat

SEQ ID NO: 1827 - DNA, 20 bp, Artificial Sequence
  sgRNA
  mm08811_Itgav
cctgcatggagcatactcaa

SEQ ID NO: 1828 - DNA, 20 bp, Artificial Sequence
  sgRNA
  mm08812_Itgav
ataataaccaattagcaaca

SEQ ID NO: 1829 - DNA, 20 bp, Artificial Sequence
  sgRNA
  mm08813_Itgax
ccatgaatacgtattcagcg

SEQ ID NO: 1830 - DNA, 20 bp, Artificial Sequence
  sgRNA
  mm08814_Itgax
tcttcaaggagacaaagacc

SEQ ID NO: 1831 - DNA, 20 bp, Artificial Sequence
  sgRNA
  mm08815_Itgax
catgacatgcttgatagccg

SEQ ID NO: 1832 - DNA, 20 bp, Artificial Sequence
  sgRNA
  mm08816_Itgax
tacaaatgtggctatcacac

SEQ ID NO: 1833 - DNA, 20 bp, Artificial Sequence
  sgRNA
  mm08817_Itgb1
gaggaatgtaacacgactgc

SEQ ID NO: 1834 - DNA, 20 bp, Artificial Sequence
  sgRNA
  mm08818_Itgb1
tcccaacattcctaccaatg

SEQ ID NO: 1835 - DNA, 20 bp, Artificial Sequence
  sgRNA
  mm08819_Itgb1
ggaaatgggacatttgagtg

SEQ ID NO: 1836 - DNA, 20 bp, Artificial Sequence
  sgRNA
  mm08820_Itgb1
gcaattgaaggataatccta

SEQ ID NO: 1837 - DNA, 20 bp, Artificial Sequence
  sgRNA
  mm08825_Itgb2
gagtataggcaaatcccgtg

SEQ ID NO: 1838 - DNA, 20 bp, Artificial Sequence
  sgRNA
  mm08826_Itgb2
ttggctggcgcaatgtcacg

SEQ ID NO: 1839 - DNA, 20 bp, Artificial Sequence
  sgRNA
  mm08827_Itgb2
atcctgagttcgaccaacgg

SEQ ID NO: 1840 - DNA, 20 bp, Artificial Sequence
  sgRNA
  mm08828_Itgb2
tggagtaggagagatccatg

SEQ ID NO: 1841 - DNA, 20 bp, Artificial Sequence
  sgRNA
  mm08833_Itgb3
gcaggtggaggattaccccg

SEQ ID NO: 1842 - DNA, 20 bp, Artificial Sequence
  sgRNA
  mm08834_Itgb3
aatatgggtcttggcatccg

SEQ ID NO: 1843 - DNA, 20 bp, Artificial Sequence
  sgRNA
  mm08835_Itgb3
ttctccttcaggttacatcg

SEQ ID NO: 1844 - DNA, 20 bp, Artificial Sequence
  sgRNA
  mm08836_Itgb3
cgatacaggcttgtccacga

SEQ ID NO: 1845 - DNA, 20 bp, Artificial Sequence
  sgRNA
  mm08841_Itgb5
caaaagacccgaaacctaag

SEQ ID NO: 1846 - DNA, 20 bp, Artificial Sequence
  sgRNA
  mm08842_Itgb5
ccgcatcaaaccccccctcg

SEQ ID NO: 1847 - DNA, 20 bp, Artificial Sequence
  sgRNA
  mm08843_Itgb5
gaaccactatatgctctaca

SEQ ID NO: 1848 - DNA, 20 bp, Artificial Sequence
  sgRNA
  mm08844_Itgb5
tgctgagaggtaggttccgg

SEQ ID NO: 1849 - DNA, 20 bp, Artificial Sequence
  sgRNA
  mm08845_Itgb6
tgtctacactaaaggaactg

SEQ ID NO: 1850 - DNA, 20 bp, Artificial Sequence
  sgRNA
  mm08846_Itgb6
tgaggtaatacagatctact

SEQ ID NO: 1851 - DNA, 20 bp, Artificial Sequence
  sgRNA
  mm08847_Itgb6
atgggtcctcactgcgagtg

SEQ ID NO: 1852 - DNA, 20 bp, Artificial Sequence
  sgRNA
  mm08848_Itgb6
tttggctaaaagattcgctg

SEQ ID NO: 1853 - DNA, 20 bp, Artificial Sequence
  sgRNA
  mm08849_Itgb7
acagtgtgcgactgtaactg

SEQ ID NO: 1854 - DNA, 20 bp, Artificial Sequence
  sgRNA
  mm08850_Itgb7
cgtgacgcggatccgctgcg

SEQ ID NO: 1855 - DNA, 20 bp, Artificial Sequence
  sgRNA
  mm08851_Itgb7
gtggctgacaacgctccagt

SEQ ID NO: 1856 - DNA, 20 bp, Artificial Sequence
  sgRNA
  mm08852_Itgb7
tgatgtccgagtcaaccaga

SEQ ID NO: 1857 - DNA, 20 bp, Artificial Sequence
  sgRNA
  mm08853_Cd47
atcagcctgttcttacgagg

SEQ ID NO: 1858 - DNA, 20 bp, Artificial Sequence
  sgRNA
  mm08854_Cd47
ggataagcgcgatgccatgg

SEQ ID NO: 1859 - DNA, 20 bp, Artificial Sequence
  sgRNA
  mm08855_Cd47
cacttcatgcaatgaaactg

SEQ ID NO: 1860 - DNA, 20 bp, Artificial Sequence
  sgRNA
  mm08856_Cd47
gaatgattctcttattcgta

SEQ ID NO: 1861 - DNA, 20 bp, Artificial Sequence
  sgRNA
  mm08881_Stt3a
aaggtggtacgtaacgatgg

SEQ ID NO: 1862 - DNA, 20 bp, Artificial Sequence
  sgRNA
  mm08882_Stt3a
taccatgtagaaataagcga

SEQ ID NO: 1863 - DNA, 20 bp, Artificial Sequence
  sgRNA
  mm08883_Stt3a
gtttacctggaaaccaacaa

SEQ ID NO: 1864 - DNA, 20 bp, Artificial Sequence
  sgRNA
  mm08884_Stt3a
actttaattatcggactacc

SEQ ID NO: 1865 - DNA, 20 bp, Artificial Sequence
  sgRNA
  mm08901_Itpr1
ctgtgaaatatgcccgactg

SEQ ID NO: 1866 - DNA, 20 bp, Artificial Sequence
  sgRNA
  mm08902_Itpr1
acacgaacgatgtcatcgag

SEQ ID NO: 1867 - DNA, 20 bp, Artificial Sequence
  sgRNA
  mm08903_Itpr1
aaacgtgtcaatctctgccg

SEQ ID NO: 1868 - DNA, 20 bp, Artificial Sequence
  sgRNA
  mm08904_Itpr1
ggaagctgagaactccacag

SEQ ID NO: 1869 - DNA, 20 bp, Artificial Sequence
  sgRNA
  mm08921_Jag1
tctgacccctgccataaccg

SEQ ID NO: 1870 - DNA, 20 bp, Artificial Sequence
  sgRNA
  mm08922_Jag1
gaagccacgtgtaataatgg

SEQ ID NO: 1871 - DNA, 20 bp, Artificial Sequence
  sgRNA
  mm08923_Jag1
tgacttacgtacccgacagg

SEQ ID NO: 1872 - DNA, 20 bp, Artificial Sequence
  sgRNA
  mm08924_Jag1
actggcacgattgtagcact

SEQ ID NO: 1873 - DNA, 20 bp, Artificial Sequence
  sgRNA
  mm08941_F11r
aggtggccagaactacgggg

SEQ ID NO: 1874 - DNA, 20 bp, Artificial Sequence
  sgRNA
  mm08942_F11r
gtggagtggaagttcgtcca

SEQ ID NO: 1875 - DNA, 20 bp, Artificial Sequence
  sgRNA
  mm08943_F11r
ttgaaccaggaatattcaga

SEQ ID NO: 1876 - DNA, 20 bp, Artificial Sequence
  sgRNA
  mm08944_F11r
cactattgatccaaagtcgg

SEQ ID NO: 1877 - DNA, 20 bp, Artificial Sequence
  sgRNA
  mm08981_Kcna1
cgacacaatggcaataaccc

SEQ ID NO: 1878 - DNA, 20 bp, Artificial Sequence
  sgRNA
  mm08982_Kcna1
ttctgaacacccttaccaag

SEQ ID NO: 1879 - DNA, 20 bp, Artificial Sequence
  sgRNA
  mm08983_Kcna1
ggactggtagtaataaagga

SEQ ID NO: 1880 - DNA, 20 bp, Artificial Sequence
  sgRNA
  mm08984_Kcna1
cgcagcattcgtggtcgtcg

SEQ ID NO: 1881 - DNA, 20 bp, Artificial Sequence
  sgRNA
  mm08993_Kcna4
ccaccatcatcagacacgtg

SEQ ID NO: 1882 - DNA, 20 bp, Artificial Sequence
  sgRNA
  mm08994_Kcna4
tgtacgaacacccatcccca

SEQ ID NO: 1883 - DNA, 20 bp, Artificial Sequence
  sgRNA
  mm08995_Kcna4
tggagacagtgtgtattgtg

SEQ ID NO: 1884 - DNA, 20 bp, Artificial Sequence
  sgRNA
  mm08996_Kcna4
caatggctatacccctggca

SEQ ID NO: 1885 - DNA, 20 bp, Artificial Sequence
  sgRNA
  mm09021_Kcnb1
gtgcgacgactacagcctcg

SEQ ID NO: 1886 - DNA, 20 bp, Artificial Sequence
  sgRNA
  mm09022_Kcnb1
ggagaagcccaactcatcgg

SEQ ID NO: 1887 - DNA, 20 bp, Artificial Sequence
  sgRNA
  mm09023_Kcnb1
agccaggagctggactactg

SEQ ID NO: 1888 - DNA, 20 bp, Artificial Sequence
  sgRNA
  mm09024_Kcnb1
catcgagatgatggacatcg

SEQ ID NO: 1889 - DNA, 20 bp, Artificial Sequence
  sgRNA
  mm09025_Kcnc1
ccatgatctactacgccgag

SEQ ID NO: 1890 - DNA, 20 bp, Artificial Sequence
  sgRNA
  mm09026_Kcnc1
agacgccctcgatgtaggtg

SEQ ID NO: 1891 - DNA, 20 bp, Artificial Sequence
  sgRNA
  mm09027_Kcnc1
tgtgagcgaagacgcccggg

SEQ ID NO: 1892 - DNA, 20 bp, Artificial Sequence
  sgRNA
  mm09028_Kcnc1
cctactcatcccgctacgcg

SEQ ID NO: 1893 - DNA, 20 bp, Artificial Sequence
  sgRNA
  mm09045_Kcnh1
ttacatcgagtatggagccg

SEQ ID NO: 1894 - DNA, 20 bp, Artificial Sequence
  sgRNA
  mm09046_Kcnh1
ctgtgtctttaagaccacgt

SEQ ID NO: 1895 - DNA, 20 bp, Artificial Sequence
  sgRNA
  mm09047_Kcnh1
tctctccagcatgatagatg

SEQ ID NO: 1896 - DNA, 20 bp, Artificial Sequence
  sgRNA
  mm09048_Kcnh1
atcttcacaaaaaaccacac

SEQ ID NO: 1897 - DNA, 20 bp, Artificial Sequence
  sgRNA
  mm09049_Kcnh2
ggcctgcgcgatctgcgcgg

SEQ ID NO: 1898 - DNA, 20 bp, Artificial Sequence
  sgRNA
  mm09050_Kcnh2
ctgccccgtactccgagtag

SEQ ID NO: 1899 - DNA, 20 bp, Artificial Sequence
  sgRNA
  mm09051_Kcnh2
cacctatgttaatgccaacg

SEQ ID NO: 1900 - DNA, 20 bp, Artificial Sequence
  sgRNA
  mm09052_Kcnh2
cggatgacattgaggcaatg

SEQ ID NO: 1901 - DNA, 20 bp, Artificial Sequence
  sgRNA
  mm09081_Kcnj5
ccacgtgatccagatcacct

SEQ ID NO: 1902 - DNA, 20 bp, Artificial Sequence
  sgRNA
  mm09082_Kcnj5
acaatgccgtcatctccatg

SEQ ID NO: 1903 - DNA, 20 bp, Artificial Sequence
  sgRNA
  mm09083_Kcnj5
ggcaagtgcaatgtacacca

SEQ ID NO: 1904 - DNA, 20 bp, Artificial Sequence
  sgRNA
  mm09084_Kcnj5
attaacaatcgagcccagaa

SEQ ID NO: 1905 - DNA, 20 bp, Artificial Sequence
  sgRNA
  mm09085_Kcnj6
accagactgatatcaacgtg

SEQ ID NO: 1906 - DNA, 20 bp, Artificial Sequence
  sgRNA
  mm09086_Kcnj6
ggtgacacaaggagtccacg

SEQ ID NO: 1907 - DNA, 20 bp, Artificial Sequence
  sgRNA
  mm09087_Kcnj6
ggaaaatccagaggtacgtg

SEQ ID NO: 1908 - DNA, 20 bp, Artificial Sequence
  sgRNA
  mm09088_Kcnj6
gacccggtagccataaccga

SEQ ID NO: 1909 - DNA, 20 bp, Artificial Sequence
  sgRNA
  mm09101_Kcnk2
atagtggcagcaataaacgc

SEQ ID NO: 1910 - DNA, 20 bp, Artificial Sequence
  sgRNA
  mm09102_Kcnk2
ctgctcagaactccaaaccg

SEQ ID NO: 1911 - DNA, 20 bp, Artificial Sequence
  sgRNA
  mm09103_Kcnk2
cattggatttggagactacg

SEQ ID NO: 1912 - DNA, 20 bp, Artificial Sequence
  sgRNA
  mm09104_Kcnk2
aacatctccccacgaactga

SEQ ID NO: 1913 - DNA, 20 bp, Artificial Sequence
  sgRNA
  mm09121_Kcnma1
atacgggggctcctatagcg

SEQ ID NO: 1914 - DNA, 20 bp, Artificial Sequence
  sgRNA
  mm09122_Kcnma1
agtctatgaagtatattacg

SEQ ID NO: 1915 - DNA, 20 bp, Artificial Sequence
  sgRNA
  mm09123_Kcnma1
cattgccaggaattaacaag

SEQ ID NO: 1916 - DNA, 20 bp, Artificial Sequence
  sgRNA
  mm09124_Kcnma1
tgtccacgttaccacgcaca

SEQ ID NO: 1917 - DNA, 20 bp, Artificial Sequence
  sgRNA
  mm09141_Kcnq2
ccacgtggcagtactacgag

SEQ ID NO: 1918 - DNA, 20 bp, Artificial Sequence
  sgRNA
  mm09142_Kcnq2
atcgcgggccacttacacgt

SEQ ID NO: 1919 - DNA, 20 bp, Artificial Sequence
  sgRNA
  mm09143_Kcnq2
atgatccgtatggaccggag

SEQ ID NO: 1920 - DNA, 20 bp, Artificial Sequence
  sgRNA
  mm09144_Kcnq2
caagactctgatccgcactg

SEQ ID NO: 1921 - DNA, 20 bp, Artificial Sequence
  sgRNA
  mm09157_Kdr
ttacccgcttaacggtccgt

SEQ ID NO: 1922 - DNA, 20 bp, Artificial Sequence
  sgRNA
  mm09158_Kdr
atacgtttgagaacctcacg

SEQ ID NO: 1923 - DNA, 20 bp, Artificial Sequence
  sgRNA
  mm09159_Kdr
ttgtaaagaatggagacacg

SEQ ID NO: 1924 - DNA, 20 bp, Artificial Sequence
  sgRNA
  mm09160_Kdr
catagctgatcatgtaactg

SEQ ID NO: 1925 - DNA, 20 bp, Artificial Sequence
  sgRNA
  mm09221_Kif21b
tcgcctgatcaactcccagg

SEQ ID NO: 1926 - DNA, 20 bp, Artificial Sequence
  sgRNA
  mm09222_Kif21b
ggagttgatggagtacaaag

SEQ ID NO: 1927 - DNA, 20 bp, Artificial Sequence
  sgRNA
  mm09223_Kif21b
cctcatgaagcaaatgcgtg

SEQ ID NO: 1928 - DNA, 20 bp, Artificial Sequence
  sgRNA
  mm09224_Kif21b
accccattcgcagaaaaggg

SEQ ID NO: 1929 - DNA, 20 bp, Artificial Sequence
  sgRNA
  mm09281_Kit
aagcacaatagctggcaccg

SEQ ID NO: 1930 - DNA, 20 bp, Artificial Sequence
  sgRNA
  mm09282_Kit
acacgtaaatagaactcgtg

SEQ ID NO: 1931 - DNA, 20 bp, Artificial Sequence
  sgRNA
  mm09283_Kit
agatttggttgttgaatacg

SEQ ID NO: 1932 - DNA, 20 bp, Artificial Sequence
  sgRNA
  mm09284_Kit
tggttgcagctggcgcgatg

SEQ ID NO: 1933 - DNA, 20 bp, Artificial Sequence
  sgRNA
  mm09373_Klra1
gcagaaacaagtgagacctg

SEQ ID NO: 1934 - DNA, 20 bp, Artificial Sequence
  sgRNA
  mm09374_Klra1
tcgtcatggacagaaaaaca

SEQ ID NO: 1935 - DNA, 20 bp, Artificial Sequence
  sgRNA
  mm09375_Klra1
tgatcaacaaaaaaaactgc

SEQ ID NO: 1936 - DNA, 20 bp, Artificial Sequence
  sgRNA
  mm09376_Klra1
ctgaaacagctaccagaaga

SEQ ID NO: 1937 - DNA, 20 bp, Artificial Sequence
  sgRNA
  mm09381_Klra2
tgacctggtactcttgacgg

SEQ ID NO: 1938 - DNA, 20 bp, Artificial Sequence
  sgRNA
  mm09382_Klra2
aggatgtaaacagatctgcc

SEQ ID NO: 1939 - DNA, 20 bp, Artificial Sequence
  sgRNA
  mm09383_Klra2
gttgtaggcaagcaagtgga

SEQ ID NO: 1940 - DNA, 20 bp, Artificial Sequence
  sgRNA
  mm09384_Klra2
cagggttgcagaacccagtg

SEQ ID NO: 1941 - DNA, 20 bp, Artificial Sequence
  sgRNA
  mm09389_Klra4
acatactgtgtgataaaacc

SEQ ID NO: 1942 - DNA, 20 bp, Artificial Sequence
  sgRNA
  mm09390_Klra4
cctgaaaaagctcgcctcag

SEQ ID NO: 1943 - DNA, 20 bp, Artificial Sequence
  sgRNA
  mm09391_Klra4
cagggttgcagaacgagatg

SEQ ID NO: 1944 - DNA, 20 bp, Artificial Sequence
  sgRNA
  mm09392_Klra4
ctgcaacagttaccagtcga

SEQ ID NO: 1945 - DNA, 20 bp, Artificial Sequence
  sgRNA
  mm09401_Klra7
agttgacgtcactttgcgtg

SEQ ID NO: 1946 - DNA, 20 bp, Artificial Sequence
  sgRNA
  mm09402_Klra7
tcttctggaatccctcagca

SEQ ID NO: 1947 - DNA, 20 bp, Artificial Sequence
  sgRNA
  mm09403_Klra7
aaaatgttattatttcaaca

SEQ ID NO: 1948 - DNA, 20 bp, Artificial Sequence
  sgRNA
  mm09404_Klra7
gcagaaactagtgaggactg

SEQ ID NO: 1949 - DNA, 20 bp, Artificial Sequence
  sgRNA
  mm09413_Klrc1
gacaaaacagatgaggccca

SEQ ID NO: 1950 - DNA, 20 bp, Artificial Sequence
  sgRNA
  mm09414_Klrc1
atgactgaaatggagctgcg

SEQ ID NO: 1951 - DNA, 20 bp, Artificial Sequence
  sgRNA
  mm09415_Klrc1
ccagtggctcacctttgcag

SEQ ID NO: 1952 - DNA, 20 bp, Artificial Sequence
  sgRNA
  mm09416_Klrc1
aaaagcatgcttacatggtg

SEQ ID NO: 1953 - DNA, 20 bp, Artificial Sequence
  sgRNA
  mm09417_Klrc2
tcacacgccttgctctccaa

SEQ ID NO: 1954 - DNA, 20 bp, Artificial Sequence
  sgRNA
  mm09418_Klrc2
aatcttggaatgacagtttg

SEQ ID NO: 1955 - DNA, 20 bp, Artificial Sequence
  sgRNA
  mm09419_Klrc2
tctgggttctaaccaagaag

SEQ ID NO: 1956 - DNA, 20 bp, Artificial Sequence
  sgRNA
  mm09420_Klrc2
actgaaacggaactgcgcct

SEQ ID NO: 1957 - DNA, 20 bp, Artificial Sequence
  sgRNA
  mm09421_Klrd1
accttcctggaattctacag

SEQ ID NO: 1958 - DNA, 20 bp, Artificial Sequence
  sgRNA
  mm09422_Klrd1
tttgcctggacaagtgggtt

SEQ ID NO: 1959 - DNA, 20 bp, Artificial Sequence
  sgRNA
  mm09423_Klrd1
ttgccaattcatttctggat

SEQ ID NO: 1960 - DNA, 20 bp, Artificial Sequence
  sgRNA
  mm09424_Klrd1
tttccaaagaagaaaagtct

SEQ ID NO: 1961 - DNA, 20 bp, Artificial Sequence
  sgRNA
  mm09537_Krt4
gagtcctctatgaagcggtg

SEQ ID NO: 1962 - DNA, 20 bp, Artificial Sequence
  sgRNA
  mm09538_Krt4
agaagtctttacaacctcgg

SEQ ID NO: 1963 - DNA, 20 bp, Artificial Sequence
  sgRNA
  mm09539_Krt4
tctgctcacgctccgccgtg

SEQ ID NO: 1964 - DNA, 20 bp, Artificial Sequence
  sgRNA
  mm09540_Krt4
ggctccttcaacggtcgagg

SEQ ID NO: 1965 - DNA, 20 bp, Artificial Sequence
  sgRNA
  mm09597_L1cam
catccagtagatcctaagtg

SEQ ID NO: 1966 - DNA, 20 bp, Artificial Sequence
  sgRNA
  mm09598_L1cam
gtccaggcagtgaacaacca

SEQ ID NO: 1967 - DNA, 20 bp, Artificial Sequence
  sgRNA
  mm09599_L1cam
tcagcgttccattggcatag

SEQ ID NO: 1968 - DNA, 20 bp, Artificial Sequence
  sgRNA
  mm09600_L1cam
accctgcaactactcaatgt

SEQ ID NO: 1969 - DNA, 20 bp, Artificial Sequence
  sgRNA
  mm09613_Lag3
gatcctaactttctacgaag

SEQ ID NO: 1970 - DNA, 20 bp, Artificial Sequence
  sgRNA
  mm09614_Lag3
gagagaagtccccgcgctgg

SEQ ID NO: 1971 - DNA, 20 bp, Artificial Sequence
  sgRNA
  mm09615_Lag3
tcagcagcgtacactgtcag

SEQ ID NO: 1972 - DNA, 20 bp, Artificial Sequence
  sgRNA
  mm09616_Lag3
gtttcagctaaaaaatgacg

SEQ ID NO: 1973 - DNA, 20 bp, Artificial Sequence
  sgRNA
  mm09625_Lama1
atgtagctgctcaatgaacg

SEQ ID NO: 1974 - DNA, 20 bp, Artificial Sequence
  sgRNA
  mm09626_Lama1
ggaaacccaaccgtgccagg

SEQ ID NO: 1975 - DNA, 20 bp, Artificial Sequence
  sgRNA
  mm09627_Lama1
gctacaaaataactccacgg

SEQ ID NO: 1976 - DNA, 20 bp, Artificial Sequence
  sgRNA
  mm09628_Lama1
cttgaaggaacgaaaccccg

SEQ ID NO: 1977 - DNA, 20 bp, Artificial Sequence
  sgRNA
  mm09629_Lama2
gatgagaaatatgcccagcg

SEQ ID NO: 1978 - DNA, 20 bp, Artificial Sequence
  sgRNA
  mm09630_Lama2
atgacgtggagtacaaaccc

SEQ ID NO: 1979 - DNA, 20 bp, Artificial Sequence
  sgRNA
  mm09631_Lama2
ttgttgctgggcgaaatcag

SEQ ID NO: 1980 - DNA, 20 bp, Artificial Sequence
  sgRNA
  mm09632_Lama2
gagtgtcctattgggtacac

SEQ ID NO: 1981 - DNA, 20 bp, Artificial Sequence
  sgRNA
  mm09637_Lama4
aaagatacagataaacaact

SEQ ID NO: 1982 - DNA, 20 bp, Artificial Sequence
  sgRNA
  mm09638_Lama4
gtctgcagacatactcagag

SEQ ID NO: 1983 - DNA, 20 bp, Artificial Sequence
  sgRNA
  mm09639_Lama4
ggaagctaacaagacgacag

SEQ ID NO: 1984 - DNA, 20 bp, Artificial Sequence
  sgRNA
  mm09640_Lama4
atccgaacaccagctgacaa

SEQ ID NO: 1985 - DNA, 20 bp, Artificial Sequence
  sgRNA
  mm09641_Lama5
cctacagcatcgagtaacgg

SEQ ID NO: 1986 - DNA, 20 bp, Artificial Sequence
  sgRNA
  mm09642_Lama5
ggccgttaataccacccggg

SEQ ID NO: 1987 - DNA, 20 bp, Artificial Sequence
  sgRNA
  mm09643_Lama5
gatgtgaccagtgtcgcgtg

SEQ ID NO: 1988 - DNA, 20 bp, Artificial Sequence
  sgRNA
  mm09644_Lama5
ctgccagccctaccaaacag

SEQ ID NO: 1989 - DNA, 20 bp, Artificial Sequence
  sgRNA
  mm09645_Lamb2
acaacttgcttgacccacgg

SEQ ID NO: 1990 - DNA, 20 bp, Artificial Sequence
  sgRNA
  mm09646_Lamb2
gcagcggtagcgttcaaagg

SEQ ID NO: 1991 - DNA, 20 bp, Artificial Sequence
  sgRNA
  mm09647_Lamb2
taagtggaggcgtatgcgat

SEQ ID NO: 1992 - DNA, 20 bp, Artificial Sequence
  sgRNA
  mm09648_Lamb2
cagaggccctacctgcaatg

SEQ ID NO: 1993 - DNA, 20 bp, Artificial Sequence
  sgRNA
  mm09657_Lamp1
accattcgcagtctcgtagg

SEQ ID NO: 1994 - DNA, 20 bp, Artificial Sequence
  sgRNA
  mm09658_Lamp1
gcccaaatgacacatctagt

SEQ ID NO: 1995 - DNA, 20 bp, Artificial Sequence
  sgRNA
  mm09659_Lamp1
cattgtacttggatacagtg

SEQ ID NO: 1996 - DNA, 20 bp, Artificial Sequence
  sgRNA
  mm09660_Lamp1
ctcttccaaaagtaattgtg

SEQ ID NO: 1997 - DNA, 20 bp, Artificial Sequence
  sgRNA
  mm09661_Lamp2
gagtgtagttgtagtcgacg

SEQ ID NO: 1998 - DNA, 20 bp, Artificial Sequence
  sgRNA
  mm09662_Lamp2
cctgacaaggcgacacacga

SEQ ID NO: 1999 - DNA, 20 bp, Artificial Sequence
  sgRNA
  mm09663_Lamp2
cacttaaagatgacatccaa

SEQ ID NO: 2000 - DNA, 20 bp, Artificial Sequence
  sgRNA
  mm09664_Lamp2
gctgcagctgaacatcactg

SEQ ID NO: 2001 - DNA, 20 bp, Artificial Sequence
  sgRNA
  mm09669_Anpep
agagcgtactgagtacctgg

SEQ ID NO: 2002 - DNA, 20 bp, Artificial Sequence
  sgRNA
  mm09670_Anpep
gtccatgatagtgcgcaccg

SEQ ID NO: 2003 - DNA, 20 bp, Artificial Sequence
  sgRNA
  mm09671_Anpep
agcacccagatattccacgt

SEQ ID NO: 2004 - DNA, 20 bp, Artificial Sequence
  sgRNA
  mm09672_Anpep
gaccagggagctctcacggt

SEQ ID NO: 2005 - DNA, 20 bp, Artificial Sequence
  sgRNA
  mm09673_Large
gatgtgtctgatttaaaggt

SEQ ID NO: 2006 - DNA, 20 bp, Artificial Sequence
  sgRNA
  mm09674_Large
cagcaatagaatcagcaatg

SEQ ID NO: 2007 - DNA, 20 bp, Artificial Sequence
  sgRNA
  mm09675_Large
gcaggtaacagctctgagtg

SEQ ID NO: 2008 - DNA, 20 bp, Artificial Sequence
  sgRNA
  mm09676_Large
acagcagagagggaactcat

SEQ ID NO: 2009 - DNA, 20 bp, Artificial Sequence
  sgRNA
  mm09693_Lbp
acccagcctggtgataaacc

SEQ ID NO: 2010 - DNA, 20 bp, Artificial Sequence
  sgRNA
  mm09694_Lbp
gtggccaggatcaccgacaa

SEQ ID NO: 2011 - DNA, 20 bp, Artificial Sequence
  sgRNA
  mm09695_Lbp
gtgcacatatcaggaaatgt

SEQ ID NO: 2012 - DNA, 20 bp, Artificial Sequence
  sgRNA
  mm09696_Lbp
tccgattaaaaatttcaccc

SEQ ID NO: 2013 - DNA, 20 bp, Artificial Sequence
  sgRNA
  mm09753_Ldlr
aaaatgcatcgctagcaagt

SEQ ID NO: 2014 - DNA, 20 bp, Artificial Sequence
  sgRNA
  mm09754_Ldlr
ggtgtcgtaggacaagttag

SEQ ID NO: 2015 - DNA, 20 bp, Artificial Sequence
  sgRNA
  mm09755_Ldlr
gcagactggtgtactcgctg

SEQ ID NO: 2016 - DNA, 20 bp, Artificial Sequence
  sgRNA
  mm09756_Ldlr
tgaccgtgaacatgactgca

SEQ ID NO: 2017 - DNA, 20 bp, Artificial Sequence
  sgRNA
  mm09777_Lfng
ggcgatgaagacgtcgcgag

SEQ ID NO: 2018 - DNA, 20 bp, Artificial Sequence
  sgRNA
  mm09778_Lfng
agacgcggatccaccgcccg

SEQ ID NO: 2019 - DNA, 20 bp, Artificial Sequence
  sgRNA
  mm09779_Lfng
cacacccaagacgtgtacat

SEQ ID NO: 2020 - DNA, 20 bp, Artificial Sequence
  sgRNA
  mm09780_Lfng
ggagaggctatgcacctcgc

SEQ ID NO: 2021 - DNA, 20 bp, Artificial Sequence
  sgRNA
  mm09781_Lgals1
tctccatgggcattgaagcg

SEQ ID NO: 2022 - DNA, 20 bp, Artificial Sequence
  sgRNA
  mm09782_Lgals1
ccagcccgggagcatcacag

SEQ ID NO: 2023 - DNA, 20 bp, Artificial Sequence
  sgRNA
  mm09783_Lgals1
ggtgttacacacaatggtgt

SEQ ID NO: 2024 - DNA, 20 bp, Artificial Sequence
  sgRNA
  mm09784_Lgals1
tctcaaagttcggggagagg

SEQ ID NO: 2025 - DNA, 20 bp, Artificial Sequence
  sgRNA
  mm09785_Lgals3
tctggaaacccaaaccctca

SEQ ID NO: 2026 - DNA, 20 bp, Artificial Sequence
  sgRNA
  mm09786_Lgals3
attgttctagatttcaggag

SEQ ID NO: 2027 - DNA, 20 bp, Artificial Sequence
  sgRNA
  mm09787_Lgals3
ccatgattgtgatcagcatg

SEQ ID NO: 2028 - DNA, 20 bp, Artificial Sequence
  sgRNA
  mm09788_Lgals3
ttcttaccagtggtccagcg

SEQ ID NO: 2029 - DNA, 20 bp, Artificial Sequence
  sgRNA
  mm09809_Lhcgr
tatacataaccaccatacca

SEQ ID NO: 2030 - DNA, 20 bp, Artificial Sequence
  sgRNA
  mm09810_Lhcgr
aacctgctatacattgaacc

SEQ ID NO: 2031 - DNA, 20 bp, Artificial Sequence
  sgRNA
  mm09811_Lhcgr
gtggctagggtaggtcagcg

SEQ ID NO: 2032 - DNA, 20 bp, Artificial Sequence
  sgRNA
  mm09812_Lhcgr
gaccagtcgttataaactga

SEQ ID NO: 2033 - DNA, 20 bp, Artificial Sequence
  sgRNA
  mm09849_Lifr
cgacgatgtgtacggaacgg

SEQ ID NO: 2034 - DNA, 20 bp, Artificial Sequence
  sgRNA
  mm09850_Lifr
catttgcacgcctaaccggt

SEQ ID NO: 2035 - DNA, 20 bp, Artificial Sequence
  sgRNA
  mm09851_Lifr
tcacagtagagcaagcggtg

SEQ ID NO: 2036 - DNA, 20 bp, Artificial Sequence
  sgRNA
  mm09852_Lifr
tgtttcgtgttcattgaacg

SEQ ID NO: 2037 - DNA, 20 bp, Artificial Sequence
  sgRNA
  mm09873_Lipg
cggatgttaaaagccacaga

SEQ ID NO: 2038 - DNA, 20 bp, Artificial Sequence
  sgRNA
  mm09874_Lipg
gaaagatgctaacgtcgtgg

SEQ ID NO: 2039 - DNA, 20 bp, Artificial Sequence
  sgRNA
  mm09875_Lipg
aaggggtggacatcaacaga

SEQ ID NO: 2040 - DNA, 20 bp, Artificial Sequence
  sgRNA
  mm09876_Lipg
aagaaccgttgtaataacat

SEQ ID NO: 2041 - DNA, 20 bp, Artificial Sequence
  sgRNA
  mm09953_Anxa1
gtgcaaggcagcaacatccg

SEQ ID NO: 2042 - DNA, 20 bp, Artificial Sequence
  sgRNA
  mm09954_Anxa1
caagctgtaaaatcatacaa

SEQ ID NO: 2043 - DNA, 20 bp, Artificial Sequence
  sgRNA
  mm09955_Anxa1
gtacttacaggagaatggaa

SEQ ID NO: 2044 - DNA, 20 bp, Artificial Sequence
  sgRNA
  mm09956_Anxa1
gctcctgctggtcagaattg

SEQ ID NO: 2045 - DNA, 20 bp, Artificial Sequence
  sgRNA
  mm09957_Lpl
gaaaaacgtaccgtctgctg

SEQ ID NO: 2046 - DNA, 20 bp, Artificial Sequence
  sgRNA
  mm09958_Lpl
ccatccatggatcaccacga

SEQ ID NO: 2047 - DNA, 20 bp, Artificial Sequence
  sgRNA
  mm09959_Lpl
tggattccaatacttcgacc

SEQ ID NO: 2048 - DNA, 20 bp, Artificial Sequence
  sgRNA
  mm09960_Lpl
tgacactggataatgttgct

SEQ ID NO: 2049 - DNA, 20 bp, Artificial Sequence
  sgRNA
  mm09973_Lrp1
gctgcggaacagtaccacgt

SEQ ID NO: 2050 - DNA, 20 bp, Artificial Sequence
  sgRNA
  mm09974_Lrp1
aaatgccgggtaaataacgg

SEQ ID NO: 2051 - DNA, 20 bp, Artificial Sequence
  sgRNA
  mm09975_Lrp1
actgcgtcttacccagactg

SEQ ID NO: 2052 - DNA, 20 bp, Artificial Sequence
  sgRNA
  mm09976_Lrp1
tgacggtagcgatgattgcg

SEQ ID NO: 2053 - DNA, 20 bp, Artificial Sequence
  sgRNA
  mm09977_Lrp5
cgtgtactggaccgacgatg

SEQ ID NO: 2054 - DNA, 20 bp, Artificial Sequence
  sgRNA
  mm09978_Lrp5
tgggaccaattgtatgacac

SEQ ID NO: 2055 - DNA, 20 bp, Artificial Sequence
  sgRNA
  mm09979_Lrp5
ggagactaacaacaacgatg

SEQ ID NO: 2056 - DNA, 20 bp, Artificial Sequence
  sgRNA
  mm09980_Lrp5
tgggtgagtacagagcacta

SEQ ID NO: 2057 - DNA, 20 bp, Artificial Sequence
  sgRNA
  mm09981_Lrp6
ggatctaacacgatagcccg

SEQ ID NO: 2058 - DNA, 20 bp, Artificial Sequence
  sgRNA
  mm09982_Lrp6
ttgccttagatccatcaagt

SEQ ID NO: 2059 - DNA, 20 bp, Artificial Sequence
  sgRNA
  mm09983_Lrp6
tgtgtcctcaaataacgtca

SEQ ID NO: 2060 - DNA, 20 bp, Artificial Sequence
  sgRNA
  mm09984_Lrp6
gttgttcatcaatcaccatg

SEQ ID NO: 2061 - DNA, 20 bp, Artificial Sequence
  sgRNA
  mm09985_Lrpap1
agactgcgcagtatcaacca

SEQ ID NO: 2062 - DNA, 20 bp, Artificial Sequence
  sgRNA
  mm09986_Lrpap1
ctgacctgaagatacaagag

SEQ ID NO: 2063 - DNA, 20 bp, Artificial Sequence
  sgRNA
  mm09987_Lrpap1
agaataggaaggtaccgttg

SEQ ID NO: 2064 - DNA, 20 bp, Artificial Sequence
  sgRNA
  mm09988_Lrpap1
cgccaagcgcgagtccgggg

SEQ ID NO: 2065 - DNA, 20 bp, Artificial Sequence
  sgRNA
  mm09997_Lrrn1
cactacggaaagccaaacgg

SEQ ID NO: 2066 - DNA, 20 bp, Artificial Sequence
  sgRNA
  mm09998_Lrrn1
ccatgccaccggaatacagg

SEQ ID NO: 2067 - DNA, 20 bp, Artificial Sequence
  sgRNA
  mm09999_Lrrn1
gaggtcattacaatccacgg

SEQ ID NO: 2068 - DNA, 20 bp, Artificial Sequence
  sgRNA
  mm10000_Lrrn1
tgggagtggaatcaaaccag

SEQ ID NO: 2069 - DNA, 20 bp, Artificial Sequence
  sgRNA
  mm10025_Ltb
aggtaatagacgccgtcctg

SEQ ID NO: 2070 - DNA, 20 bp, Artificial Sequence
  sgRNA
  mm10026_Ltb
gataggcactgccaacaaca

SEQ ID NO: 2071 - DNA, 20 bp, Artificial Sequence
  sgRNA
  mm10027_Ltb
tgttgcgcagtcctctcggg

SEQ ID NO: 2072 - DNA, 20 bp, Artificial Sequence
  sgRNA
  mm10028_Ltb
acccgacgtccctgatcctg

SEQ ID NO: 2073 - DNA, 20 bp, Artificial Sequence
  sgRNA
  mm10033_Ltbr
ggaagtgtcccggcttacag

SEQ ID NO: 2074 - DNA, 20 bp, Artificial Sequence
  sgRNA
  mm10034_Ltbr
ctcattgtccagatacacac

SEQ ID NO: 2075 - DNA, 20 bp, Artificial Sequence
  sgRNA
  mm10035_Ltbr
tgttcattataggaattatg

SEQ ID NO: 2076 - DNA, 20 bp, Artificial Sequence
  sgRNA
  mm10036_Ltbr
agctccaggtacctcctact

SEQ ID NO: 2077 - DNA, 20 bp, Artificial Sequence
  sgRNA
  mm10041_Ltf
aacctgagtatggctcctcg

SEQ ID NO: 2078 - DNA, 20 bp, Artificial Sequence
  sgRNA
  mm10042_Ltf
agaagcgcaagtgtgatcag

SEQ ID NO: 2079 - DNA, 20 bp, Artificial Sequence
  sgRNA
  mm10043_Ltf
gatgccatgactcttgatgg

SEQ ID NO: 2080 - DNA, 20 bp, Artificial Sequence
  sgRNA
  mm10044_Ltf
agttaccaaataaagccgaa

SEQ ID NO: 2081 - DNA, 20 bp, Artificial Sequence
  sgRNA
  mm10049_Lum
aacaacctgaccgagtccgt

SEQ ID NO: 2082 - DNA, 20 bp, Artificial Sequence
  sgRNA
  mm10050_Lum
atttgcccatacatgaagag

SEQ ID NO: 2083 - DNA, 20 bp, Artificial Sequence
  sgRNA
  mm10051_Lum
taaaggtacttgatgccagg

SEQ ID NO: 2084 - DNA, 20 bp, Artificial Sequence
  sgRNA
  mm10052_Lum
tctgattgaagctcaaatcc

SEQ ID NO: 2085 - DNA, 20 bp, Artificial Sequence
  sgRNA
  mm10065_Klrb1c
gagatgcaacacttaactgg

SEQ ID NO: 2086 - DNA, 20 bp, Artificial Sequence
  sgRNA
  mm10066_Klrb1c
tcctgggtggctttaaaccg

SEQ ID NO: 2087 - DNA, 20 bp, Artificial Sequence
  sgRNA
  mm10067_Klrb1c
taagacactcatcccaatca

SEQ ID NO: 2088 - DNA, 20 bp, Artificial Sequence
  sgRNA
  mm10068_Klrb1c
gaggaaggtcaagctgactg

SEQ ID NO: 2089 - DNA, 20 bp, Artificial Sequence
  sgRNA
  mm10077_Cd93
actccaggaatatttcactg

SEQ ID NO: 2090 - DNA, 20 bp, Artificial Sequence
  sgRNA
  mm10078_Cd93
gcctgctatacagcccattg

SEQ ID NO: 2091 - DNA, 20 bp, Artificial Sequence
  sgRNA
  mm10079_Cd93
tgggttggttaccaacccag

SEQ ID NO: 2092 - DNA, 20 bp, Artificial Sequence
  sgRNA
  mm10080_Cd93
agtggcatgagagtccctgt

SEQ ID NO: 2093 - DNA, 20 bp, Artificial Sequence
  sgRNA
  mm10081_Ly6c1
cacaagaagaatgagcacac

SEQ ID NO: 2094 - DNA, 20 bp, Artificial Sequence
  sgRNA
  mm10082_Ly6c1
ccctgattggcacaccagca

SEQ ID NO: 2095 - DNA, 20 bp, Artificial Sequence
  sgRNA
  mm10083_Ly6c1
gcagaaagaaaggcactgac

SEQ ID NO: 2096 - DNA, 20 bp, Artificial Sequence
  sgRNA
  mm10084_Ly6c1
actgtgtgcagaaagaggtg

SEQ ID NO: 2097 - DNA, 20 bp, Artificial Sequence
  sgRNA
  mm10085_Ly6d
ctggcagcattgtgtgacct

SEQ ID NO: 2098 - DNA, 20 bp, Artificial Sequence
  sgRNA
  mm10086_Ly6d
tgccaactgtaagaaccctc

SEQ ID NO: 2099 - DNA, 20 bp, Artificial Sequence
  sgRNA
  mm10087_Ly6d
cacgtgacatcgaagtgccc

SEQ ID NO: 2100 - DNA, 20 bp, Artificial Sequence
  sgRNA
  mm10088_Ly6d
acctccgactacagccagca

SEQ ID NO: 2101 - DNA, 20 bp, Artificial Sequence
  sgRNA
  mm10097_Epcam
cggagtccgaagaaccgaca

SEQ ID NO: 2102 - DNA, 20 bp, Artificial Sequence
  sgRNA
  mm10098_Epcam
gggcgatccagaacaacgat

SEQ ID NO: 2103 - DNA, 20 bp, Artificial Sequence
  sgRNA
  mm10099_Epcam
gataacattattctcatact

SEQ ID NO: 2104 - DNA, 20 bp, Artificial Sequence
  sgRNA
  mm10100_Epcam
gcaagctctgatggtcgtag

SEQ ID NO: 2105 - DNA, 20 bp, Artificial Sequence
  sgRNA
  mm10101_Ly75
gtcacgaaactccataatgg

SEQ ID NO: 2106 - DNA, 20 bp, Artificial Sequence
  sgRNA
  mm10102_Ly75
taagctgtgtccgccagacg

SEQ ID NO: 2107 - DNA, 20 bp, Artificial Sequence
  sgRNA
  mm10103_Ly75
gcttgcttgagaaaacgtaa

SEQ ID NO: 2108 - DNA, 20 bp, Artificial Sequence
  sgRNA
  mm10104_Ly75
tcctgtgaacgatgttatcg

SEQ ID NO: 2109 - DNA, 20 bp, Artificial Sequence
  sgRNA
  mm10105_Cd180
aacacgaagagacttgagct

SEQ ID NO: 2110 - DNA, 20 bp, Artificial Sequence
  sgRNA
  mm10106_Cd180
gtctctgccataaatatcag

SEQ ID NO: 2111 - DNA, 20 bp, Artificial Sequence
  sgRNA
  mm10107_Cd180
ttcacagagaccctcaaaca

SEQ ID NO: 2112 - DNA, 20 bp, Artificial Sequence
  sgRNA
  mm10108_Cd180
acattgcaggaatagagctg

SEQ ID NO: 2113 - DNA, 20 bp, Artificial Sequence
  sgRNA
  mm10109_Il1rl1
cacttgtcaattcacacacg

SEQ ID NO: 2114 - DNA, 20 bp, Artificial Sequence
  sgRNA
  mm10110_Il1rl1
accagttatccttaacactg

SEQ ID NO: 2115 - DNA, 20 bp, Artificial Sequence
  sgRNA
  mm10111_Il1rl1
ttgatgtactcgacagtacg

SEQ ID NO: 2116 - DNA, 20 bp, Artificial Sequence
  sgRNA
  mm10112_Il1rl1
aggacgctcgacttatcctg

SEQ ID NO: 2117 - DNA, 20 bp, Artificial Sequence
  sgRNA
  mm10121_Ly9
tgcaggtatagggtaggtcg

SEQ ID NO: 2118 - DNA, 20 bp, Artificial Sequence
  sgRNA
  mm10122_Ly9
gaaacaatgtgacatacaca

SEQ ID NO: 2119 - DNA, 20 bp, Artificial Sequence
  sgRNA
  mm10123_Ly9
cgagtggcccgaaattccaa

SEQ ID NO: 2120 - DNA, 20 bp, Artificial Sequence
  sgRNA
  mm10124_Ly9
acagattccacgatgatctg

SEQ ID NO: 2121 - DNA, 20 bp, Artificial Sequence
  sgRNA
  mm10157_Tm4sf1
tgctgcggctacgaaaacta

SEQ ID NO: 2122 - DNA, 20 bp, Artificial Sequence
  sgRNA
  mm10158_Tm4sf1
atcccaatgaacacaaacgc

SEQ ID NO: 2123 - DNA, 20 bp, Artificial Sequence
  sgRNA
  mm10159_Tm4sf1
ggagacaaagtatgctacgg

SEQ ID NO: 2124 - DNA, 20 bp, Artificial Sequence
  sgRNA
  mm10160_Tm4sf1
ggtgtagttccatactccat

SEQ ID NO: 2125 - DNA, 20 bp, Artificial Sequence
  sgRNA
  mm10161_M6pr
atcatgctgatatataaagg

SEQ ID NO: 2126 - DNA, 20 bp, Artificial Sequence
  sgRNA
  mm10162_M6pr
ggataaggagtcaaagaacg

SEQ ID NO: 2127 - DNA, 20 bp, Artificial Sequence
  sgRNA
  mm10163_M6pr
aggagatcatcaccactgca

SEQ ID NO: 2128 - DNA, 20 bp, Artificial Sequence
  sgRNA
  mm10164_M6pr
ggctgctatccatctcaaag

SEQ ID NO: 2129 - DNA, 20 bp, Artificial Sequence
  sgRNA
  mm10301_Man1a2
agtggagtaggtcgaaactg

SEQ ID NO: 2130 - DNA, 20 bp, Artificial Sequence
  sgRNA
  mm10302_Man1a2
aattacagaacatacggatg

SEQ ID NO: 2131 - DNA, 20 bp, Artificial Sequence
  sgRNA
  mm10303_Man1a2
ctgacaggtaatatgcagcg

SEQ ID NO: 2132 - DNA, 20 bp, Artificial Sequence
  sgRNA
  mm10304_Man1a2
ggcaaaggagctaaaaaccc

SEQ ID NO: 2133 - DNA, 20 bp, Artificial Sequence
  sgRNA
  mm10305_Man2a1
tgcgtcgaaataatctgaca

SEQ ID NO: 2134 - DNA, 20 bp, Artificial Sequence
  sgRNA
  mm10306_Man2a1
aggaaccgcgaaagactggg

SEQ ID NO: 2135 - DNA, 20 bp, Artificial Sequence
  sgRNA
  mm10307_Man2a1
cagctggaaattgtgaccgg

SEQ ID NO: 2136 - DNA, 20 bp, Artificial Sequence
  sgRNA
  mm10308_Man2a1
acaatccctttgaacaagaa

SEQ ID NO: 2137 - DNA, 20 bp, Artificial Sequence
  sgRNA
  mm10309_Man2b1
atgttgtaaatgactacgcg

SEQ ID NO: 2138 - DNA, 20 bp, Artificial Sequence
  sgRNA
  mm10310_Man2b1
tgagttcaatgcaaaaacgt

SEQ ID NO: 2139 - DNA, 20 bp, Artificial Sequence
  sgRNA
  mm10311_Man2b1
cttgatagtcaatgcgccca

SEQ ID NO: 2140 - DNA, 20 bp, Artificial Sequence
  sgRNA
  mm10312_Man2b1
agctcccagaggtaacacgt

SEQ ID NO: 2141 - DNA, 20 bp, Artificial Sequence
  sgRNA
  mm10325_Marco
ttccagattaaaggtgaacg

SEQ ID NO: 2142 - DNA, 20 bp, Artificial Sequence
  sgRNA
  mm10326_Marco
taggtctcactggccccaag

SEQ ID NO: 2143 - DNA, 20 bp, Artificial Sequence
  sgRNA
  mm10327_Marco
caatggatcactagctatcg

SEQ ID NO: 2144 - DNA, 20 bp, Artificial Sequence
  sgRNA
  mm10328_Marco
gtgcacccgtaagtccctgg

SEQ ID NO: 2145 - DNA, 20 bp, Artificial Sequence
  sgRNA
  mm10337_Mas1
gtgctggacactaacatgag

SEQ ID NO: 2146 - DNA, 20 bp, Artificial Sequence
  sgRNA
  mm10338_Mas1
atatggggtagaggaccgat

SEQ ID NO: 2147 - DNA, 20 bp, Artificial Sequence
  sgRNA
  mm10339_Mas1
aatacacatgacatactcca

SEQ ID NO: 2148 - DNA, 20 bp, Artificial Sequence
  sgRNA
  mm10340_Mas1
ttctcggagtgactgccggg

SEQ ID NO: 2149 - DNA, 20 bp, Artificial Sequence
  sgRNA
  mm10349_Masp1
ttaatgtagtcatagggaca

SEQ ID NO: 2150 - DNA, 20 bp, Artificial Sequence
  sgRNA
  mm10350_Masp1
gcggcaatctctttacccag

SEQ ID NO: 2151 - DNA, 20 bp, Artificial Sequence
  sgRNA
  mm10351_Masp1
ggaatattactgtcccggag

SEQ ID NO: 2152 - DNA, 20 bp, Artificial Sequence
  sgRNA
  mm10352_Masp1
gacaactcaggagagaaccg

SEQ ID NO: 2153 - DNA, 20 bp, Artificial Sequence
  sgRNA
  mm10429_Mc2r
atgggttatcttaagcctcg

SEQ ID NO: 2154 - DNA, 20 bp, Artificial Sequence
  sgRNA
  mm10430_Mc2r
acaatcggagttatttcttg

SEQ ID NO: 2155 - DNA, 20 bp, Artificial Sequence
  sgRNA
  mm10431_Mc2r
ggcgcatggtcacaatgcta

SEQ ID NO: 2156 - DNA, 20 bp, Artificial Sequence
  sgRNA
  mm10432_Mc2r
agatagagcccagcaaagag

SEQ ID NO: 2157 - DNA, 20 bp, Artificial Sequence
  sgRNA
  mm10477_Cd46
ctgtgagccaaatcatacat

SEQ ID NO: 2158 - DNA, 20 bp, Artificial Sequence
  sgRNA
  mm10478_Cd46
tccatagcttcaaatggccg

SEQ ID NO: 2159 - DNA, 20 bp, Artificial Sequence
  sgRNA
  mm10479_Cd46
ggcctcagcatagacgccca

SEQ ID NO: 2160 - DNA, 20 bp, Artificial Sequence
  sgRNA
  mm10480_Cd46
acagttgtgatcctacccca

SEQ ID NO: 2161 - DNA, 20 bp, Artificial Sequence
  sgRNA
  mm10497_Cma1
aaacatctaaagaagacacg

SEQ ID NO: 2162 - DNA, 20 bp, Artificial Sequence
  sgRNA
  mm10498_Cma1
gccaagctaaccctaggtgt

SEQ ID NO: 2163 - DNA, 20 bp, Artificial Sequence
  sgRNA
  mm10499_Cma1
tttccagataggccatgtag

SEQ ID NO: 2164 - DNA, 20 bp, Artificial Sequence
  sgRNA
  mm10500_Cma1
ctgcagctcactgtgcggga

SEQ ID NO: 2165 - DNA, 20 bp, Artificial Sequence
  sgRNA
  mm10537_Abcc1
ggtgaagtacagatagaacg

SEQ ID NO: 2166 - DNA, 20 bp, Artificial Sequence
  sgRNA
  mm10538_Abcc1
ggctaggatgacttgcagag

SEQ ID NO: 2167 - DNA, 20 bp, Artificial Sequence
  sgRNA
  mm10539_Abcc1
agctgtaggcacattcacgt

SEQ ID NO: 2168 - DNA, 20 bp, Artificial Sequence
  sgRNA
  mm10540_Abcc1
gagcggaggtcgatcaagag

SEQ ID NO: 2169 - DNA, 20 bp, Artificial Sequence
  sgRNA
  mm10545_Slc3a2
gttcaccggcttatccaagg

SEQ ID NO: 2170 - DNA, 20 bp, Artificial Sequence
  sgRNA
  mm10546_Slc3a2
cgcccgaacgatgataacca

SEQ ID NO: 2171 - DNA, 20 bp, Artificial Sequence
  sgRNA
  mm10547_Slc3a2
tatcaccaagaacttaagtg

SEQ ID NO: 2172 - DNA, 20 bp, Artificial Sequence
  sgRNA
  mm10548_Slc3a2
gtactgaatccctagtcact

SEQ ID NO: 2173 - DNA, 20 bp, Artificial Sequence
  sgRNA
  mm10585_Men1
tcctcactcttggataacag

SEQ ID NO: 2174 - DNA, 20 bp, Artificial Sequence
  sgRNA
  mm10586_Men1
gcgctgcgaccgtaagatgg

SEQ ID NO: 2175 - DNA, 20 bp, Artificial Sequence
  sgRNA
  mm10587_Men1
ggtggtgtttgggcccaacg

SEQ ID NO: 2176 - DNA, 20 bp, Artificial Sequence
  sgRNA
  mm10588_Men1
cacagcgccgcggatctgag

SEQ ID NO: 2177 - DNA, 20 bp, Artificial Sequence
  sgRNA
  mm10601_Mertk
aggtacggttaggacagacg

SEQ ID NO: 2178 - DNA, 20 bp, Artificial Sequence
  sgRNA
  mm10602_Mertk
tgtatctgatcccatatacg

SEQ ID NO: 2179 - DNA, 20 bp, Artificial Sequence
  sgRNA
  mm10603_Mertk
gctaccggatatctcacgtg

SEQ ID NO: 2180 - DNA, 20 bp, Artificial Sequence
  sgRNA
  mm10604_Mertk
agcgatgctgtaattagcca

SEQ ID NO: 2181 - DNA, 20 bp, Artificial Sequence
  sgRNA
  mm10617_Met
gtatcggacagagtttacca

SEQ ID NO: 2182 - DNA, 20 bp, Artificial Sequence
  sgRNA
  mm10618_Met
taataacaagcatttctccg

SEQ ID NO: 2183 - DNA, 20 bp, Artificial Sequence
  sgRNA
  mm10619_Met
ccctggtttactgacatacg

SEQ ID NO: 2184 - DNA, 20 bp, Artificial Sequence
  sgRNA
  mm10620_Met
ggtggatttcatagacaacg

SEQ ID NO: 2185 - DNA, 20 bp, Artificial Sequence
  sgRNA
  mm10633_Mfge8
cagcagagttaactcacggg

SEQ ID NO: 2186 - DNA, 20 bp, Artificial Sequence
  sgRNA
  mm10634_Mfge8
actcaaacttgcgtccgtcg

SEQ ID NO: 2187 - DNA, 20 bp, Artificial Sequence
  sgRNA
  mm10635_Mfge8
agtgcttaccggtttcacag

SEQ ID NO: 2188 - DNA, 20 bp, Artificial Sequence
  sgRNA
  mm10636_Mfge8
gtgtgcaatgagactgagag

SEQ ID NO: 2189 - DNA, 20 bp, Artificial Sequence
  sgRNA
  mm10673_Mif
ccctctggcacggaggcgcg

SEQ ID NO: 2190 - DNA, 20 bp, Artificial Sequence
  sgRNA
  mm10674_Mif
acagcagcttactgtagttg

SEQ ID NO: 2191 - DNA, 20 bp, Artificial Sequence
  sgRNA
  mm10675_Mif
ggccaccggcaagcccgcac

SEQ ID NO: 2192 - DNA, 20 bp, Artificial Sequence
  sgRNA
  mm10676_Mif
cacagcatcggcaagatcgg

SEQ ID NO: 2193 - DNA, 20 bp, Artificial Sequence
  sgRNA
  mm10677_Cxcl9
atcgtgcattccttatcact

SEQ ID NO: 2194 - DNA, 20 bp, Artificial Sequence
  sgRNA
  mm10678_Cxcl9
tttgttgcaattggggcttg

SEQ ID NO: 2195 - DNA, 20 bp, Artificial Sequence
  sgRNA
  mm10679_Cxcl9
cacagtgctacactgaagaa

SEQ ID NO: 2196 - DNA, 20 bp, Artificial Sequence
  sgRNA
  mm10680_Cxcl9
agatcaaacctgcctagatc

SEQ ID NO: 2197 - DNA, 20 bp, Artificial Sequence
  sgRNA
  mm10741_Mme
cttgctcctgactatcatag

SEQ ID NO: 2198 - DNA, 20 bp, Artificial Sequence
  sgRNA
  mm10742_Mme
tgttaccagatatatatggg

SEQ ID NO: 2199 - DNA, 20 bp, Artificial Sequence
  sgRNA
  mm10743_Mme
tttgaccagctgaatgactg

SEQ ID NO: 2200 - DNA, 20 bp, Artificial Sequence
  sgRNA
  mm10744_Mme
ctggaagggaggccaagtcg

SEQ ID NO: 2201 - DNA, 20 bp, Artificial Sequence
  sgRNA
  mm10765_Mmp15
agacgccgaagtgtacgccg

SEQ ID NO: 2202 - DNA, 20 bp, Artificial Sequence
  sgRNA
  mm10766_Mmp15
tggggtagttgtctagaacg

SEQ ID NO: 2203 - DNA, 20 bp, Artificial Sequence
  sgRNA
  mm10767_Mmp15
aagccaacctgcgtcgacgg

SEQ ID NO: 2204 - DNA, 20 bp, Artificial Sequence
  sgRNA
  mm10768_Mmp15
agggtgccataatagcgctg

SEQ ID NO: 2205 - DNA, 20 bp, Artificial Sequence
  sgRNA
  mm10785_Mmp7
tgttccctggcccatcaaag

SEQ ID NO: 2206 - DNA, 20 bp, Artificial Sequence
  sgRNA
  mm10786_Mmp7
atttgatccactacgatccg

SEQ ID NO: 2207 - DNA, 20 bp, Artificial Sequence
  sgRNA
  mm10787_Mmp7
gatcccactgaacttcaaga

SEQ ID NO: 2208 - DNA, 20 bp, Artificial Sequence
  sgRNA
  mm10788_Mmp7
ataatgcagaaacctaggtg

SEQ ID NO: 2209 - DNA, 20 bp, Artificial Sequence
  sgRNA
  mm10829_Mog
cgatgagagtcagcacaccg

SEQ ID NO: 2210 - DNA, 20 bp, Artificial Sequence
  sgRNA
  mm10830_Mog
aattcagagtgataggacca

SEQ ID NO: 2211 - DNA, 20 bp, Artificial Sequence
  sgRNA
  mm10831_Mog
tcacctctaccgaaatggca

SEQ ID NO: 2212 - DNA, 20 bp, Artificial Sequence
  sgRNA
  mm10832_Mog
tctcacgttctgaatcctaa

SEQ ID NO: 2213 - DNA, 20 bp, Artificial Sequence
  sgRNA
  mm10857_Cd200
aggaacccttgattgtgaca

SEQ ID NO: 2214 - DNA, 20 bp, Artificial Sequence
  sgRNA
  mm10858_Cd200
cacctacagcaaaacccatg

SEQ ID NO: 2215 - DNA, 20 bp, Artificial Sequence
  sgRNA
  mm10859_Cd200
ttgtagtgaaggtgtactat

SEQ ID NO: 2216 - DNA, 20 bp, Artificial Sequence
  sgRNA
  mm10860_Cd200
gccccaaatcaggctgtagg

SEQ ID NO: 2217 - DNA, 20 bp, Artificial Sequence
  sgRNA
  mm10873_Mpl
gctgtcggatgaacacacgg

SEQ ID NO: 2218 - DNA, 20 bp, Artificial Sequence
  sgRNA
  mm10874_Mpl
ggaacttcagatccactggg

SEQ ID NO: 2219 - DNA, 20 bp, Artificial Sequence
  sgRNA
  mm10875_Mpl
gtgaacggcaccttgcgctg

SEQ ID NO: 2220 - DNA, 20 bp, Artificial Sequence
  sgRNA
  mm10876_Mpl
gctacgcagccaacccgacg

SEQ ID NO: 2221 - DNA, 20 bp, Artificial Sequence
  sgRNA
  mm10889_Mpz
gggacaaccttacatcgatg

SEQ ID NO: 2222 - DNA, 20 bp, Artificial Sequence
  sgRNA
  mm10890_Mpz
aaaaacccaccggacatagt

SEQ ID NO: 2223 - DNA, 20 bp, Artificial Sequence
  sgRNA
  mm10891_Mpz
cattgtggtttacacggaca

SEQ ID NO: 2224 - DNA, 20 bp, Artificial Sequence
  sgRNA
  mm10892_Mpz
caacaccaccccatacctag

SEQ ID NO: 2225 - DNA, 20 bp, Artificial Sequence
  sgRNA
  mm10897_Mrc1
ttctggaatgacatcaactg

SEQ ID NO: 2226 - DNA, 20 bp, Artificial Sequence
  sgRNA
  mm10898_Mrc1
tctcgagcacaggtcatccg

SEQ ID NO: 2227 - DNA, 20 bp, Artificial Sequence
  sgRNA
  mm10899_Mrc1
agccatgctgtagtaccgga

SEQ ID NO: 2228 - DNA, 20 bp, Artificial Sequence
  sgRNA
  mm10900_Mrc1
tttctcaccatatccgagct

SEQ ID NO: 2229 - DNA, 20 bp, Artificial Sequence
  sgRNA
  mm10901_Mrc2
atggcagtgtcgtacactag

SEQ ID NO: 2230 - DNA, 20 bp, Artificial Sequence
  sgRNA
  mm10902_Mrc2
gaaccagacattggtcgaca

SEQ ID NO: 2231 - DNA, 20 bp, Artificial Sequence
  sgRNA
  mm10903_Mrc2
acagatcagccggacaaccc

SEQ ID NO: 2232 - DNA, 20 bp, Artificial Sequence
  sgRNA
  mm10904_Mrc2
gtatacatgacagccagaca

SEQ ID NO: 2233 - DNA, 20 bp, Artificial Sequence
  sgRNA
  mm10953_Msn
cgcttgttaatccgaagccg

SEQ ID NO: 2234 - DNA, 20 bp, Artificial Sequence
  sgRNA
  mm10954_Msn
ccgggccaagttctacccag

SEQ ID NO: 2235 - DNA, 20 bp, Artificial Sequence
  sgRNA
  mm10955_Msn
gaagcaacttatctccagcc

SEQ ID NO: 2236 - DNA, 20 bp, Artificial Sequence
  sgRNA
  mm10956_Msn
cagactaagaaggctcagca

SEQ ID NO: 2237 - DNA, 20 bp, Artificial Sequence
  sgRNA
  mm11085_Muc1
agctctccagtagtccacgg

SEQ ID NO: 2238 - DNA, 20 bp, Artificial Sequence
  sgRNA
  mm11086_Muc1
ttgtagttgaggtaccactg

SEQ ID NO: 2239 - DNA, 20 bp, Artificial Sequence
  sgRNA
  mm11087_Muc1
tggccatggtaggagaaaca

SEQ ID NO: 2240 - DNA, 20 bp, Artificial Sequence
  sgRNA
  mm11088_Muc1
agaactggtaggtagcaccg

SEQ ID NO: 2241 - DNA, 20 bp, Artificial Sequence
  sgRNA
  mm11097_Mug1
ggggagatagttcatcacag

SEQ ID NO: 2242 - DNA, 20 bp, Artificial Sequence
  sgRNA
  mm11098_Mug1
acatccttctcagttccatg

SEQ ID NO: 2243 - DNA, 20 bp, Artificial Sequence
  sgRNA
  mm11099_Mug1
ggaagagcccgagatgcatg

SEQ ID NO: 2244 - DNA, 20 bp, Artificial Sequence
  sgRNA
  mm11100_Mug1
gctacgtcccctgaatgagt

SEQ ID NO: 2245 - DNA, 20 bp, Artificial Sequence
  sgRNA
  mm11214_Myh9
gctggtactcacgaatcgag

SEQ ID NO: 2246 - DNA, 20 bp, Artificial Sequence
  sgRNA
  mm11215_Myh9
tggactataaagctgacgag

SEQ ID NO: 2247 - DNA, 20 bp, Artificial Sequence
  sgRNA
  mm11216_Myh9
tcaaggagcgatactactca

SEQ ID NO: 2248 - DNA, 20 bp, Artificial Sequence
  sgRNA
  mm11217_Myh9
actgcaggtcaagttcagcg

SEQ ID NO: 2249 - DNA, 20 bp, Artificial Sequence
  sgRNA
  mm11330_Naga
gctaggaaggcaatcccgtg

SEQ ID NO: 2250 - DNA, 20 bp, Artificial Sequence
  sgRNA
  mm11331_Naga
tgttgaggtatacatagccc

SEQ ID NO: 2251 - DNA, 20 bp, Artificial Sequence
  sgRNA
  mm11332_Naga
tctcacaaaccagtccagga

SEQ ID NO: 2252 - DNA, 20 bp, Artificial Sequence
  sgRNA
  mm11333_Naga
tgttcaggtgaactacaccg

SEQ ID NO: 2253 - DNA, 20 bp, Artificial Sequence
  sgRNA
  mm11382_Ncam1
gaagatcttcacgttgacag

SEQ ID NO: 2254 - DNA, 20 bp, Artificial Sequence
  sgRNA
  mm11383_Ncam1
ctcctggttctcccccaatg

SEQ ID NO: 2255 - DNA, 20 bp, Artificial Sequence
  sgRNA
  mm11384_Ncam1
gccatcggcatcacacacca

SEQ ID NO: 2256 - DNA, 20 bp, Artificial Sequence
  sgRNA
  mm11385_Ncam1
acctaccaaagaccttgagg

SEQ ID NO: 2257 - DNA, 20 bp, Artificial Sequence
  sgRNA
  mm11386_Ncam2
gtgcccaccaatccgactag

SEQ ID NO: 2258 - DNA, 20 bp, Artificial Sequence
  sgRNA
  mm11387_Ncam2
taccaaaatactaactgtcg

SEQ ID NO: 2259 - DNA, 20 bp, Artificial Sequence
  sgRNA
  mm11388_Ncam2
gtgagcctgagagtatcgac

SEQ ID NO: 2260 - DNA, 20 bp, Artificial Sequence
  sgRNA
  mm11389_Ncam2
aggaagaaagatgatactcg

SEQ ID NO: 2261 - DNA, 20 bp, Artificial Sequence
  sgRNA
  mm11410_Ncl
agccaaagtcattccaacac

SEQ ID NO: 2262 - DNA, 20 bp, Artificial Sequence
  sgRNA
  mm11411_Ncl
cctctctttcaacatcactg

SEQ ID NO: 2263 - DNA, 20 bp, Artificial Sequence
  sgRNA
  mm11412_Ncl
taaaaatgatcttgctgttg

SEQ ID NO: 2264 - DNA, 20 bp, Artificial Sequence
  sgRNA
  mm11413_Ncl
tcctatgaaagccaagagtg

SEQ ID NO: 2265 - DNA, 20 bp, Artificial Sequence
  sgRNA
  mm11430_Ndp
acagtgctgaaggacaccaa

SEQ ID NO: 2266 - DNA, 20 bp, Artificial Sequence
  sgRNA
  mm11431_Ndp
actgtacaaatgtagctcaa

SEQ ID NO: 2267 - DNA, 20 bp, Artificial Sequence
  sgRNA
  mm11432_Ndp
tgctcctggccagatgtgag

SEQ ID NO: 2268 - DNA, 20 bp, Artificial Sequence
  sgRNA
  mm11433_Ndp
aacagacagttcatttctga

SEQ ID NO: 2269 - DNA, 20 bp, Artificial Sequence
  sgRNA
  mm11438_Ndufa2
gcagggatttcatcgtgcaa

SEQ ID NO: 2270 - DNA, 20 bp, Artificial Sequence
  sgRNA
  mm11439_Ndufa2
tctgatccgcgaatgctcgg

SEQ ID NO: 2271 - DNA, 20 bp, Artificial Sequence
  sgRNA
  mm11440_Ndufa2
attcgcggatcagaatgggc

SEQ ID NO: 2272 - DNA, 20 bp, Artificial Sequence
  sgRNA
  mm11441_Ndufa2
ggctgccgctgctagccgag

SEQ ID NO: 2273 - DNA, 20 bp, Artificial Sequence
  sgRNA
  mm11462_Sept2
agtggacactcccggctacg

SEQ ID NO: 2274 - DNA, 20 bp, Artificial Sequence
  sgRNA
  mm11463_Sept2
cgctacctacatgatgagag

SEQ ID NO: 2275 - DNA, 20 bp, Artificial Sequence
  sgRNA
  mm11464_Sept2
caccgaaaatcagtgaagaa

SEQ ID NO: 2276 - DNA, 20 bp, Artificial Sequence
  sgRNA
  mm11465_Sept2
gcgtgagcggcttaagaaaa

SEQ ID NO: 2277 - DNA, 20 bp, Artificial Sequence
  sgRNA
  mm11482_Neo1
cgtaaccgatggcataacct

SEQ ID NO: 2278 - DNA, 20 bp, Artificial Sequence
  sgRNA
  mm11483_Neo1
ggttccaagattatccacag

SEQ ID NO: 2279 - DNA, 20 bp, Artificial Sequence
  sgRNA
  mm11484_Neo1
aacaccgttatctggcaatg

SEQ ID NO: 2280 - DNA, 20 bp, Artificial Sequence
  sgRNA
  mm11485_Neo1
actcccgctactacacagtc

SEQ ID NO: 2281 - DNA, 20 bp, Artificial Sequence
  sgRNA
  mm11490_Neu1
acagccttcatcgtagacga

SEQ ID NO: 2282 - DNA, 20 bp, Artificial Sequence
  sgRNA
  mm11491_Neu1
ttggtttggagtaaggacga

SEQ ID NO: 2283 - DNA, 20 bp, Artificial Sequence
  sgRNA
  mm11492_Neu1
tgtgtgtggacacgggacgc

SEQ ID NO: 2284 - DNA, 20 bp, Artificial Sequence
  sgRNA
  mm11493_Neu1
gaaaaaatctgcatccgatg

SEQ ID NO: 2285 - DNA, 20 bp, Artificial Sequence
  sgRNA
  mm11514_Nf2
gacccctctgtgcacaagcg

SEQ ID NO: 2286 - DNA, 20 bp, Artificial Sequence
  sgRNA
  mm11515_Nf2
tgtgaactactttacaatcc

SEQ ID NO: 2287 - DNA, 20 bp, Artificial Sequence
  sgRNA
  mm11516_Nf2
gtcgcctcataaataggtca

SEQ ID NO: 2288 - DNA, 20 bp, Artificial Sequence
  sgRNA
  mm11517_Nf2
caagagatgagttagagagg

SEQ ID NO: 2289 - DNA, 20 bp, Artificial Sequence
  sgRNA
  mm11626_Ngfr
tggagcaatagacaggaatg

SEQ ID NO: 2290 - DNA, 20 bp, Artificial Sequence
  sgRNA
  mm11627_Ngfr
acaaggtctacgcccccgga

SEQ ID NO: 2291 - DNA, 20 bp, Artificial Sequence
  sgRNA
  mm11628_Ngfr
agggtaggcacgggtccacg

SEQ ID NO: 2292 - DNA, 20 bp, Artificial Sequence
  sgRNA
  mm11629_Ngfr
tatgtccgctccctgtgtgg

SEQ ID NO: 2293 - DNA, 20 bp, Artificial Sequence
  sgRNA
  mm11642_Nid1
tggctgtgtaagagcgcccg

SEQ ID NO: 2294 - DNA, 20 bp, Artificial Sequence
  sgRNA
  mm11643_Nid1
agccctctacacactcgcag

SEQ ID NO: 2295 - DNA, 20 bp, Artificial Sequence
  sgRNA
  mm11644_Nid1
tgtgcaccgaggctccatag

SEQ ID NO: 2296 - DNA, 20 bp, Artificial Sequence
  sgRNA
  mm11645_Nid1
ctgacccacacaatgtacct

SEQ ID NO: 2297 - DNA, 20 bp, Artificial Sequence
  sgRNA
  mm11646_Nid2
tgagatacataccttcaaca

SEQ ID NO: 2298 - DNA, 20 bp, Artificial Sequence
  sgRNA
  mm11647_Nid2
gtatcactcaaactgccgag

SEQ ID NO: 2299 - DNA, 20 bp, Artificial Sequence
  sgRNA
  mm11648_Nid2
cttgatcattagatcccacg

SEQ ID NO: 2300 - DNA, 20 bp, Artificial Sequence
  sgRNA
  mm11649_Nid2
ggatctacacgcttacatcg

SEQ ID NO: 2301 - DNA, 20 bp, Artificial Sequence
  sgRNA
  mm11722_Cd244
aaagatacatttgaccaact

SEQ ID NO: 2302 - DNA, 20 bp, Artificial Sequence
  sgRNA
  mm11723_Cd244
ctgctggagatcaccaacac

SEQ ID NO: 2303 - DNA, 20 bp, Artificial Sequence
  sgRNA
  mm11724_Cd244
agtgcccccacttactcgaa

SEQ ID NO: 2304 - DNA, 20 bp, Artificial Sequence
  sgRNA
  mm11725_Cd244
gtgagctacgctttgtacag

SEQ ID NO: 2305 - DNA, 20 bp, Artificial Sequence
  sgRNA
  mm11782_Notch1
atatacatacccgtccactc

SEQ ID NO: 2306 - DNA, 20 bp, Artificial Sequence
  sgRNA
  mm11783_Notch1
ctgcccaccaggcttcgtcg

SEQ ID NO: 2307 - DNA, 20 bp, Artificial Sequence
  sgRNA
  mm11784_Notch1
cagtgtaataatcacgcatg

SEQ ID NO: 2308 - DNA, 20 bp, Artificial Sequence
  sgRNA
  mm11785_Notch1
acctgcaaggacatgaccag

SEQ ID NO: 2309 - DNA, 20 bp, Artificial Sequence
  sgRNA
  mm11786_Notch2
gggctgtgtagagttcgcag

SEQ ID NO: 2310 - DNA, 20 bp, Artificial Sequence
  sgRNA
  mm11787_Notch2
cagcaacccttgtcacaagg

SEQ ID NO: 2311 - DNA, 20 bp, Artificial Sequence
  sgRNA
  mm11788_Notch2
agggaccagtgaaacccacg

SEQ ID NO: 2312 - DNA, 20 bp, Artificial Sequence
  sgRNA
  mm11789_Notch2
tggccaccgttaaggcagtg

SEQ ID NO: 2313 - DNA, 20 bp, Artificial Sequence
  sgRNA
  mm11798_Notch4
gctgtgacaggcactcattg

SEQ ID NO: 2314 - DNA, 20 bp, Artificial Sequence
  sgRNA
  mm11799_Notch4
acctgccaagacacacctcg

SEQ ID NO: 2315 - DNA, 20 bp, Artificial Sequence
  sgRNA
  mm11800_Notch4
ctcactacaggtcaaccctg

SEQ ID NO: 2316 - DNA, 20 bp, Artificial Sequence
  sgRNA
  mm11801_Notch4
cacagggcagagacactggt

SEQ ID NO: 2317 - DNA, 20 bp, Artificial Sequence
  sgRNA
  mm11826_Npc1
ggggaaggtgatcacaagcg

SEQ ID NO: 2318 - DNA, 20 bp, Artificial Sequence
  sgRNA
  mm11827_Npc1
catcatgtgggtcacctacg

SEQ ID NO: 2319 - DNA, 20 bp, Artificial Sequence
  sgRNA
  mm11828_Npc1
cggttcgtagatatgaacac

SEQ ID NO: 2320 - DNA, 20 bp, Artificial Sequence
  sgRNA
  mm11829_Npc1
ccatccctacctgaaaacac

SEQ ID NO: 2321 - DNA, 20 bp, Artificial Sequence
  sgRNA
  mm11854_Npr3
acagcgacgacaaactcgag

SEQ ID NO: 2322 - DNA, 20 bp, Artificial Sequence
  sgRNA
  mm11855_Npr3
gctggcggctcaaaagatcg

SEQ ID NO: 2323 - DNA, 20 bp, Artificial Sequence
  sgRNA
  mm11856_Npr3
tccaaacagtcaccctactg

SEQ ID NO: 2324 - DNA, 20 bp, Artificial Sequence
  sgRNA
  mm11857_Npr3
gtggtgatcatgtgtgccag

SEQ ID NO: 2325 - DNA, 20 bp, Artificial Sequence
  sgRNA
  mm11886_Slc11a1
gggtgtgctaccacatactg

SEQ ID NO: 2326 - DNA, 20 bp, Artificial Sequence
  sgRNA
  mm11887_Slc11a1
gagaagtagacagaacccgc

SEQ ID NO: 2327 - DNA, 20 bp, Artificial Sequence
  sgRNA
  mm11888_Slc11a1
cctagcatgataccgtccag

SEQ ID NO: 2328 - DNA, 20 bp, Artificial Sequence
  sgRNA
  mm11889_Slc11a1
gaatggggatcttctcactc

SEQ ID NO: 2329 - DNA, 20 bp, Artificial Sequence
  sgRNA
  mm11890_Slc11a2
atgtcaccgtcagtatccca

SEQ ID NO: 2330 - DNA, 20 bp, Artificial Sequence
  sgRNA
  mm11891_Slc11a2
aaacacaaaagtgtctgcga

SEQ ID NO: 2331 - DNA, 20 bp, Artificial Sequence
  sgRNA
  mm11892_Slc11a2
tgagaaaatccccattcctg

SEQ ID NO: 2332 - DNA, 20 bp, Artificial Sequence
  sgRNA
  mm11893_Slc11a2
ccttgactaaggcagaatgc

SEQ ID NO: 2333 - DNA, 20 bp, Artificial Sequence
  sgRNA
  mm11914_Nrp1
ctctgactatgagacacatg

SEQ ID NO: 2334 - DNA, 20 bp, Artificial Sequence
  sgRNA
  mm11915_Nrp1
caagactcgaatcctcccgg

SEQ ID NO: 2335 - DNA, 20 bp, Artificial Sequence
  sgRNA
  mm11916_Nrp1
tgaactaccctgaaaatggg

SEQ ID NO: 2336 - DNA, 20 bp, Artificial Sequence
  sgRNA
  mm11917_Nrp1
tgtcctccaaatcgaaatgt

SEQ ID NO: 2337 - DNA, 20 bp, Artificial Sequence
  sgRNA
  mm11918_Nrp2
agcgaacaatgatgcgaccg

SEQ ID NO: 2338 - DNA, 20 bp, Artificial Sequence
  sgRNA
  mm11919_Nrp2
ggtgaacttgatgtataaca

SEQ ID NO: 2339 - DNA, 20 bp, Artificial Sequence
  sgRNA
  mm11920_Nrp2
ccaaactccgctcgtccacg

SEQ ID NO: 2340 - DNA, 20 bp, Artificial Sequence
  sgRNA
  mm11921_Nrp2
cagagcggctactaaccagg

SEQ ID NO: 2341 - DNA, 20 bp, Artificial Sequence
  sgRNA
  mm11926_Nrxn1
gctctacatcgaccgcgccg

SEQ ID NO: 2342 - DNA, 20 bp, Artificial Sequence
  sgRNA
  mm11927_Nrxn1
gtattcagatcccttgaacg

SEQ ID NO: 2343 - DNA, 20 bp, Artificial Sequence
  sgRNA
  mm11928_Nrxn1
tgaatggcacacagtgcgtg

SEQ ID NO: 2344 - DNA, 20 bp, Artificial Sequence
  sgRNA
  mm11929_Nrxn1
gacgacgagcctcccaacag

SEQ ID NO: 2345 - DNA, 20 bp, Artificial Sequence
  sgRNA
  mm11958_Musk
cacccgcagagagtcgaccg

SEQ ID NO: 2346 - DNA, 20 bp, Artificial Sequence
  sgRNA
  mm11959_Musk
agaaaagttcagtaccgcaa

SEQ ID NO: 2347 - DNA, 20 bp, Artificial Sequence
  sgRNA
  mm11960_Musk
tgcaggacagtaccgctgtg

SEQ ID NO: 2348 - DNA, 20 bp, Artificial Sequence
  sgRNA
  mm11961_Musk
atggaaggaaaggcccaccg

SEQ ID NO: 2349 - DNA, 20 bp, Artificial Sequence
  sgRNA
  mm11978_Ntn1
tctgtttggtgataggcgcg

SEQ ID NO: 2350 - DNA, 20 bp, Artificial Sequence
  sgRNA
  mm11979_Ntn1
tgggatccgaagagttgcag

SEQ ID NO: 2351 - DNA, 20 bp, Artificial Sequence
  sgRNA
  mm11980_Ntn1
tgtccattctcatccgagca

SEQ ID NO: 2352 - DNA, 20 bp, Artificial Sequence
  sgRNA
  mm11981_Ntn1
gtgtgactgtaggcacaaca

SEQ ID NO: 2353 - DNA, 20 bp, Artificial Sequence
  sgRNA
  mm11986_Ntrk1
gcggaggccactcttcacga

SEQ ID NO: 2354 - DNA, 20 bp, Artificial Sequence
  sgRNA
  mm11987_Ntrk1
gacacaacaccagttgtggt

SEQ ID NO: 2355 - DNA, 20 bp, Artificial Sequence
  sgRNA
  mm11988_Ntrk1
actaatgagaccatgcggca

SEQ ID NO: 2356 - DNA, 20 bp, Artificial Sequence
  sgRNA
  mm11989_Ntrk1
acccagtgtcatgaagtgta

SEQ ID NO: 2357 - DNA, 20 bp, Artificial Sequence
  sgRNA
  mm11990_Ntrk2
atgacgttgaagcttacgtg

SEQ ID NO: 2358 - DNA, 20 bp, Artificial Sequence
  sgRNA
  mm11991_Ntrk2
aacctgcagatacccaattg

SEQ ID NO: 2359 - DNA, 20 bp, Artificial Sequence
  sgRNA
  mm11992_Ntrk2
aatgcaccagtggtgatctg

SEQ ID NO: 2360 - DNA, 20 bp, Artificial Sequence
  sgRNA
  mm11993_Ntrk2
ctcagtacaccaaatcctag

SEQ ID NO: 2361 - DNA, 20 bp, Artificial Sequence
  sgRNA
  mm11994_Ntrk3
actcacatataacgcaagtg

SEQ ID NO: 2362 - DNA, 20 bp, Artificial Sequence
  sgRNA
  mm11995_Ntrk3
ccactgcatcacatcaacca

SEQ ID NO: 2363 - DNA, 20 bp, Artificial Sequence
  sgRNA
  mm11996_Ntrk3
ccaggctcaccacacgtgga

SEQ ID NO: 2364 - DNA, 20 bp, Artificial Sequence
  sgRNA
  mm11997_Ntrk3
gtcaacctgactgtccgaga

SEQ ID NO: 2365 - DNA, 20 bp, Artificial Sequence
  sgRNA
  mm12002_Ntsr1
cctggtgtgcacacccacgg

SEQ ID NO: 2366 - DNA, 20 bp, Artificial Sequence
  sgRNA
  mm12003_Ntsr1
agcactgtgcattaccacct

SEQ ID NO: 2367 - DNA, 20 bp, Artificial Sequence
  sgRNA
  mm12004_Ntsr1
aggatggagatgatcagcat

SEQ ID NO: 2368 - DNA, 20 bp, Artificial Sequence
  sgRNA
  mm12005_Ntsr1
cccacatccacagttcggac

SEQ ID NO: 2369 - DNA, 20 bp, Artificial Sequence
  sgRNA
  mm12006_Ntsr2
cgagatcgccgaagacccag

SEQ ID NO: 2370 - DNA, 20 bp, Artificial Sequence
  sgRNA
  mm12007_Ntsr2
gaagatgagcgaatagagcg

SEQ ID NO: 2371 - DNA, 20 bp, Artificial Sequence
  sgRNA
  mm12008_Ntsr2
tgtcccatgataaccgccat

SEQ ID NO: 2372 - DNA, 20 bp, Artificial Sequence
  sgRNA
  mm12009_Ntsr2
tagcaccgtgcacacacgcg

SEQ ID NO: 2373 - DNA, 20 bp, Artificial Sequence
  sgRNA
  mm12066_Ocln
ctttccgcatagtcagatgg

SEQ ID NO: 2374 - DNA, 20 bp, Artificial Sequence
  sgRNA
  mm12067_Ocln
tcccattatgtacacgatcg

SEQ ID NO: 2375 - DNA, 20 bp, Artificial Sequence
  sgRNA
  mm12068_Ocln
tccggataaaaagagtacgc

SEQ ID NO: 2376 - DNA, 20 bp, Artificial Sequence
  sgRNA
  mm12069_Ocln
atatttgtatcactactgtg

SEQ ID NO: 2377 - DNA, 20 bp, Artificial Sequence
  sgRNA
  mm12122_Olfr13
gtaagggtaaaagtaacacg

SEQ ID NO: 2378 - DNA, 20 bp, Artificial Sequence
  sgRNA
  mm12123_Olfr13
caggcagatgagccccacga

SEQ ID NO: 2379 - DNA, 20 bp, Artificial Sequence
  sgRNA
  mm12124_Olfr13
aggacatcaccactaggaga

SEQ ID NO: 2380 - DNA, 20 bp, Artificial Sequence
  sgRNA
  mm12125_Olfr13
tgatggcagagtaacggagt

SEQ ID NO: 2381 - DNA, 20 bp, Artificial Sequence
  sgRNA
  mm12294_Omg
aaataccctaagaagtctcg

SEQ ID NO: 2382 - DNA, 20 bp, Artificial Sequence
  sgRNA
  mm12295_Omg
atataccaatctgagaaccc

SEQ ID NO: 2383 - DNA, 20 bp, Artificial Sequence
  sgRNA
  mm12296_Omg
aacttgactacattaccacc

SEQ ID NO: 2384 - DNA, 20 bp, Artificial Sequence
  sgRNA
  mm12297_Omg
acaaggagtccctatcacat

SEQ ID NO: 2385 - DNA, 20 bp, Artificial Sequence
  sgRNA
  mm12370_Osmr
tatacctggcaaatcactga

SEQ ID NO: 2386 - DNA, 20 bp, Artificial Sequence
  sgRNA
  mm12371_Osmr
cccgtatctggagacacgat

SEQ ID NO: 2387 - DNA, 20 bp, Artificial Sequence
  sgRNA
  mm12372_Osmr
agaggtagtttgcgctcatg

SEQ ID NO: 2388 - DNA, 20 bp, Artificial Sequence
  sgRNA
  mm12373_Osmr
atcaattgtcaagccacgaa

SEQ ID NO: 2389 - DNA, 20 bp, Artificial Sequence
  sgRNA
  mm12422_Mybbp1a
acaggcactagacctgatcg

SEQ ID NO: 2390 - DNA, 20 bp, Artificial Sequence
  sgRNA
  mm12423_Mybbp1a
ccagagataagtacatacgt

SEQ ID NO: 2391 - DNA, 20 bp, Artificial Sequence
  sgRNA
  mm12424_Mybbp1a
tttggacgaccgcaaccgtg

SEQ ID NO: 2392 - DNA, 20 bp, Artificial Sequence
  sgRNA
  mm12425_Mybbp1a
agatatgaccaaatacactc

SEQ ID NO: 2393 - DNA, 20 bp, Artificial Sequence
  sgRNA
  mm12426_P2rx1
actgctgataaggccacttg

SEQ ID NO: 2394 - DNA, 20 bp, Artificial Sequence
  sgRNA
  mm12427_P2rx1
actctcgcaccacatagcca

SEQ ID NO: 2395 - DNA, 20 bp, Artificial Sequence
  sgRNA
  mm12428_P2rx1
gctggtacgaaacaagaagg

SEQ ID NO: 2396 - DNA, 20 bp, Artificial Sequence
  sgRNA
  mm12429_P2rx1
ggcatatgccaagatgacag

SEQ ID NO: 2397 - DNA, 20 bp, Artificial Sequence
  sgRNA
  mm12430_P2rx4
agtggggctcatgaaccgcg

SEQ ID NO: 2398 - DNA, 20 bp, Artificial Sequence
  sgRNA
  mm12431_P2rx4
gtcaccgtgaaccagacgca

SEQ ID NO: 2399 - DNA, 20 bp, Artificial Sequence
  sgRNA
  mm12432_P2rx4
ctgagctgggaccacatagt

SEQ ID NO: 2400 - DNA, 20 bp, Artificial Sequence
  sgRNA
  mm12433_P2rx4
ctaccaggaaacggactctg

SEQ ID NO: 2401 - DNA, 20 bp, Artificial Sequence
  sgRNA
  mm12434_P2rx7
ctgaccggcgttgtaaaaag

SEQ ID NO: 2402 - DNA, 20 bp, Artificial Sequence
  sgRNA
  mm12435_P2rx7
gttacctgaagttgtagccg

SEQ ID NO: 2403 - DNA, 20 bp, Artificial Sequence
  sgRNA
  mm12436_P2rx7
gtgttccatcttccgactag

SEQ ID NO: 2404 - DNA, 20 bp, Artificial Sequence
  sgRNA
  mm12437_P2rx7
acctcttaccaagccaaagt

SEQ ID NO: 2405 - DNA, 20 bp, Artificial Sequence
  sgRNA
  mm12442_P2ry1
tgctaccgtagagatttacg

SEQ ID NO: 2406 - DNA, 20 bp, Artificial Sequence
  sgRNA
  mm12443_P2ry1
agcctgcccagagacttgag

SEQ ID NO: 2407 - DNA, 20 bp, Artificial Sequence
  sgRNA
  mm12444_P2ry1
cggtcttggtcagggcacat

SEQ ID NO: 2408 - DNA, 20 bp, Artificial Sequence
  sgRNA
  mm12445_P2ry1
agccaaattgaacatgtaca

SEQ ID NO: 2409 - DNA, 20 bp, Artificial Sequence
  sgRNA
  mm12450_P4ha1
tcatggaaacggataatccg

SEQ ID NO: 2410 - DNA, 20 bp, Artificial Sequence
  sgRNA
  mm12451_P4ha1
gatccataatgagaaagacc

SEQ ID NO: 2411 - DNA, 20 bp, Artificial Sequence
  sgRNA
  mm12452_P4ha1
tgaaacgtctgaacactgag

SEQ ID NO: 2412 - DNA, 20 bp, Artificial Sequence
  sgRNA
  mm12453_P4ha1
ggacacaaataccatctcaa

SEQ ID NO: 2413 - DNA, 20 bp, Artificial Sequence
  sgRNA
  mm12454_P4ha2
ctgtcaaatcagacagacgc

SEQ ID NO: 2414 - DNA, 20 bp, Artificial Sequence
  sgRNA
  mm12455_P4ha2
caccagggacttggtaacag

SEQ ID NO: 2415 - DNA, 20 bp, Artificial Sequence
  sgRNA
  mm12456_P4ha2
atccggacacgatttccaga

SEQ ID NO: 2416 - DNA, 20 bp, Artificial Sequence
  sgRNA
  mm12457_P4ha2
cttctctgcgtaaatcagat

SEQ ID NO: 2417 - DNA, 20 bp, Artificial Sequence
  sgRNA
  mm12458_P4hb
tagggtaataagccgcacag

SEQ ID NO: 2418 - DNA, 20 bp, Artificial Sequence
  sgRNA
  mm12459_P4hb
tttggaatcacgtccaacag

SEQ ID NO: 2419 - DNA, 20 bp, Artificial Sequence
  sgRNA
  mm12460_P4hb
ggtggactcaagcgaagtga

SEQ ID NO: 2420 - DNA, 20 bp, Artificial Sequence
  sgRNA
  mm12461_P4hb
aagagtgtatctgactatga

SEQ ID NO: 2421 - DNA, 20 bp, Artificial Sequence
  sgRNA
  mm12506_Pam
atggtgagtatggactcggt

SEQ ID NO: 2422 - DNA, 20 bp, Artificial Sequence
  sgRNA
  mm12507_Pam
agaatcttacccgatgtggg

SEQ ID NO: 2423 - DNA, 20 bp, Artificial Sequence
  sgRNA
  mm12508_Pam
actggatattcgcatgcctg

SEQ ID NO: 2424 - DNA, 20 bp, Artificial Sequence
  sgRNA
  mm12509_Pam
aattcctgtaaaatccgaca

SEQ ID NO: 2425 - DNA, 20 bp, Artificial Sequence
  sgRNA
  mm12510_Cntn3
catcgttacaaactgaatgg

SEQ ID NO: 2426 - DNA, 20 bp, Artificial Sequence
  sgRNA
  mm12511_Cntn3
tgtcgtggagttaaacccat

SEQ ID NO: 2427 - DNA, 20 bp, Artificial Sequence
  sgRNA
  mm12512_Cntn3
aacattcaattgaaacacag

SEQ ID NO: 2428 - DNA, 20 bp, Artificial Sequence
  sgRNA
  mm12513_Cntn3
cgcacctgtcacaaccaagt

SEQ ID NO: 2429 - DNA, 20 bp, Artificial Sequence
  sgRNA
  mm12602_Pcna
atacgtgcaaattcacccga

SEQ ID NO: 2430 - DNA, 20 bp, Artificial Sequence
  sgRNA
  mm12603_Pcna
gcgcagagtaagctgtacca

SEQ ID NO: 2431 - DNA, 20 bp, Artificial Sequence
  sgRNA
  mm12604_Pcna
gatatcctgtgcaaagaatg

SEQ ID NO: 2432 - DNA, 20 bp, Artificial Sequence
  sgRNA
  mm12605_Pcna
tgcttcgaatactagtgcta

SEQ ID NO: 2433 - DNA, 20 bp, Artificial Sequence
  sgRNA
  mm12626_Pcsk2
tcctgggctagacttgaacg

SEQ ID NO: 2434 - DNA, 20 bp, Artificial Sequence
  sgRNA
  mm12627_Pcsk2
agagcaactctcatcataca

SEQ ID NO: 2435 - DNA, 20 bp, Artificial Sequence
  sgRNA
  mm12628_Pcsk2
ggatttgaccgtaaaaagag

SEQ ID NO: 2436 - DNA, 20 bp, Artificial Sequence
  sgRNA
  mm12629_Pcsk2
ttatcacaatgggcttgcaa

SEQ ID NO: 2437 - DNA, 20 bp, Artificial Sequence
  sgRNA
  mm12630_Furin
accctgtcttacaatcgccg

SEQ ID NO: 2438 - DNA, 20 bp, Artificial Sequence
  sgRNA
  mm12631_Furin
acagcccgtagccatacgaa

SEQ ID NO: 2439 - DNA, 20 bp, Artificial Sequence
  sgRNA
  mm12632_Furin
gggcacattgccgaactgtg

SEQ ID NO: 2440 - DNA, 20 bp, Artificial Sequence
  sgRNA
  mm12633_Furin
acaatgcccgaattggaggt

SEQ ID NO: 2441 - DNA, 20 bp, Artificial Sequence
  sgRNA
  mm12642_Pcsk6
gttgctggcgtcatatctcg

SEQ ID NO: 2442 - DNA, 20 bp, Artificial Sequence
  sgRNA
  mm12643_Pcsk6
ctgataagaacagtcgctgt

SEQ ID NO: 2443 - DNA, 20 bp, Artificial Sequence
  sgRNA
  mm12644_Pcsk6
ggccacgcatacgtgctggg

SEQ ID NO: 2444 - DNA, 20 bp, Artificial Sequence
  sgRNA
  mm12645_Pcsk6
ggaaagacagtagatggacc

SEQ ID NO: 2445 - DNA, 20 bp, Artificial Sequence
  sgRNA
  mm12666_Pdcd1
caatacagggatacccacta

SEQ ID NO: 2446 - DNA, 20 bp, Artificial Sequence
  sgRNA
  mm12667_Pdcd1
gacacacggcgcaatgacag

SEQ ID NO: 2447 - DNA, 20 bp, Artificial Sequence
  sgRNA
  mm12668_Pdcd1
cagcttgtccaactggtcgg

SEQ ID NO: 2448 - DNA, 20 bp, Artificial Sequence
  sgRNA
  mm12669_Pdcd1
gctcaaaccattacagaagg

SEQ ID NO: 2449 - DNA, 20 bp, Artificial Sequence
  sgRNA
  mm12738_Pdgfa
agccgctcgatcaactcccg

SEQ ID NO: 2450 - DNA, 20 bp, Artificial Sequence
  sgRNA
  mm12739_Pdgfa
cggtcatttacgagatacct

SEQ ID NO: 2451 - DNA, 20 bp, Artificial Sequence
  sgRNA
  mm12740_Pdgfa
ctcttggagatagactccgt

SEQ ID NO: 2452 - DNA, 20 bp, Artificial Sequence
  sgRNA
  mm12741_Pdgfa
attcgcaggaagagaagtat

SEQ ID NO: 2453 - DNA, 20 bp, Artificial Sequence
  sgRNA
  mm12742_Pdgfb
cctcggcgctgaccagacgc

SEQ ID NO: 2454 - DNA, 20 bp, Artificial Sequence
  sgRNA
  mm12743_Pdgfb
cgagtgcaagacgcgcacag

SEQ ID NO: 2455 - DNA, 20 bp, Artificial Sequence
  sgRNA
  mm12744_Pdgfb
tggaaagctcatctcgaggg

SEQ ID NO: 2456 - DNA, 20 bp, Artificial Sequence
  sgRNA
  mm12745_Pdgfb
aggcccggcattgcacattg

SEQ ID NO: 2457 - DNA, 20 bp, Artificial Sequence
  sgRNA
  mm12746_Pdgfra
taaggcaggagaaacgatcg

SEQ ID NO: 2458 - DNA, 20 bp, Artificial Sequence
  sgRNA
  mm12747_Pdgfra
taaccttgcacaataacggg

SEQ ID NO: 2459 - DNA, 20 bp, Artificial Sequence
  sgRNA
  mm12748_Pdgfra
agatatactcatgtccatcg

SEQ ID NO: 2460 - DNA, 20 bp, Artificial Sequence
  sgRNA
  mm12749_Pdgfra
cacagaatactgcttctatg

SEQ ID NO: 2461 - DNA, 20 bp, Artificial Sequence
  sgRNA
  mm12750_Pdgfrb
cggacagtggctgatccacg

SEQ ID NO: 2462 - DNA, 20 bp, Artificial Sequence
  sgRNA
  mm12751_Pdgfrb
ccgcagagaatggctacgtg

SEQ ID NO: 2463 - DNA, 20 bp, Artificial Sequence
  sgRNA
  mm12752_Pdgfrb
atggacgtacccccgcatga

SEQ ID NO: 2464 - DNA, 20 bp, Artificial Sequence
  sgRNA
  mm12753_Pdgfrb
cggtcatgagtacatctacg

SEQ ID NO: 2465 - DNA, 20 bp, Artificial Sequence
  sgRNA
  mm12782_Enpp1
tacaacgcaagttgccactg

SEQ ID NO: 2466 - DNA, 20 bp, Artificial Sequence
  sgRNA
  mm12783_Enpp1
ggtgaccgctaatcatcagg

SEQ ID NO: 2467 - DNA, 20 bp, Artificial Sequence
  sgRNA
  mm12784_Enpp1
atgtgaaagcatcgataccc

SEQ ID NO: 2468 - DNA, 20 bp, Artificial Sequence
  sgRNA
  mm12785_Enpp1
aacgtcttggtagggtacat

SEQ ID NO: 2469 - DNA, 20 bp, Artificial Sequence
  sgRNA
  mm12922_Abcb1a
actgaatgctccaattaaca

SEQ ID NO: 2470 - DNA, 20 bp, Artificial Sequence
  sgRNA
  mm12923_Abcb1a
caggaagcttagtaccaaag

SEQ ID NO: 2471 - DNA, 20 bp, Artificial Sequence
  sgRNA
  mm12924_Abcb1a
caaagatcagcatcataagt

SEQ ID NO: 2472 - DNA, 20 bp, Artificial Sequence
  sgRNA
  mm12925_Abcb1a
aatgacgtcagcattacgaa

SEQ ID NO: 2473 - DNA, 20 bp, Artificial Sequence
  sgRNA
  mm12926_Phb
gtgatgactggtacgttccg

SEQ ID NO: 2474 - DNA, 20 bp, Artificial Sequence
  sgRNA
  mm12927_Phb
ttaccagggacacgtcatcc

SEQ ID NO: 2475 - DNA, 20 bp, Artificial Sequence
  sgRNA
  mm12928_Phb
ccaatgctggtgtagatacg

SEQ ID NO: 2476 - DNA, 20 bp, Artificial Sequence
  sgRNA
  mm12929_Phb
cactcaccaccaccgacttg

SEQ ID NO: 2477 - DNA, 20 bp, Artificial Sequence
  sgRNA
  mm13110_Pkd1
attcccgtaccgatatacct

SEQ ID NO: 2478 - DNA, 20 bp, Artificial Sequence
  sgRNA
  mm13111_Pkd1
acagttgcgtagatcaacat

SEQ ID NO: 2479 - DNA, 20 bp, Artificial Sequence
  sgRNA
  mm13112_Pkd1
agctcgcagacataactatg

SEQ ID NO: 2480 - DNA, 20 bp, Artificial Sequence
  sgRNA
  mm13113_Pkd1
tgatggtgtcctatatacgt

SEQ ID NO: 2481 - DNA, 20 bp, Artificial Sequence
  sgRNA
  mm13158_Pla2g1b
ccttcaggggatcactcccg

SEQ ID NO: 2482 - DNA, 20 bp, Artificial Sequence
  sgRNA
  mm13159_Pla2g1b
cctgtctaagtcgtccactg

SEQ ID NO: 2483 - DNA, 20 bp, Artificial Sequence
  sgRNA
  mm13160_Pla2g1b
gcatgagtaggagtaagtgt

SEQ ID NO: 2484 - DNA, 20 bp, Artificial Sequence
  sgRNA
  mm13161_Pla2g1b
tggtgcacttgatcatattg

SEQ ID NO: 2485 - DNA, 20 bp, Artificial Sequence
  sgRNA
  mm13162_Pla2r1
tggatcgcctacacgtccag

SEQ ID NO: 2486 - DNA, 20 bp, Artificial Sequence
  sgRNA
  mm13163_Pla2r1
attcccaatccatatagcag

SEQ ID NO: 2487 - DNA, 20 bp, Artificial Sequence
  sgRNA
  mm13164_Pla2r1
tctgtgatgctacgtggcaa

SEQ ID NO: 2488 - DNA, 20 bp, Artificial Sequence
  sgRNA
  mm13165_Pla2r1
tttgcatatataaggcaagg

SEQ ID NO: 2489 - DNA, 20 bp, Artificial Sequence
  sgRNA
  mm13174_Pla2g5
ccgttgttatgggcaactgg

SEQ ID NO: 2490 - DNA, 20 bp, Artificial Sequence
  sgRNA
  mm13175_Pla2g5
ggtcgcgggacacccaagga

SEQ ID NO: 2491 - DNA, 20 bp, Artificial Sequence
  sgRNA
  mm13176_Pla2g5
gtcataggactgggtccgaa

SEQ ID NO: 2492 - DNA, 20 bp, Artificial Sequence
  sgRNA
  mm13177_Pla2g5
tgagttctagcaagccccct

SEQ ID NO: 2493 - DNA, 20 bp, Artificial Sequence
  sgRNA
  mm13194_Plat
tgaagccctacaatgcaagg

SEQ ID NO: 2494 - DNA, 20 bp, Artificial Sequence
  sgRNA
  mm13195_Plat
cgaaccaagatgcttcaatg

SEQ ID NO: 2495 - DNA, 20 bp, Artificial Sequence
  sgRNA
  mm13196_Plat
cctcctttaattctaaactg

SEQ ID NO: 2496 - DNA, 20 bp, Artificial Sequence
  sgRNA
  mm13197_Plat
gaccactttaagatgattgg

SEQ ID NO: 2497 - DNA, 20 bp, Artificial Sequence
  sgRNA
  mm13198_Plau
cccccaacaatcttaaagcg

SEQ ID NO: 2498 - DNA, 20 bp, Artificial Sequence
  sgRNA
  mm13199_Plau
actcccaccacatttaaagg

SEQ ID NO: 2499 - DNA, 20 bp, Artificial Sequence
  sgRNA
  mm13200_Plau
ccaacactgataccaaaggt

SEQ ID NO: 2500 - DNA, 20 bp, Artificial Sequence
  sgRNA
  mm13201_Plau
gctggtacgtatcttcagca

SEQ ID NO: 2501 - DNA, 20 bp, Artificial Sequence
  sgRNA
  mm13202_Plaur
aggaccatgagttaccgcat

SEQ ID NO: 2502 - DNA, 20 bp, Artificial Sequence
  sgRNA
  mm13203_Plaur
aaggatgaggactacacccg

SEQ ID NO: 2503 - DNA, 20 bp, Artificial Sequence
  sgRNA
  mm13204_Plaur
aggtgcaggacgcacactcg

SEQ ID NO: 2504 - DNA, 20 bp, Artificial Sequence
  sgRNA
  mm13205_Plaur
tgcaactacacccactgcaa

SEQ ID NO: 2505 - DNA, 20 bp, Artificial Sequence
  sgRNA
  mm13238_Pld3
tatcgggtgtcaaaggaccg

SEQ ID NO: 2506 - DNA, 20 bp, Artificial Sequence
  sgRNA
  mm13239_Pld3
atgcgaacctttacacctcg

SEQ ID NO: 2507 - DNA, 20 bp, Artificial Sequence
  sgRNA
  mm13240_Pld3
actgcccttgaatgaaatcg

SEQ ID NO: 2508 - DNA, 20 bp, Artificial Sequence
  sgRNA
  mm13241_Pld3
gctgtttctatgggaatacg

SEQ ID NO: 2509 - DNA, 20 bp, Artificial Sequence
  sgRNA
  mm13254_Pa2g4
caggactatatactcaagga

SEQ ID NO: 2510 - DNA, 20 bp, Artificial Sequence
  sgRNA
  mm13255_Pa2g4
tcaggccatattgtttagag

SEQ ID NO: 2511 - DNA, 20 bp, Artificial Sequence
  sgRNA
  mm13256_Pa2g4
tgctgaagctgccttacgac

SEQ ID NO: 2512 - DNA, 20 bp, Artificial Sequence
  sgRNA
  mm13257_Pa2g4
gtgaccaagtataagatggg

SEQ ID NO: 2513 - DNA, 20 bp, Artificial Sequence
  sgRNA
  mm13258_Prl7d1
tgaggatgtccgaaagacat

SEQ ID NO: 2514 - DNA, 20 bp, Artificial Sequence
  sgRNA
  mm13259_Prl7d1
gaacgttgatgggaacagtg

SEQ ID NO: 2515 - DNA, 20 bp, Artificial Sequence
  sgRNA
  mm13260_Prl7d1
gatgtcaaatctcttcctgt

SEQ ID NO: 2516 - DNA, 20 bp, Artificial Sequence
  sgRNA
  mm13261_Prl7d1
cctttgataggatcctataa

SEQ ID NO: 2517 - DNA, 20 bp, Artificial Sequence
  sgRNA
  mm13262_Plg
gcagcaatgcgtgatcatgg

SEQ ID NO: 2518 - DNA, 20 bp, Artificial Sequence
  sgRNA
  mm13263_Plg
gaagaggtgaaaattaccga

SEQ ID NO: 2519 - DNA, 20 bp, Artificial Sequence
  sgRNA
  mm13264_Plg
agagcttacttgggtacgtg

SEQ ID NO: 2520 - DNA, 20 bp, Artificial Sequence
  sgRNA
  mm13265_Plg
aggaatgctaccagagcgat

SEQ ID NO: 2521 - DNA, 20 bp, Artificial Sequence
  sgRNA
  mm13266_Serpinf2
acgttccactcaaaataagt

SEQ ID NO: 2522 - DNA, 20 bp, Artificial Sequence
  sgRNA
  mm13267_Serpinf2
tccagcaggaaccatcgaag

SEQ ID NO: 2523 - DNA, 20 bp, Artificial Sequence
  sgRNA
  mm13268_Serpinf2
agccatttctaccagaacct

SEQ ID NO: 2524 - DNA, 20 bp, Artificial Sequence
  sgRNA
  mm13269_Serpinf2
gtgaccatgctaccctcaag

SEQ ID NO: 2525 - DNA, 20 bp, Artificial Sequence
  sgRNA
  mm13278_Plod1
agcatatctacccggaccgg

SEQ ID NO: 2526 - DNA, 20 bp, Artificial Sequence
  sgRNA
  mm13279_Plod1
cactggatactcacacacga

SEQ ID NO: 2527 - DNA, 20 bp, Artificial Sequence
  sgRNA
  mm13280_Plod1
tgtcaacgaagagaataacc

SEQ ID NO: 2528 - DNA, 20 bp, Artificial Sequence
  sgRNA
  mm13281_Plod1
ccgtaggccctcgtcacaca

SEQ ID NO: 2529 - DNA, 20 bp, Artificial Sequence
  sgRNA
  mm13298_Pltp
acatctccaacgcatccttg

SEQ ID NO: 2530 - DNA, 20 bp, Artificial Sequence
  sgRNA
  mm13299_Pltp
aaaatgaatatggccttcgg

SEQ ID NO: 2531 - DNA, 20 bp, Artificial Sequence
  sgRNA
  mm13300_Pltp
agtggggagttaatcactgt

SEQ ID NO: 2532 - DNA, 20 bp, Artificial Sequence
  sgRNA
  mm13301_Pltp
cgacgagaggatggtgtacg

SEQ ID NO: 2533 - DNA, 20 bp, Artificial Sequence
  sgRNA
  mm13306_Plxna1
tgactaccaaggccgcaccg

SEQ ID NO: 2534 - DNA, 20 bp, Artificial Sequence
  sgRNA
  mm13307_Plxna1
tccaacagtactcctatgag

SEQ ID NO: 2535 - DNA, 20 bp, Artificial Sequence
  sgRNA
  mm13308_Plxna1
agtatacgaactgctcgctg

SEQ ID NO: 2536 - DNA, 20 bp, Artificial Sequence
  sgRNA
  mm13309_Plxna1
cggcgcccggcacaccatgg

SEQ ID NO: 2537 - DNA, 20 bp, Artificial Sequence
  sgRNA
  mm13310_Plxna2
actgttcacatgattcaaca

SEQ ID NO: 2538 - DNA, 20 bp, Artificial Sequence
  sgRNA
  mm13311_Plxna2
ctgcagactgctatccaccc

SEQ ID NO: 2539 - DNA, 20 bp, Artificial Sequence
  sgRNA
  mm13312_Plxna2
tacaatgcacaggttcacgt

SEQ ID NO: 2540 - DNA, 20 bp, Artificial Sequence
  sgRNA
  mm13313_Plxna2
atgtggtacctataacggca

SEQ ID NO: 2541 - DNA, 20 bp, Artificial Sequence
  sgRNA
  mm13366_Sept5
gacatcgacaagcagtacgt

SEQ ID NO: 2542 - DNA, 20 bp, Artificial Sequence
  sgRNA
  mm13367_Sept5
tttccggtccttatacaggt

SEQ ID NO: 2543 - DNA, 20 bp, Artificial Sequence
  sgRNA
  mm13368_Sept5
cacacacccgtgtccgaacg

SEQ ID NO: 2544 - DNA, 20 bp, Artificial Sequence
  sgRNA
  mm13369_Sept5
aaagccgggcgtgtccacaa

SEQ ID NO: 2545 - DNA, 20 bp, Artificial Sequence
  sgRNA
  mm13410_Pon1
ctggatggtttaccaccagt

SEQ ID NO: 2546 - DNA, 20 bp, Artificial Sequence
  sgRNA
  mm13411_Pon1
cttactgataggaagaccga

SEQ ID NO: 2547 - DNA, 20 bp, Artificial Sequence
  sgRNA
  mm13412_Pon1
aaatgtacttgggtctgtcg

SEQ ID NO: 2548 - DNA, 20 bp, Artificial Sequence
  sgRNA
  mm13413_Pon1
gaagggtttgatttcgcgaa

SEQ ID NO: 2549 - DNA, 20 bp, Artificial Sequence
  sgRNA
  mm13478_Ppap2a
aaagtatatccatttcagag

SEQ ID NO: 2550 - DNA, 20 bp, Artificial Sequence
  sgRNA
  mm13479_Ppap2a
gtatggcgagtatacgggac

SEQ ID NO: 2551 - DNA, 20 bp, Artificial Sequence
  sgRNA
  mm13480_Ppap2a
cccgagtagaaagacaacct

SEQ ID NO: 2552 - DNA, 20 bp, Artificial Sequence
  sgRNA
  mm13481_Ppap2a
atacttagcgatgtcagtca

SEQ ID NO: 2553 - DNA, 20 bp, Artificial Sequence
  sgRNA
  mm13514_Ctsa
gtggtgctttggcttaacgg

SEQ ID NO: 2554 - DNA, 20 bp, Artificial Sequence
  sgRNA
  mm13515_Ctsa
ggactcgatatacagcacgt

SEQ ID NO: 2555 - DNA, 20 bp, Artificial Sequence
  sgRNA
  mm13516_Ctsa
ctccggctacctcagagcat

SEQ ID NO: 2556 - DNA, 20 bp, Artificial Sequence
  sgRNA
  mm13517_Ctsa
catgaccagtacagccaagg

SEQ ID NO: 2557 - DNA, 20 bp, Artificial Sequence
  sgRNA
  mm13522_Ppib
gtggccaacgataagaagaa

SEQ ID NO: 2558 - DNA, 20 bp, Artificial Sequence
  sgRNA
  mm13523_Ppib
gggcagcaaaaggaagacga

SEQ ID NO: 2559 - DNA, 20 bp, Artificial Sequence
  sgRNA
  mm13524_Ppib
tgaagtccttgatgacacga

SEQ ID NO: 2560 - DNA, 20 bp, Artificial Sequence
  sgRNA
  mm13525_Ppib
ccagggtggagacttcacca

SEQ ID NO: 2561 - DNA, 20 bp, Artificial Sequence
  sgRNA
  mm13530_Lgals3bp
agaaaccattgcctcacacg

SEQ ID NO: 2562 - DNA, 20 bp, Artificial Sequence
  sgRNA
  mm13531_Lgals3bp
tgtccatcccagataccacg

SEQ ID NO: 2563 - DNA, 20 bp, Artificial Sequence
  sgRNA
  mm13532_Lgals3bp
gcgtacgcataaaggtccaa

SEQ ID NO: 2564 - DNA, 20 bp, Artificial Sequence
  sgRNA
  mm13533_Lgals3bp
aacggggcctcagccaatga

SEQ ID NO: 2565 - DNA, 20 bp, Artificial Sequence
  sgRNA
  mm13666_Prkcsh
aagaccaggtagaaacactg

SEQ ID NO: 2566 - DNA, 20 bp, Artificial Sequence
  sgRNA
  mm13667_Prkcsh
cagggacaagtaccgctctg

SEQ ID NO: 2567 - DNA, 20 bp, Artificial Sequence
  sgRNA
  mm13668_Prkcsh
ggcacagacgagtacaacag

SEQ ID NO: 2568 - DNA, 20 bp, Artificial Sequence
  sgRNA
  mm13669_Prkcsh
aacttgacgacaacatggat

SEQ ID NO: 2569 - DNA, 20 bp, Artificial Sequence
  sgRNA
  mm13670_Prkdc
agagccaattcagtgacccg

SEQ ID NO: 2570 - DNA, 20 bp, Artificial Sequence
  sgRNA
  mm13671_Prkdc
tggcccttgtaagtagacga

SEQ ID NO: 2571 - DNA, 20 bp, Artificial Sequence
  sgRNA
  mm13672_Prkdc
catgcagggtaagtaatcgt

SEQ ID NO: 2572 - DNA, 20 bp, Artificial Sequence
  sgRNA
  mm13673_Prkdc
acagaggatgctcaaaaatg

SEQ ID NO: 2573 - DNA, 20 bp, Artificial Sequence
  sgRNA
  mm13722_Prlr
atccacataaagtggatccg

SEQ ID NO: 2574 - DNA, 20 bp, Artificial Sequence
  sgRNA
  mm13723_Prlr
atgtcaatgaataattggtg

SEQ ID NO: 2575 - DNA, 20 bp, Artificial Sequence
  sgRNA
  mm13724_Prlr
atttgatactcatctgctag

SEQ ID NO: 2576 - DNA, 20 bp, Artificial Sequence
  sgRNA
  mm13725_Prlr
tcccattccaaagagtatcc

SEQ ID NO: 2577 - DNA, 20 bp, Artificial Sequence
  sgRNA
  mm13734_Prnp
tggccccatccaccgccatg

SEQ ID NO: 2578 - DNA, 20 bp, Artificial Sequence
  sgRNA
  mm13735_Prnp
gtgactatgtggactgatgt

SEQ ID NO: 2579 - DNA, 20 bp, Artificial Sequence
  sgRNA
  mm13736_Prnp
aaaaaccaacctcaagcatg

SEQ ID NO: 2580 - DNA, 20 bp, Artificial Sequence
  sgRNA
  mm13737_Prnp
accctaaccaagtgtactac

SEQ ID NO: 2581 - DNA, 20 bp, Artificial Sequence
  sgRNA
  mm13742_Procr
tccaagacaaccatcatgtg

SEQ ID NO: 2582 - DNA, 20 bp, Artificial Sequence
  sgRNA
  mm13743_Procr
tgcgccctttgtaactccga

SEQ ID NO: 2583 - DNA, 20 bp, Artificial Sequence
  sgRNA
  mm13744_Procr
gctggtatatcgcgagcgca

SEQ ID NO: 2584 - DNA, 20 bp, Artificial Sequence
  sgRNA
  mm13745_Procr
gccacatcgaagaagacatg

SEQ ID NO: 2585 - DNA, 20 bp, Artificial Sequence
  sgRNA
  mm13750_Prom1
gagtgaagactcacgccatg

SEQ ID NO: 2586 - DNA, 20 bp, Artificial Sequence
  sgRNA
  mm13751_Prom1
aaggactccgatctcataga

SEQ ID NO: 2587 - DNA, 20 bp, Artificial Sequence
  sgRNA
  mm13752_Prom1
cagcaacagatacttaaacc

SEQ ID NO: 2588 - DNA, 20 bp, Artificial Sequence
  sgRNA
  mm13753_Prom1
caaagccatatataatgcca

SEQ ID NO: 2589 - DNA, 20 bp, Artificial Sequence
  sgRNA
  mm13794_St14
aggagcccactggtacgttg

SEQ ID NO: 2590 - DNA, 20 bp, Artificial Sequence
  sgRNA
  mm13795_St14
gggtccctaccacaagaagt

SEQ ID NO: 2591 - DNA, 20 bp, Artificial Sequence
  sgRNA
  mm13796_St14
ggggctcaggctatcataca

SEQ ID NO: 2592 - DNA, 20 bp, Artificial Sequence
  sgRNA
  mm13797_St14
gtgacagtgtcaacgactgt

SEQ ID NO: 2593 - DNA, 20 bp, Artificial Sequence
  sgRNA
  mm13818_Psap
ctacgtggaccagtattccg

SEQ ID NO: 2594 - DNA, 20 bp, Artificial Sequence
  sgRNA
  mm13819_Psap
gtcaaccacctccttgcacg

SEQ ID NO: 2595 - DNA, 20 bp, Artificial Sequence
  sgRNA
  mm13820_Psap
cctcagctaaccttaggttg

SEQ ID NO: 2596 - DNA, 20 bp, Artificial Sequence
  sgRNA
  mm13821_Psap
tctggcataaaatcacattg

SEQ ID NO: 2597 - DNA, 20 bp, Artificial Sequence
  sgRNA
  mm13834_Psen1
tttcaaccagcatacgaagt

SEQ ID NO: 2598 - DNA, 20 bp, Artificial Sequence
  sgRNA
  mm13835_Psen1
tgctactgtaacgtagtcca

SEQ ID NO: 2599 - DNA, 20 bp, Artificial Sequence
  sgRNA
  mm13836_Psen1
ctgagccaatatctaatggg

SEQ ID NO: 2600 - DNA, 20 bp, Artificial Sequence
  sgRNA
  mm13837_Psen1
agtcagcttctatacccgga

SEQ ID NO: 2601 - DNA, 20 bp, Artificial Sequence
  sgRNA
  mm13838_Psen2
tgtcacgctgtgtatgatcg

SEQ ID NO: 2602 - DNA, 20 bp, Artificial Sequence
  sgRNA
  mm13839_Psen2
gagccccactgcatgcgtag

SEQ ID NO: 2603 - DNA, 20 bp, Artificial Sequence
  sgRNA
  mm13840_Psen2
gatacttgtagagtaccacg

SEQ ID NO: 2604 - DNA, 20 bp, Artificial Sequence
  sgRNA
  mm13841_Psen2
agtgctcaagacctacaatg

SEQ ID NO: 2605 - DNA, 20 bp, Artificial Sequence
  sgRNA
  mm13922_Pstpip1
ctggttacagtgcacccaca

SEQ ID NO: 2606 - DNA, 20 bp, Artificial Sequence
  sgRNA
  mm13923_Pstpip1
tgtttgtagaaagagtgtac

SEQ ID NO: 2607 - DNA, 20 bp, Artificial Sequence
  sgRNA
  mm13924_Pstpip1
attggcactcacacgctcga

SEQ ID NO: 2608 - DNA, 20 bp, Artificial Sequence
  sgRNA
  mm13925_Pstpip1
gtcgctctacaagaagacca

SEQ ID NO: 2609 - DNA, 20 bp, Artificial Sequence
  sgRNA
  mm13934_Ptafr
attgtctactactacaacga

SEQ ID NO: 2610 - DNA, 20 bp, Artificial Sequence
  sgRNA
  mm13935_Ptafr
catcaatacctactgcagtg

SEQ ID NO: 2611 - DNA, 20 bp, Artificial Sequence
  sgRNA
  mm13936_Ptafr
agagatgccacgcttgcggg

SEQ ID NO: 2612 - DNA, 20 bp, Artificial Sequence
  sgRNA
  mm13937_Ptafr
aagacatgaacaacaaggat

SEQ ID NO: 2613 - DNA, 20 bp, Artificial Sequence
  sgRNA
  mm13942_Ptch1
agctaatctcgagaccaacg

SEQ ID NO: 2614 - DNA, 20 bp, Artificial Sequence
  sgRNA
  mm13943_Ptch1
tgtgagggtcatactctgtg

SEQ ID NO: 2615 - DNA, 20 bp, Artificial Sequence
  sgRNA
  mm13944_Ptch1
ctggcagaggacttacgtgg

SEQ ID NO: 2616 - DNA, 20 bp, Artificial Sequence
  sgRNA
  mm13945_Ptch1
taaaaatggatcagatgacg

SEQ ID NO: 2617 - DNA, 20 bp, Artificial Sequence
  sgRNA
  mm13978_Ptger3
tcaagtactaccgacgactg

SEQ ID NO: 2618 - DNA, 20 bp, Artificial Sequence
  sgRNA
  mm13979_Ptger3
atgtggctggcataccagtg

SEQ ID NO: 2619 - DNA, 20 bp, Artificial Sequence
  sgRNA
  mm13980_Ptger3
gggagcagctcgacccatcg

SEQ ID NO: 2620 - DNA, 20 bp, Artificial Sequence
  sgRNA
  mm13981_Ptger3
tggcgctcaccgacttagtg

SEQ ID NO: 2621 - DNA, 20 bp, Artificial Sequence
  sgRNA
  mm13990_Ptgfrn
ggtcacgcttacaccagacg

SEQ ID NO: 2622 - DNA, 20 bp, Artificial Sequence
  sgRNA
  mm13991_Ptgfrn
cattctatagtaccacgaca

SEQ ID NO: 2623 - DNA, 20 bp, Artificial Sequence
  sgRNA
  mm13992_Ptgfrn
atcctagccctaagccacga

SEQ ID NO: 2624 - DNA, 20 bp, Artificial Sequence
  sgRNA
  mm13993_Ptgfrn
agcggggtgatatcctgttg

SEQ ID NO: 2625 - DNA, 20 bp, Artificial Sequence
  sgRNA
  mm14006_Ptgs2
aacatcatatttgagccttg

SEQ ID NO: 2626 - DNA, 20 bp, Artificial Sequence
  sgRNA
  mm14007_Ptgs2
tagtgcacattgtaagtagg

SEQ ID NO: 2627 - DNA, 20 bp, Artificial Sequence
  sgRNA
  mm14008_Ptgs2
gactacgtgcaacacctgag

SEQ ID NO: 2628 - DNA, 20 bp, Artificial Sequence
  sgRNA
  mm14009_Ptgs2
cgtggggaatgtatgagcac

SEQ ID NO: 2629 - DNA, 20 bp, Artificial Sequence
  sgRNA
  mm14018_Pth1r
tccagggcacaaccggacgt

SEQ ID NO: 2630 - DNA, 20 bp, Artificial Sequence
  sgRNA
  mm14019_Pth1r
tcataaatgtaatcgggaca

SEQ ID NO: 2631 - DNA, 20 bp, Artificial Sequence
  sgRNA
  mm14020_Pth1r
ccgcccacctaaaataggct

SEQ ID NO: 2632 - DNA, 20 bp, Artificial Sequence
  sgRNA
  mm14021_Pth1r
gagcaaccttggccaacact

SEQ ID NO: 2633 - DNA, 20 bp, Artificial Sequence
  sgRNA
  mm14042_Ptn
tgtgtgcgtgcctaccagcg

SEQ ID NO: 2634 - DNA, 20 bp, Artificial Sequence
  sgRNA
  mm14043_Ptn
aaggtgaaaaagtctgactg

SEQ ID NO: 2635 - DNA, 20 bp, Artificial Sequence
  sgRNA
  mm14044_Ptn
aagtaccagttccaggcttg

SEQ ID NO: 2636 - DNA, 20 bp, Artificial Sequence
  sgRNA
  mm14045_Ptn
ccaagatgaaaatcaatgcc

SEQ ID NO: 2637 - DNA, 20 bp, Artificial Sequence
  sgRNA
  mm14106_Sirpa
taattctaaggtcatctgcg

SEQ ID NO: 2638 - DNA, 20 bp, Artificial Sequence
  sgRNA
  mm14107_Sirpa
tggagaatggaaacgtatca

SEQ ID NO: 2639 - DNA, 20 bp, Artificial Sequence
  sgRNA
  mm14108_Sirpa
ggaacagaggtctatgtact

SEQ ID NO: 2640 - DNA, 20 bp, Artificial Sequence
  sgRNA
  mm14109_Sirpa
cacctggttcattgacgtcg

SEQ ID NO: 2641 - DNA, 20 bp, Artificial Sequence
  sgRNA
  mm14118_Ptprc
gtagcagaaatcttatatcg

SEQ ID NO: 2642 - DNA, 20 bp, Artificial Sequence
  sgRNA
  mm14119_Ptprc
tttcacaatggagtgtacga

SEQ ID NO: 2643 - DNA, 20 bp, Artificial Sequence
  sgRNA
  mm14120_Ptprc
ttgtcaagctaaggcgacag

SEQ ID NO: 2644 - DNA, 20 bp, Artificial Sequence
  sgRNA
  mm14121_Ptprc
accacaacgaagcaaacatg

SEQ ID NO: 2645 - DNA, 20 bp, Artificial Sequence
  sgRNA
  mm14130_Ptprf
gggttcccgactatcgacat

SEQ ID NO: 2646 - DNA, 20 bp, Artificial Sequence
  sgRNA
  mm14131_Ptprf
ggcagcgagccggaagacgt

SEQ ID NO: 2647 - DNA, 20 bp, Artificial Sequence
  sgRNA
  mm14132_Ptprf
ctgtacacctgactagcgag

SEQ ID NO: 2648 - DNA, 20 bp, Artificial Sequence
  sgRNA
  mm14133_Ptprf
cgaagaccgtaagcgacatg

SEQ ID NO: 2649 - DNA, 20 bp, Artificial Sequence
  sgRNA
  mm14134_Ptprg
taaaaagcctatgtcccgag

SEQ ID NO: 2650 - DNA, 20 bp, Artificial Sequence
  sgRNA
  mm14135_Ptprg
tccactatttcactacaggg

SEQ ID NO: 2651 - DNA, 20 bp, Artificial Sequence
  sgRNA
  mm14136_Ptprg
agcatagtgtcaatggccgg

SEQ ID NO: 2652 - DNA, 20 bp, Artificial Sequence
  sgRNA
  mm14137_Ptprg
ggcacttcacgggaacgtcg

SEQ ID NO: 2653 - DNA, 20 bp, Artificial Sequence
  sgRNA
  mm14138_Ptprj
actgaccgatgtaatattag

SEQ ID NO: 2654 - DNA, 20 bp, Artificial Sequence
  sgRNA
  mm14139_Ptprj
cctggaaaagcaattacgat

SEQ ID NO: 2655 - DNA, 20 bp, Artificial Sequence
  sgRNA
  mm14140_Ptprj
agacaccagggattaactca

SEQ ID NO: 2656 - DNA, 20 bp, Artificial Sequence
  sgRNA
  mm14141_Ptprj
gagtgacaaatgtcagcaca

SEQ ID NO: 2657 - DNA, 20 bp, Artificial Sequence
  sgRNA
  mm14142_Ptprk
taccagaacgccctaagtgg

SEQ ID NO: 2658 - DNA, 20 bp, Artificial Sequence
  sgRNA
  mm14143_Ptprk
tgcgtaactcagtcagaacg

SEQ ID NO: 2659 - DNA, 20 bp, Artificial Sequence
  sgRNA
  mm14144_Ptprk
acctaccgcaaggataactc

SEQ ID NO: 2660 - DNA, 20 bp, Artificial Sequence
  sgRNA
  mm14145_Ptprk
agaagcgcaaagatgcaatg

SEQ ID NO: 2661 - DNA, 20 bp, Artificial Sequence
  sgRNA
  mm14150_Ptprm
agagccgacacaaacatatg

SEQ ID NO: 2662 - DNA, 20 bp, Artificial Sequence
  sgRNA
  mm14151_Ptprm
gtagtgaaagtcgatgcagt

SEQ ID NO: 2663 - DNA, 20 bp, Artificial Sequence
  sgRNA
  mm14152_Ptprm
taaaaaatagatcccatgcg

SEQ ID NO: 2664 - DNA, 20 bp, Artificial Sequence
  sgRNA
  mm14153_Ptprm
caaaattgactgtgtccgag

SEQ ID NO: 2665 - DNA, 20 bp, Artificial Sequence
  sgRNA
  mm14154_Ptprn2
ctcaccatcatccatactcg

SEQ ID NO: 2666 - DNA, 20 bp, Artificial Sequence
  sgRNA
  mm14155_Ptprn2
agatcacagactatcagagg

SEQ ID NO: 2667 - DNA, 20 bp, Artificial Sequence
  sgRNA
  mm14156_Ptprn2
tgctgatgtgtgggccacgt

SEQ ID NO: 2668 - DNA, 20 bp, Artificial Sequence
  sgRNA
  mm14157_Ptprn2
caaggcctacctatggcatg

SEQ ID NO: 2669 - DNA, 20 bp, Artificial Sequence
  sgRNA
  mm14166_Ptprs
atgatgtccttgatgcgcgg

SEQ ID NO: 2670 - DNA, 20 bp, Artificial Sequence
  sgRNA
  mm14167_Ptprs
caattacgtagtaggacacg

SEQ ID NO: 2671 - DNA, 20 bp, Artificial Sequence
  sgRNA
  mm14168_Ptprs
agaagcgtggggccacacgg

SEQ ID NO: 2672 - DNA, 20 bp, Artificial Sequence
  sgRNA
  mm14169_Ptprs
atggagccggaacacccagt

SEQ ID NO: 2673 - DNA, 20 bp, Artificial Sequence
  sgRNA
  mm14170_Ptprt
acctcccaatgagaccaatg

SEQ ID NO: 2674 - DNA, 20 bp, Artificial Sequence
  sgRNA
  mm14171_Ptprt
caaagtagtgtagcgaatcg

SEQ ID NO: 2675 - DNA, 20 bp, Artificial Sequence
  sgRNA
  mm14172_Ptprt
cctgcgactccaaaacgttg

SEQ ID NO: 2676 - DNA, 20 bp, Artificial Sequence
  sgRNA
  mm14173_Ptprt
acagggtcacaagtccggta

SEQ ID NO: 2677 - DNA, 20 bp, Artificial Sequence
  sgRNA
  mm14190_Igdcc3
acagctcggacattgcgtgg

SEQ ID NO: 2678 - DNA, 20 bp, Artificial Sequence
  sgRNA
  mm14191_Igdcc3
cctgacagtgcaccagactg

SEQ ID NO: 2679 - DNA, 20 bp, Artificial Sequence
  sgRNA
  mm14192_Igdcc3
caaagcctacacaccacgag

SEQ ID NO: 2680 - DNA, 20 bp, Artificial Sequence
  sgRNA
  mm14193_Igdcc3
aggtacacactactgcccaa

SEQ ID NO: 2681 - DNA, 20 bp, Artificial Sequence
  sgRNA
  mm14206_Pvrl2
tcccaacggtacccgcaggg

SEQ ID NO: 2682 - DNA, 20 bp, Artificial Sequence
  sgRNA
  mm14207_Pvrl2
gcgggtacgagtgcttcccg

SEQ ID NO: 2683 - DNA, 20 bp, Artificial Sequence
  sgRNA
  mm14208_Pvrl2
tttccacccatccttcggag

SEQ ID NO: 2684 - DNA, 20 bp, Artificial Sequence
  sgRNA
  mm14209_Pvrl2
tgaccattcgatccacagag

SEQ ID NO: 2685 - DNA, 20 bp, Artificial Sequence
  sgRNA
  mm14494_Robo3
tctgcgtagaccaataaacc

SEQ ID NO: 2686 - DNA, 20 bp, Artificial Sequence
  sgRNA
  mm14495_Robo3
ggcctcgacccaacatcgag

SEQ ID NO: 2687 - DNA, 20 bp, Artificial Sequence
  sgRNA
  mm14496_Robo3
catcactgaagtaaagatcg

SEQ ID NO: 2688 - DNA, 20 bp, Artificial Sequence
  sgRNA
  mm14497_Robo3
tgtggccaagagttccatag

SEQ ID NO: 2689 - DNA, 20 bp, Artificial Sequence
  sgRNA
  mm14578_Rdx
aaaaacagttggcttacgtg

SEQ ID NO: 2690 - DNA, 20 bp, Artificial Sequence
  sgRNA
  mm14579_Rdx
gagaatacagaactggcatg

SEQ ID NO: 2691 - DNA, 20 bp, Artificial Sequence
  sgRNA
  mm14580_Rdx
accatgaactgtacatgcga

SEQ ID NO: 2692 - DNA, 20 bp, Artificial Sequence
  sgRNA
  mm14581_Rdx
aataaagagattcacaaacc

SEQ ID NO: 2693 - DNA, 20 bp, Artificial Sequence
  sgRNA
  mm14670_Rfng
cgggacgcgcacctgccgtg

SEQ ID NO: 2694 - DNA, 20 bp, Artificial Sequence
  sgRNA
  mm14671_Rfng
agcaattggtgttgatcatg

SEQ ID NO: 2695 - DNA, 20 bp, Artificial Sequence
  sgRNA
  mm14672_Rfng
tccgggtcgggacccgatcg

SEQ ID NO: 2696 - DNA, 20 bp, Artificial Sequence
  sgRNA
  mm14673_Rfng
agcactgtgctgcaaaatgt

SEQ ID NO: 2697 - DNA, 20 bp, Artificial Sequence
  sgRNA
  mm14734_Rhag
cctgcataatcgtaccccat

SEQ ID NO: 2698 - DNA, 20 bp, Artificial Sequence
  sgRNA
  mm14735_Rhag
gcaatggctgaattaaagct

SEQ ID NO: 2699 - DNA, 20 bp, Artificial Sequence
  sgRNA
  mm14736_Rhag
ggcataggctgtgatcacac

SEQ ID NO: 2700 - DNA, 20 bp, Artificial Sequence
  sgRNA
  mm14737_Rhag
tcatgatcaacatttgaatg

SEQ ID NO: 2701 - DNA, 20 bp, Artificial Sequence
  sgRNA
  mm14810_Robo1
ttcgatgtaagcgctccacg

SEQ ID NO: 2702 - DNA, 20 bp, Artificial Sequence
  sgRNA
  mm14811_Robo1
gctggacgttcgtaatggtg

SEQ ID NO: 2703 - DNA, 20 bp, Artificial Sequence
  sgRNA
  mm14812_Robo1
gatacagttacacttcgggg

SEQ ID NO: 2704 - DNA, 20 bp, Artificial Sequence
  sgRNA
  mm14813_Robo1
ctgggtctcttcacaaacga

SEQ ID NO: 2705 - DNA, 20 bp, Artificial Sequence
  sgRNA
  mm14830_Mst1r
aagtatcagactttagacga

SEQ ID NO: 2706 - DNA, 20 bp, Artificial Sequence
  sgRNA
  mm14831_Mst1r
gggaacacaccagatcaccg

SEQ ID NO: 2707 - DNA, 20 bp, Artificial Sequence
  sgRNA
  mm14832_Mst1r
atgtggtccgaaaccctcag

SEQ ID NO: 2708 - DNA, 20 bp, Artificial Sequence
  sgRNA
  mm14833_Mst1r
aagacgtgtcacatgcagtg

SEQ ID NO: 2709 - DNA, 20 bp, Artificial Sequence
  sgRNA
  mm14842_Ros1
gggttgtagaacatgttgcg

SEQ ID NO: 2710 - DNA, 20 bp, Artificial Sequence
  sgRNA
  mm14843_Ros1
agagatatgagatacggaca

SEQ ID NO: 2711 - DNA, 20 bp, Artificial Sequence
  sgRNA
  mm14844_Ros1
gtcatggtgtgacattacgc

SEQ ID NO: 2712 - DNA, 20 bp, Artificial Sequence
  sgRNA
  mm14845_Ros1
gtcactccttatacctactg

SEQ ID NO: 2713 - DNA, 20 bp, Artificial Sequence
  sgRNA
  mm14878_Rpl18
tgtgaccgtccccacaacca

SEQ ID NO: 2714 - DNA, 20 bp, Artificial Sequence
  sgRNA
  mm14879_Rpl18
tggctgactactaaccatgc

SEQ ID NO: 2715 - DNA, 20 bp, Artificial Sequence
  sgRNA
  mm14880_Rpl18
ttaccttgacaagcagccgc

SEQ ID NO: 2716 - DNA, 20 bp, Artificial Sequence
  sgRNA
  mm14881_Rpl18
tcgccacaacaaggaccgaa

SEQ ID NO: 2717 - DNA, 20 bp, Artificial Sequence
  sgRNA
  mm14886_Rpl21
attcgcatgtatgtggccaa

SEQ ID NO: 2718 - DNA, 20 bp, Artificial Sequence
  sgRNA
  mm14887_Rpl21
aaggcctagagaacatgtac

SEQ ID NO: 2719 - DNA, 20 bp, Artificial Sequence
  sgRNA
  mm14888_Rpl21
gggcatcattgtcaacaagc

SEQ ID NO: 2720 - DNA, 20 bp, Artificial Sequence
  sgRNA
  mm14889_Rpl21
atgccccataagtgctacca

SEQ ID NO: 2721 - DNA, 20 bp, Artificial Sequence
  sgRNA
  mm14918_Rpl32
tgtgtcttcagcgaaactgg

SEQ ID NO: 2722 - DNA, 20 bp, Artificial Sequence
  sgRNA
  mm14919_Rpl32
accaagcacatgctgcccag

SEQ ID NO: 2723 - DNA, 20 bp, Artificial Sequence
  sgRNA
  mm14920_Rpl32
gaggcattgacaacagggtg

SEQ ID NO: 2724 - DNA, 20 bp, Artificial Sequence
  sgRNA
  mm14921_Rpl32
ccacaatgtcaaggagctgg

SEQ ID NO: 2725 - DNA, 20 bp, Artificial Sequence
  sgRNA
  mm14938_Rpl9
agggcttccgatacaagatg

SEQ ID NO: 2726 - DNA, 20 bp, Artificial Sequence
  sgRNA
  mm14939_Rpl9
ctgtcctcatccgaaccctg

SEQ ID NO: 2727 - DNA, 20 bp, Artificial Sequence
  sgRNA
  mm14940_Rpl9
actgcagatggtcctgacgg

SEQ ID NO: 2728 - DNA, 20 bp, Artificial Sequence
  sgRNA
  mm14941_Rpl9
ggacttcaatcacatcaacg

SEQ ID NO: 2729 - DNA, 20 bp, Artificial Sequence
  sgRNA
  mm14942_Rpn2
gcacaaccaccactggtacg

SEQ ID NO: 2730 - DNA, 20 bp, Artificial Sequence
  sgRNA
  mm14943_Rpn2
tggacggttcggtccccacg

SEQ ID NO: 2731 - DNA, 20 bp, Artificial Sequence
  sgRNA
  mm14944_Rpn2
tgtgaaggggcggtccagtg

SEQ ID NO: 2732 - DNA, 20 bp, Artificial Sequence
  sgRNA
  mm14945_Rpn2
tgcaactgcatggtagatct

SEQ ID NO: 2733 - DNA, 20 bp, Artificial Sequence
  sgRNA
  mm14958_Polr1a
tgtcaaacacaatattgacg

SEQ ID NO: 2734 - DNA, 20 bp, Artificial Sequence
  sgRNA
  mm14959_Polr1a
gattgatatgaagttcaagg

SEQ ID NO: 2735 - DNA, 20 bp, Artificial Sequence
  sgRNA
  mm14960_Polr1a
gaggagggtcgacacaacct

SEQ ID NO: 2736 - DNA, 20 bp, Artificial Sequence
  sgRNA
  mm14961_Polr1a
gaattgacaaggctcagatg

SEQ ID NO: 2737 - DNA, 20 bp, Artificial Sequence
  sgRNA
  mm15046_Rps8
acggcccgctgccaacacga

SEQ ID NO: 2738 - DNA, 20 bp, Artificial Sequence
  sgRNA
  mm15047_Rps8
cacgatgcagttcttcacca

SEQ ID NO: 2739 - DNA, 20 bp, Artificial Sequence
  sgRNA
  mm15048_Rps8
tttcattcagactcctgagg

SEQ ID NO: 2740 - DNA, 20 bp, Artificial Sequence
  sgRNA
  mm15049_Rps8
acagcacgccgtaccgacag

SEQ ID NO: 2741 - DNA, 20 bp, Artificial Sequence
  sgRNA
  mm15130_Ryk
actgatgtaaaacacacgcg

SEQ ID NO: 2742 - DNA, 20 bp, Artificial Sequence
  sgRNA
  mm15131_Ryk
tgagcagaaatattgacctg

SEQ ID NO: 2743 - DNA, 20 bp, Artificial Sequence
  sgRNA
  mm15132_Ryk
tgcacacatgagtaatagga

SEQ ID NO: 2744 - DNA, 20 bp, Artificial Sequence
  sgRNA
  mm15133_Ryk
cctcaggttatcctaccttg

SEQ ID NO: 2745 - DNA, 20 bp, Artificial Sequence
  sgRNA
  mm15318_Scn5a
agtcgaagctggtgtaaccg

SEQ ID NO: 2746 - DNA, 20 bp, Artificial Sequence
  sgRNA
  mm15319_Scn5a
gcaaatcccagacctcgggg

SEQ ID NO: 2747 - DNA, 20 bp, Artificial Sequence
  sgRNA
  mm15320_Scn5a
ctggtcaagattctagctcg

SEQ ID NO: 2748 - DNA, 20 bp, Artificial Sequence
  sgRNA
  mm15321_Scn5a
gcatggtggacacttacggt

SEQ ID NO: 2749 - DNA, 20 bp, Artificial Sequence
  sgRNA
  mm15330_Scn9a
gccagttccaagggtcacgg

SEQ ID NO: 2750 - DNA, 20 bp, Artificial Sequence
  sgRNA
  mm15331_Scn9a
gtgtccgtagagatttaatg

SEQ ID NO: 2751 - DNA, 20 bp, Artificial Sequence
  sgRNA
  mm15332_Scn9a
tatctcaaaccgtacccttg

SEQ ID NO: 2752 - DNA, 20 bp, Artificial Sequence
  sgRNA
  mm15333_Scn9a
ctgagtacacgagtttaggg

SEQ ID NO: 2753 - DNA, 20 bp, Artificial Sequence
  sgRNA
  mm15334_Scnn1a
ccagacatactcatccgggg

SEQ ID NO: 2754 - DNA, 20 bp, Artificial Sequence
  sgRNA
  mm15335_Scnn1a
tgtagcagttcccatacatg

SEQ ID NO: 2755 - DNA, 20 bp, Artificial Sequence
  sgRNA
  mm15336_Scnn1a
ctgccagtacatcatgccga

SEQ ID NO: 2756 - DNA, 20 bp, Artificial Sequence
  sgRNA
  mm15337_Scnn1a
aaagcgtctgttccgtgatg

SEQ ID NO: 2757 - DNA, 20 bp, Artificial Sequence
  sgRNA
  mm15338_Scnn1b
caagacgatgaacttcccgg

SEQ ID NO: 2758 - DNA, 20 bp, Artificial Sequence
  sgRNA
  mm15339_Scnn1b
gacgtaccccttcattagag

SEQ ID NO: 2759 - DNA, 20 bp, Artificial Sequence
  sgRNA
  mm15340_Scnn1b
agctaggattatgcgatcag

SEQ ID NO: 2760 - DNA, 20 bp, Artificial Sequence
  sgRNA
  mm15341_Scnn1b
agagaaatactgcaacaaca

SEQ ID NO: 2761 - DNA, 20 bp, Artificial Sequence
  sgRNA
  mm15342_Scnn1g
taccctttcatcgaagacgt

SEQ ID NO: 2762 - DNA, 20 bp, Artificial Sequence
  sgRNA
  mm15343_Scnn1g
ggcgcactgccagataatga

SEQ ID NO: 2763 - DNA, 20 bp, Artificial Sequence
  sgRNA
  mm15344_Scnn1g
gggtggtgtgccttcccacg

SEQ ID NO: 2764 - DNA, 20 bp, Artificial Sequence
  sgRNA
  mm15345_Scnn1g
acgaagatggtggaaaaatg

SEQ ID NO: 2765 - DNA, 20 bp, Artificial Sequence
  sgRNA
  mm15362_Msr1
gtattagtactgcaaacaca

SEQ ID NO: 2766 - DNA, 20 bp, Artificial Sequence
  sgRNA
  mm15363_Msr1
tttcgtcagtccaggaacat

SEQ ID NO: 2767 - DNA, 20 bp, Artificial Sequence
  sgRNA
  mm15364_Msr1
aaaagccgaccttatagaca

SEQ ID NO: 2768 - DNA, 20 bp, Artificial Sequence
  sgRNA
  mm15365_Msr1
gaaagaagaacaagcgcacg

SEQ ID NO: 2769 - DNA, 20 bp, Artificial Sequence
  sgRNA
  mm15442_Cx3cl1
gggtggacaatgtgacacct

SEQ ID NO: 2770 - DNA, 20 bp, Artificial Sequence
  sgRNA
  mm15443_Cx3cl1
gatgacctcacgaatcccag

SEQ ID NO: 2771 - DNA, 20 bp, Artificial Sequence
  sgRNA
  mm15444_Cx3cl1
actgactactatttcccagg

SEQ ID NO: 2772 - DNA, 20 bp, Artificial Sequence
  sgRNA
  mm15445_Cx3cl1
ggccaacccccatgggtcca

SEQ ID NO: 2773 - DNA, 20 bp, Artificial Sequence
  sgRNA
  mm15446_Cxcl12
ctaggacttacacaatctga

SEQ ID NO: 2774 - DNA, 20 bp, Artificial Sequence
  sgRNA
  mm15447_Cxcl12
accgtcactgatgcagagcg

SEQ ID NO: 2775 - DNA, 20 bp, Artificial Sequence
  sgRNA
  mm15448_Cxcl12
tggctctcgaagaaccggca

SEQ ID NO: 2776 - DNA, 20 bp, Artificial Sequence
  sgRNA
  mm15449_Cxcl12
gggcacagtttggagtgttg

SEQ ID NO: 2777 - DNA, 20 bp, Artificial Sequence
  sgRNA
  mm15466_Nptn
tgacaaaatgatatacacag

SEQ ID NO: 2778 - DNA, 20 bp, Artificial Sequence
  sgRNA
  mm15467_Nptn
gttgctggcattcttacggg

SEQ ID NO: 2779 - DNA, 20 bp, Artificial Sequence
  sgRNA
  mm15468_Nptn
gagctattagaaatctcctg

SEQ ID NO: 2780 - DNA, 20 bp, Artificial Sequence
  sgRNA
  mm15469_Nptn
atgatgtactgcaagtcagt

SEQ ID NO: 2781 - DNA, 20 bp, Artificial Sequence
  sgRNA
  mm15470_Frrs1
gctttaggtgtcgtaaaggg

SEQ ID NO: 2782 - DNA, 20 bp, Artificial Sequence
  sgRNA
  mm15471_Frrs1
tcagtgatggttgaaatgag

SEQ ID NO: 2783 - DNA, 20 bp, Artificial Sequence
  sgRNA
  mm15472_Frrs1
caggactccaatgctgaccg

SEQ ID NO: 2784 - DNA, 20 bp, Artificial Sequence
  sgRNA
  mm15473_Frrs1
cagaaatcgtatgtgatctg

SEQ ID NO: 2785 - DNA, 20 bp, Artificial Sequence
  sgRNA
  mm15498_Sel1l
caagcccgctctgtcccacg

SEQ ID NO: 2786 - DNA, 20 bp, Artificial Sequence
  sgRNA
  mm15499_Sel1l
aaaacccggggatgaacagt

SEQ ID NO: 2787 - DNA, 20 bp, Artificial Sequence
  sgRNA
  mm15500_Sel1l
gccagcaactactttgcccg

SEQ ID NO: 2788 - DNA, 20 bp, Artificial Sequence
  sgRNA
  mm15501_Sel1l
tcggctctatgtactacagt

SEQ ID NO: 2789 - DNA, 20 bp, Artificial Sequence
  sgRNA
  mm15506_Glg1
cattcaaagctcgatcaatg

SEQ ID NO: 2790 - DNA, 20 bp, Artificial Sequence
  sgRNA
  mm15507_Glg1
tcctgcttggtggatcatcg

SEQ ID NO: 2791 - DNA, 20 bp, Artificial Sequence
  sgRNA
  mm15508_Glg1
gtctaaatgaaagtcatccg

SEQ ID NO: 2792 - DNA, 20 bp, Artificial Sequence
  sgRNA
  mm15509_Glg1
gtggaatgcagagacatcgt

SEQ ID NO: 2793 - DNA, 20 bp, Artificial Sequence
  sgRNA
  mm15518_Sell
tgacgcctgtcacaaacgaa

SEQ ID NO: 2794 - DNA, 20 bp, Artificial Sequence
  sgRNA
  mm15519_Sell
gtccatggtacccaactcag

SEQ ID NO: 2795 - DNA, 20 bp, Artificial Sequence
  sgRNA
  mm15520_Sell
acacgtgcatctgtgatgca

SEQ ID NO: 2796 - DNA, 20 bp, Artificial Sequence
  sgRNA
  mm15521_Sell
ttctgaaaagcccatgaact

SEQ ID NO: 2797 - DNA, 20 bp, Artificial Sequence
  sgRNA
  mm15522_Selp
atgtaccgtcacacttcggg

SEQ ID NO: 2798 - DNA, 20 bp, Artificial Sequence
  sgRNA
  mm15523_Selp
gggaacaaataagacactca

SEQ ID NO: 2799 - DNA, 20 bp, Artificial Sequence
  sgRNA
  mm15524_Selp
tggtacgtcaaggtaccgaa

SEQ ID NO: 2800 - DNA, 20 bp, Artificial Sequence
  sgRNA
  mm15525_Selp
ttgtaggtggaattcccaag

SEQ ID NO: 2801 - DNA, 20 bp, Artificial Sequence
  sgRNA
  mm15530_Sema3a
tagaataggtcagatatgca

SEQ ID NO: 2802 - DNA, 20 bp, Artificial Sequence
  sgRNA
  mm15531_Sema3a
gtgaacactccatagacgat

SEQ ID NO: 2803 - DNA, 20 bp, Artificial Sequence
  sgRNA
  mm15532_Sema3a
gaacggagtagactatatgt

SEQ ID NO: 2804 - DNA, 20 bp, Artificial Sequence
  sgRNA
  mm15533_Sema3a
acaaattgttgtagaccgag

SEQ ID NO: 2805 - DNA, 20 bp, Artificial Sequence
  sgRNA
  mm15538_Sema3c
gtgtgcacctacctgaaccg

SEQ ID NO: 2806 - DNA, 20 bp, Artificial Sequence
  sgRNA
  mm15539_Sema3c
tatctctcccatctagatcg

SEQ ID NO: 2807 - DNA, 20 bp, Artificial Sequence
  sgRNA
  mm15540_Sema3c
atcaagaccggatatatgtg

SEQ ID NO: 2808 - DNA, 20 bp, Artificial Sequence
  sgRNA
  mm15541_Sema3c
acatgtgcgtccacaaacat

SEQ ID NO: 2809 - DNA, 20 bp, Artificial Sequence
  sgRNA
  mm15554_Sema4b
tcgggcaactcgggacacga

SEQ ID NO: 2810 - DNA, 20 bp, Artificial Sequence
  sgRNA
  mm15555_Sema4b
ctactgatacctaccgctcc

SEQ ID NO: 2811 - DNA, 20 bp, Artificial Sequence
  sgRNA
  mm15556_Sema4b
gggtcttgcgccaatcctga

SEQ ID NO: 2812 - DNA, 20 bp, Artificial Sequence
  sgRNA
  mm15557_Sema4b
tccctcaactggctacaagg

SEQ ID NO: 2813 - DNA, 20 bp, Artificial Sequence
  sgRNA
  mm15558_Sema4d
gatggcatactccgtcctca

SEQ ID NO: 2814 - DNA, 20 bp, Artificial Sequence
  sgRNA
  mm15559_Sema4d
ggctggattcaggacatgag

SEQ ID NO: 2815 - DNA, 20 bp, Artificial Sequence
  sgRNA
  mm15560_Sema4d
cttgggtctgttgtctatcg

SEQ ID NO: 2816 - DNA, 20 bp, Artificial Sequence
  sgRNA
  mm15561_Sema4d
attggtcccacacacataga

SEQ ID NO: 2817 - DNA, 20 bp, Artificial Sequence
  sgRNA
  mm15570_Sema5b
gttcggcctatcatagccag

SEQ ID NO: 2818 - DNA, 20 bp, Artificial Sequence
  sgRNA
  mm15571_Sema5b
ttatactgggcagtgcgaag

SEQ ID NO: 2819 - DNA, 20 bp, Artificial Sequence
  sgRNA
  mm15572_Sema5b
ccagagcaaagggaaaacgg

SEQ ID NO: 2820 - DNA, 20 bp, Artificial Sequence
  sgRNA
  mm15573_Sema5b
ctctatcacgtactctacat

SEQ ID NO: 2821 - DNA, 20 bp, Artificial Sequence
  sgRNA
  mm15586_Sema7a
cctcggtttcgacgcattcg

SEQ ID NO: 2822 - DNA, 20 bp, Artificial Sequence
  sgRNA
  mm15587_Sema7a
tggtacttagaatggaacaa

SEQ ID NO: 2823 - DNA, 20 bp, Artificial Sequence
  sgRNA
  mm15588_Sema7a
ggtgaacatcggctccacaa

SEQ ID NO: 2824 - DNA, 20 bp, Artificial Sequence
  sgRNA
  mm15589_Sema7a
acaacgaactctcaccaccc

SEQ ID NO: 2825 - DNA, 20 bp, Artificial Sequence
  sgRNA
  mm15606_Sez6
gagtcggactggtaaagacg

SEQ ID NO: 2826 - DNA, 20 bp, Artificial Sequence
  sgRNA
  mm15607_Sez6
ccgcaatggaaataacgtgg

SEQ ID NO: 2827 - DNA, 20 bp, Artificial Sequence
  sgRNA
  mm15608_Sez6
aggaacgactggttagccaa

SEQ ID NO: 2828 - DNA, 20 bp, Artificial Sequence
  sgRNA
  mm15609_Sez6
ctaccctgtgggtacaactg

SEQ ID NO: 2829 - DNA, 20 bp, Artificial Sequence
  sgRNA
  mm15618_Sfrp1
gacatcggctcgtatcagag

SEQ ID NO: 2830 - DNA, 20 bp, Artificial Sequence
  sgRNA
  mm15619_Sfrp1
caaatgtgacaagttccccg

SEQ ID NO: 2831 - DNA, 20 bp, Artificial Sequence
  sgRNA
  mm15620_Sfrp1
ttcaactcgttgtcgcatgg

SEQ ID NO: 2832 - DNA, 20 bp, Artificial Sequence
  sgRNA
  mm15621_Sfrp1
ctgaggctgtgccacaacgt

SEQ ID NO: 2833 - DNA, 20 bp, Artificial Sequence
  sgRNA
  mm15626_Sfrp4
ttgcaatgaggtcacaactg

SEQ ID NO: 2834 - DNA, 20 bp, Artificial Sequence
  sgRNA
  mm15627_Sfrp4
agggcttgatgggatcgtgc

SEQ ID NO: 2835 - DNA, 20 bp, Artificial Sequence
  sgRNA
  mm15628_Sfrp4
tgtggttatacatcttcatg

SEQ ID NO: 2836 - DNA, 20 bp, Artificial Sequence
  sgRNA
  mm15629_Sfrp4
gagctgccggtctatgaccg

SEQ ID NO: 2837 - DNA, 20 bp, Artificial Sequence
  sgRNA
  mm15658_Sgce
gatggcttcgatatatccaa

SEQ ID NO: 2838 - DNA, 20 bp, Artificial Sequence
  sgRNA
  mm15659_Sgce
agaatgtgccagtggtcgcg

SEQ ID NO: 2839 - DNA, 20 bp, Artificial Sequence
  sgRNA
  mm15660_Sgce
cgactggtgcaagatttcac

SEQ ID NO: 2840 - DNA, 20 bp, Artificial Sequence
  sgRNA
  mm15661_Sgce
gcttcctattaatgacatga

SEQ ID NO: 2841 - DNA, 20 bp, Artificial Sequence
  sgRNA
  mm15730_Shh
tggcgccgcacaacgactcg

SEQ ID NO: 2842 - DNA, 20 bp, Artificial Sequence
  sgRNA
  mm15731_Shh
aggaaaacacgggagcagac

SEQ ID NO: 2843 - DNA, 20 bp, Artificial Sequence
  sgRNA
  mm15732_Shh
gtgctggcggctgacgacca

SEQ ID NO: 2844 - DNA, 20 bp, Artificial Sequence
  sgRNA
  mm15733_Shh
aaactgcttgtaggctaaag

SEQ ID NO: 2845 - DNA, 20 bp, Artificial Sequence
  sgRNA
  mm15770_St3gal1
accagcctcttgttcaacat

SEQ ID NO: 2846 - DNA, 20 bp, Artificial Sequence
  sgRNA
  mm15771_St3gal1
gtcgatctcaggcccatacg

SEQ ID NO: 2847 - DNA, 20 bp, Artificial Sequence
  sgRNA
  mm15772_St3gal1
aggatacacgagatggtggg

SEQ ID NO: 2848 - DNA, 20 bp, Artificial Sequence
  sgRNA
  mm15773_St3gal1
gctgtgacttgatgaacctg

SEQ ID NO: 2849 - DNA, 20 bp, Artificial Sequence
  sgRNA
  mm15774_St3gal4
caacacagcgacgacactcg

SEQ ID NO: 2850 - DNA, 20 bp, Artificial Sequence
  sgRNA
  mm15775_St3gal4
tcaagatggtctcaatccag

SEQ ID NO: 2851 - DNA, 20 bp, Artificial Sequence
  sgRNA
  mm15776_St3gal4
tgtcatcaacaagtacgacg

SEQ ID NO: 2852 - DNA, 20 bp, Artificial Sequence
  sgRNA
  mm15777_St3gal4
aagggcagctcataggtgga

SEQ ID NO: 2853 - DNA, 20 bp, Artificial Sequence
  sgRNA
  mm15798_St8sia1
gtgtactcacttgacaaggg

SEQ ID NO: 2854 - DNA, 20 bp, Artificial Sequence
  sgRNA
  mm15799_St8sia1
ccgcgtacccggctacccgt

SEQ ID NO: 2855 - DNA, 20 bp, Artificial Sequence
  sgRNA
  mm15800_St8sia1
ggagtacgtggaattatcga

SEQ ID NO: 2856 - DNA, 20 bp, Artificial Sequence
  sgRNA
  mm15801_St8sia1
accccagcataattcgccag

SEQ ID NO: 2857 - DNA, 20 bp, Artificial Sequence
  sgRNA
  mm15802_St8sia2
aggaccttgtgaacgccacg

SEQ ID NO: 2858 - DNA, 20 bp, Artificial Sequence
  sgRNA
  mm15803_St8sia2
tttccagacttgtgccatcg

SEQ ID NO: 2859 - DNA, 20 bp, Artificial Sequence
  sgRNA
  mm15804_St8sia2
acaaccagacgctctctctg

SEQ ID NO: 2860 - DNA, 20 bp, Artificial Sequence
  sgRNA
  mm15805_St8sia2
aggatatttctgtccttaag

SEQ ID NO: 2861 - DNA, 20 bp, Artificial Sequence
  sgRNA
  mm15806_St8sia3
gcgtggaacatgtacattcg

SEQ ID NO: 2862 - DNA, 20 bp, Artificial Sequence
  sgRNA
  mm15807_St8sia3
tgctcggattgaaggttgtg

SEQ ID NO: 2863 - DNA, 20 bp, Artificial Sequence
  sgRNA
  mm15808_St8sia3
tcataatgggcgacacatct

SEQ ID NO: 2864 - DNA, 20 bp, Artificial Sequence
  sgRNA
  mm15809_St8sia3
gaaacagtggaatcttgaca

SEQ ID NO: 2865 - DNA, 20 bp, Artificial Sequence
  sgRNA
  mm15814_St3gal5
gttcgggcagcatatccaag

SEQ ID NO: 2866 - DNA, 20 bp, Artificial Sequence
  sgRNA
  mm15815_St3gal5
tagtattcaacgtccgacag

SEQ ID NO: 2867 - DNA, 20 bp, Artificial Sequence
  sgRNA
  mm15816_St3gal5
cgccctcaaccagttcgatg

SEQ ID NO: 2868 - DNA, 20 bp, Artificial Sequence
  sgRNA
  mm15817_St3gal5
agctgagaagtgattgctca

SEQ ID NO: 2869 - DNA, 20 bp, Artificial Sequence
  sgRNA
  mm15910_Slc12a1
catcatcggttccatcaccg

SEQ ID NO: 2870 - DNA, 20 bp, Artificial Sequence
  sgRNA
  mm15911_Slc12a1
acaaacggagtggtgcgagg

SEQ ID NO: 2871 - DNA, 20 bp, Artificial Sequence
  sgRNA
  mm15912_Slc12a1
gtgggttatatccaagagag

SEQ ID NO: 2872 - DNA, 20 bp, Artificial Sequence
  sgRNA
  mm15913_Slc12a1
ccatggctatcacaaaagtg

SEQ ID NO: 2873 - DNA, 20 bp, Artificial Sequence
  sgRNA
  mm15914_Slc12a2
cggtttccgagaacgccggg

SEQ ID NO: 2874 - DNA, 20 bp, Artificial Sequence
  sgRNA
  mm15915_Slc12a2
aaacgtccctatgacgaagt

SEQ ID NO: 2875 - DNA, 20 bp, Artificial Sequence
  sgRNA
  mm15916_Slc12a2
gttaagatgtaaccacgaag

SEQ ID NO: 2876 - DNA, 20 bp, Artificial Sequence
  sgRNA
  mm15917_Slc12a2
tccgacaacatacatagcaa

SEQ ID NO: 2877 - DNA, 20 bp, Artificial Sequence
  sgRNA
  mm15922_Slc12a4
agcaaacggtgaaccgacgt

SEQ ID NO: 2878 - DNA, 20 bp, Artificial Sequence
  sgRNA
  mm15923_Slc12a4
ggtggcgcttgacatgtcat

SEQ ID NO: 2879 - DNA, 20 bp, Artificial Sequence
  sgRNA
  mm15924_Slc12a4
gttactcacggaaacacggg

SEQ ID NO: 2880 - DNA, 20 bp, Artificial Sequence
  sgRNA
  mm15925_Slc12a4
cccagaagtctatcccagtg

SEQ ID NO: 2881 - DNA, 20 bp, Artificial Sequence
  sgRNA
  mm15926_Slc12a7
aatgaaagatgtagtcacga

SEQ ID NO: 2882 - DNA, 20 bp, Artificial Sequence
  sgRNA
  mm15927_Slc12a7
aacaacgttactgagataca

SEQ ID NO: 2883 - DNA, 20 bp, Artificial Sequence
  sgRNA
  mm15928_Slc12a7
tggtcatggaaaggccaacg

SEQ ID NO: 2884 - DNA, 20 bp, Artificial Sequence
  sgRNA
  mm15929_Slc12a7
agcagatgaacatcagcgcg

SEQ ID NO: 2885 - DNA, 20 bp, Artificial Sequence
  sgRNA
  mm15950_Slc34a1
agttgagcatcttcacaagg

SEQ ID NO: 2886 - DNA, 20 bp, Artificial Sequence
  sgRNA
  mm15951_Slc34a1
tgacccactacctaccaagc

SEQ ID NO: 2887 - DNA, 20 bp, Artificial Sequence
  sgRNA
  mm15952_Slc34a1
gtgtcacccagacacaacag

SEQ ID NO: 2888 - DNA, 20 bp, Artificial Sequence
  sgRNA
  mm15953_Slc34a1
tgccatcctatccaacccag

SEQ ID NO: 2889 - DNA, 20 bp, Artificial Sequence
  sgRNA
  mm15962_Slc1a1
cgactcacctagtaccacgg

SEQ ID NO: 2890 - DNA, 20 bp, Artificial Sequence
  sgRNA
  mm15963_Slc1a1
taggattacagcaatgacgg

SEQ ID NO: 2891 - DNA, 20 bp, Artificial Sequence
  sgRNA
  mm15964_Slc1a1
atcatgctggatacgatcag

SEQ ID NO: 2892 - DNA, 20 bp, Artificial Sequence
  sgRNA
  mm15965_Slc1a1
tcacctgatcaggtccaaca

SEQ ID NO: 2893 - DNA, 20 bp, Artificial Sequence
  sgRNA
  mm15966_Slc1a2
catgttgatagccttcccgg

SEQ ID NO: 2894 - DNA, 20 bp, Artificial Sequence
  sgRNA
  mm15967_Slc1a2
ccatagctctcgtgcctagg

SEQ ID NO: 2895 - DNA, 20 bp, Artificial Sequence
  sgRNA
  mm15968_Slc1a2
taattgcccataggtctgat

SEQ ID NO: 2896 - DNA, 20 bp, Artificial Sequence
  sgRNA
  mm15969_Slc1a2
gttcatggtttcattcaaca

SEQ ID NO: 2897 - DNA, 20 bp, Artificial Sequence
  sgRNA
  mm15970_Slc1a3
gtataaaatgagctaccggg

SEQ ID NO: 2898 - DNA, 20 bp, Artificial Sequence
  sgRNA
  mm15971_Slc1a3
gactctgacccggatccggg

SEQ ID NO: 2899 - DNA, 20 bp, Artificial Sequence
  sgRNA
  mm15972_Slc1a3
gaggccgacaatgactgtca

SEQ ID NO: 2900 - DNA, 20 bp, Artificial Sequence
  sgRNA
  mm15973_Slc1a3
aggcttctaccagattggga

SEQ ID NO: 2901 - DNA, 20 bp, Artificial Sequence
  sgRNA
  mm15978_Slc1a5
aatccctatcgattcctgtg

SEQ ID NO: 2902 - DNA, 20 bp, Artificial Sequence
  sgRNA
  mm15979_Slc1a5
tacaacagagtcgttgatgg

SEQ ID NO: 2903 - DNA, 20 bp, Artificial Sequence
  sgRNA
  mm15980_Slc1a5
gcgggagatcaattcaacca

SEQ ID NO: 2904 - DNA, 20 bp, Artificial Sequence
  sgRNA
  mm15981_Slc1a5
gtggtgtgcagcctgatcgg

SEQ ID NO: 2905 - DNA, 20 bp, Artificial Sequence
  sgRNA
  mm15986_Slc20a2
atactgtacacaaagactcg

SEQ ID NO: 2906 - DNA, 20 bp, Artificial Sequence
  sgRNA
  mm15987_Slc20a2
gccttaccataggaagcccg

SEQ ID NO: 2907 - DNA, 20 bp, Artificial Sequence
  sgRNA
  mm15988_Slc20a2
aagtggcgatataaaccagg

SEQ ID NO: 2908 - DNA, 20 bp, Artificial Sequence
  sgRNA
  mm15989_Slc20a2
atggtagcagcataaaacag

SEQ ID NO: 2909 - DNA, 20 bp, Artificial Sequence
  sgRNA
  mm16002_Slc22a5
tttatgatctgatccgaaca

SEQ ID NO: 2910 - DNA, 20 bp, Artificial Sequence
  sgRNA
  mm16003_Slc22a5
gggtcagatctccaactacg

SEQ ID NO: 2911 - DNA, 20 bp, Artificial Sequence
  sgRNA
  mm16004_Slc22a5
cacaaggcaacggtgctccg

SEQ ID NO: 2912 - DNA, 20 bp, Artificial Sequence
  sgRNA
  mm16005_Slc22a5
cacacccacgaaaaacaagg

SEQ ID NO: 2913 - DNA, 20 bp, Artificial Sequence
  sgRNA
  mm16022_Slc2a1
cctgctcatcaatcgtaacg

SEQ ID NO: 2914 - DNA, 20 bp, Artificial Sequence
  sgRNA
  mm16023_Slc2a1
tcagcatggagttccgcctg

SEQ ID NO: 2915 - DNA, 20 bp, Artificial Sequence
  sgRNA
  mm16024_Slc2a1
gtgtcacctacagctctacg

SEQ ID NO: 2916 - DNA, 20 bp, Artificial Sequence
  sgRNA
  mm16025_Slc2a1
caaacatggaaccaccgcta

SEQ ID NO: 2917 - DNA, 20 bp, Artificial Sequence
  sgRNA
  mm16030_Slc2a3
ttagaagacctaccaagtga

SEQ ID NO: 2918 - DNA, 20 bp, Artificial Sequence
  sgRNA
  mm16031_Slc2a3
gaccacgcctgctccaatcg

SEQ ID NO: 2919 - DNA, 20 bp, Artificial Sequence
  sgRNA
  mm16032_Slc2a3
ctggaatgatggttaagcca

SEQ ID NO: 2920 - DNA, 20 bp, Artificial Sequence
  sgRNA
  mm16033_Slc2a3
tgtgcctatgtacattggag

SEQ ID NO: 2921 - DNA, 20 bp, Artificial Sequence
  sgRNA
  mm16034_Slc2a4
gcagcctctgatcatcgcag

SEQ ID NO: 2922 - DNA, 20 bp, Artificial Sequence
  sgRNA
  mm16035_Slc2a4
aacagagctacaatgcaacg

SEQ ID NO: 2923 - DNA, 20 bp, Artificial Sequence
  sgRNA
  mm16036_Slc2a4
aaccagaatgccaatgacga

SEQ ID NO: 2924 - DNA, 20 bp, Artificial Sequence
  sgRNA
  mm16037_Slc2a4
ccaggtctaaagcgcctgac

SEQ ID NO: 2925 - DNA, 20 bp, Artificial Sequence
  sgRNA
  mm16046_Slc34a2
tcatagaggagcatcccgag

SEQ ID NO: 2926 - DNA, 20 bp, Artificial Sequence
  sgRNA
  mm16047_Slc34a2
ctccatcaccaacacgatcg

SEQ ID NO: 2927 - DNA, 20 bp, Artificial Sequence
  sgRNA
  mm16048_Slc34a2
agaggtgcagttatcagtcg

SEQ ID NO: 2928 - DNA, 20 bp, Artificial Sequence
  sgRNA
  mm16049_Slc34a2
ctcaccgatgagtggagtca

SEQ ID NO: 2929 - DNA, 20 bp, Artificial Sequence
  sgRNA
  mm16054_Slc4a1
ctccatggcgcataaccgag

SEQ ID NO: 2930 - DNA, 20 bp, Artificial Sequence
  sgRNA
  mm16055_Slc4a1
aataacctggagtatatcgt

SEQ ID NO: 2931 - DNA, 20 bp, Artificial Sequence
  sgRNA
  mm16056_Slc4a1
tctacaacagacttgaacgg

SEQ ID NO: 2932 - DNA, 20 bp, Artificial Sequence
  sgRNA
  mm16057_Slc4a1
cttacccactagcaccagtg

SEQ ID NO: 2933 - DNA, 20 bp, Artificial Sequence
  sgRNA
  mm16062_Slc4a2
ggaagtcacttaggtagtgg

SEQ ID NO: 2934 - DNA, 20 bp, Artificial Sequence
  sgRNA
  mm16063_Slc4a2
gggtacggcgacacttggtg

SEQ ID NO: 2935 - DNA, 20 bp, Artificial Sequence
  sgRNA
  mm16064_Slc4a2
tagcggatgatggatatggt

SEQ ID NO: 2936 - DNA, 20 bp, Artificial Sequence
  sgRNA
  mm16065_Slc4a2
gagcccgctgagatgtttcg

SEQ ID NO: 2937 - DNA, 20 bp, Artificial Sequence
  sgRNA
  mm16074_Slc6a2
cttcaccactagtagatcgg

SEQ ID NO: 2938 - DNA, 20 bp, Artificial Sequence
  sgRNA
  mm16075_Slc6a2
agcagtgggatccatgacat

SEQ ID NO: 2939 - DNA, 20 bp, Artificial Sequence
  sgRNA
  mm16076_Slc6a2
agccgacatagagggcaatg

SEQ ID NO: 2940 - DNA, 20 bp, Artificial Sequence
  sgRNA
  mm16077_Slc6a2
ataagggaaccgccacacgt

SEQ ID NO: 2941 - DNA, 20 bp, Artificial Sequence
  sgRNA
  mm16086_Slc8a1
ctgattatgaattcacggaa

SEQ ID NO: 2942 - DNA, 20 bp, Artificial Sequence
  sgRNA
  mm16087_Slc8a1
aatcgcactctgtgtttacg

SEQ ID NO: 2943 - DNA, 20 bp, Artificial Sequence
  sgRNA
  mm16088_Slc8a1
actcacgtgagcgagagcat

SEQ ID NO: 2944 - DNA, 20 bp, Artificial Sequence
  sgRNA
  mm16089_Slc8a1
ctgcaataatagaaactcca

SEQ ID NO: 2945 - DNA, 20 bp, Artificial Sequence
  sgRNA
  mm16090_Slc9a1
acggccaacaggtcgaccag

SEQ ID NO: 2946 - DNA, 20 bp, Artificial Sequence
  sgRNA
  mm16091_Slc9a1
ggggcgcatcactactcctg

SEQ ID NO: 2947 - DNA, 20 bp, Artificial Sequence
  sgRNA
  mm16092_Slc9a1
cgcccacaaacaccccaccg

SEQ ID NO: 2948 - DNA, 20 bp, Artificial Sequence
  sgRNA
  mm16093_Slc9a1
gaaggtccagttccactggt

SEQ ID NO: 2949 - DNA, 20 bp, Artificial Sequence
  sgRNA
  mm16110_Slit1
caaccccatcgagacaactg

SEQ ID NO: 2950 - DNA, 20 bp, Artificial Sequence
  sgRNA
  mm16111_Slit1
gtcggcccttcaaagccgga

SEQ ID NO: 2951 - DNA, 20 bp, Artificial Sequence
  sgRNA
  mm16112_Slit1
tgataccgttcaactccagg

SEQ ID NO: 2952 - DNA, 20 bp, Artificial Sequence
  sgRNA
  mm16113_Slit1
tccgcaagccatctagaccc

SEQ ID NO: 2953 - DNA, 20 bp, Artificial Sequence
  sgRNA
  mm16114_Slit2
tacatcgataaaaatcaacg

SEQ ID NO: 2954 - DNA, 20 bp, Artificial Sequence
  sgRNA
  mm16115_Slit2
gtgagaaattacctgaacaa

SEQ ID NO: 2955 - DNA, 20 bp, Artificial Sequence
  sgRNA
  mm16116_Slit2
taagatcacggatatcgagg

SEQ ID NO: 2956 - DNA, 20 bp, Artificial Sequence
  sgRNA
  mm16117_Slit2
ggatgggaaccagtttacgc

SEQ ID NO: 2957 - DNA, 20 bp, Artificial Sequence
  sgRNA
  mm16118_Slit3
caaccctattgagacaagcg

SEQ ID NO: 2958 - DNA, 20 bp, Artificial Sequence
  sgRNA
  mm16119_Slit3
ggagattcccatccaagacg

SEQ ID NO: 2959 - DNA, 20 bp, Artificial Sequence
  sgRNA
  mm16120_Slit3
acagcgtcttgaggctactg

SEQ ID NO: 2960 - DNA, 20 bp, Artificial Sequence
  sgRNA
  mm16121_Slit3
cagattggctgcgacaacgg

SEQ ID NO: 2961 - DNA, 20 bp, Artificial Sequence
  sgRNA
  mm16218_Siglec1
actgagtgtaacatgacgtg

SEQ ID NO: 2962 - DNA, 20 bp, Artificial Sequence
  sgRNA
  mm16219_Siglec1
gcgctccagtccattgagtg

SEQ ID NO: 2963 - DNA, 20 bp, Artificial Sequence
  sgRNA
  mm16220_Siglec1
tgctatcactgatctcaaag

SEQ ID NO: 2964 - DNA, 20 bp, Artificial Sequence
  sgRNA
  mm16221_Siglec1
ctcatactactgtaggacgc

SEQ ID NO: 2965 - DNA, 20 bp, Artificial Sequence
  sgRNA
  mm16322_Sorl1
tcacgtcctctgacacaagg

SEQ ID NO: 2966 - DNA, 20 bp, Artificial Sequence
  sgRNA
  mm16323_Sorl1
actgctagagatgtacacat

SEQ ID NO: 2967 - DNA, 20 bp, Artificial Sequence
  sgRNA
  mm16324_Sorl1
cttctccatcccattccggg

SEQ ID NO: 2968 - DNA, 20 bp, Artificial Sequence
  sgRNA
  mm16325_Sorl1
gcacccgggaggactacgaa

SEQ ID NO: 2969 - DNA, 20 bp, Artificial Sequence
  sgRNA
  mm16326_Sort1
ttgttatatagaccccacgg

SEQ ID NO: 2970 - DNA, 20 bp, Artificial Sequence
  sgRNA
  mm16327_Sort1
gctgaccaacaatacgcacc

SEQ ID NO: 2971 - DNA, 20 bp, Artificial Sequence
  sgRNA
  mm16328_Sort1
taccgcaaagaacaagaacg

SEQ ID NO: 2972 - DNA, 20 bp, Artificial Sequence
  sgRNA
  mm16329_Sort1
tgggcaggtgatactaacag

SEQ ID NO: 2973 - DNA, 20 bp, Artificial Sequence
  sgRNA
  mm16414_Spa17
acccactaccgaattccaca

SEQ ID NO: 2974 - DNA, 20 bp, Artificial Sequence
  sgRNA
  mm16415_Spa17
aagactataccttgaatgcg

SEQ ID NO: 2975 - DNA, 20 bp, Artificial Sequence
  sgRNA
  mm16416_Spa17
aaggttctcaaaatacgctg

SEQ ID NO: 2976 - DNA, 20 bp, Artificial Sequence
  sgRNA
  mm16417_Spa17
ctttgatccagcagaatggg

SEQ ID NO: 2977 - DNA, 20 bp, Artificial Sequence
  sgRNA
  mm16430_Spam1
gtcccaactgaacgttgtgt

SEQ ID NO: 2978 - DNA, 20 bp, Artificial Sequence
  sgRNA
  mm16431_Spam1
aactcggtagcggacataga

SEQ ID NO: 2979 - DNA, 20 bp, Artificial Sequence
  sgRNA
  mm16432_Spam1
gcttgataatcgcccctctg

SEQ ID NO: 2980 - DNA, 20 bp, Artificial Sequence
  sgRNA
  mm16433_Spam1
tacctctgaataccttctag

SEQ ID NO: 2981 - DNA, 20 bp, Artificial Sequence
  sgRNA
  mm16434_Sparc
agaatttgaggacggtgcag

SEQ ID NO: 2982 - DNA, 20 bp, Artificial Sequence
  sgRNA
  mm16435_Sparc
agccagtcacgcatgcgcag

SEQ ID NO: 2983 - DNA, 20 bp, Artificial Sequence
  sgRNA
  mm16436_Sparc
atggtccgatgtagtccagg

SEQ ID NO: 2984 - DNA, 20 bp, Artificial Sequence
  sgRNA
  mm16437_Sparc
accttgtacgagagagatga

SEQ ID NO: 2985 - DNA, 20 bp, Artificial Sequence
  sgRNA
  mm16502_Serpine2
gttgtaccataagccattcg

SEQ ID NO: 2986 - DNA, 20 bp, Artificial Sequence
  sgRNA
  mm16503_Serpine2
tgaaatacactgcattaacg

SEQ ID NO: 2987 - DNA, 20 bp, Artificial Sequence
  sgRNA
  mm16504_Serpine2
tacattatatcgcatcaccg

SEQ ID NO: 2988 - DNA, 20 bp, Artificial Sequence
  sgRNA
  mm16505_Serpine2
gagacaacaacgttctcatg

SEQ ID NO: 2989 - DNA, 20 bp, Artificial Sequence
  sgRNA
  mm16546_Spn
acaagctctaacgagaccag

SEQ ID NO: 2990 - DNA, 20 bp, Artificial Sequence
  sgRNA
  mm16547_Spn
gcagccaatcctgtgacaga

SEQ ID NO: 2991 - DNA, 20 bp, Artificial Sequence
  sgRNA
  mm16548_Spn
gggatcttgggtagacgtcg

SEQ ID NO: 2992 - DNA, 20 bp, Artificial Sequence
  sgRNA
  mm16549_Spn
cgagcccagacagtctgcag

SEQ ID NO: 2993 - DNA, 20 bp, Artificial Sequence
  sgRNA
  mm16558_Sptb
agagggcctagatactgact

SEQ ID NO: 2994 - DNA, 20 bp, Artificial Sequence
  sgRNA
  mm16559_Sptb
cagaacaactctcagccgcg

SEQ ID NO: 2995 - DNA, 20 bp, Artificial Sequence
  sgRNA
  mm16560_Sptb
gaaggttgtggagtcaacca

SEQ ID NO: 2996 - DNA, 20 bp, Artificial Sequence
  sgRNA
  mm16561_Sptb
tcaacgagttggcaaacttg

SEQ ID NO: 2997 - DNA, 20 bp, Artificial Sequence
  sgRNA
  mm16654_Scarb1
ggggccgtgaagcgatacgt

SEQ ID NO: 2998 - DNA, 20 bp, Artificial Sequence
  sgRNA
  mm16655_Scarb1
tgcggttcataaaagcacgc

SEQ ID NO: 2999 - DNA, 20 bp, Artificial Sequence
  sgRNA
  mm16656_Scarb1
gatgaacaactcgaattctg

SEQ ID NO: 3000 - DNA, 20 bp, Artificial Sequence
  sgRNA
  mm16657_Scarb1
gaggattcgggtgtcatgaa

SEQ ID NO: 3001 - DNA, 20 bp, Artificial Sequence
  sgRNA
  mm16754_Stat4
aatgtctaaactccactgag

SEQ ID NO: 3002 - DNA, 20 bp, Artificial Sequence
  sgRNA
  mm16755_Stat4
gcatgccaacgcaccctcag

SEQ ID NO: 3003 - DNA, 20 bp, Artificial Sequence
  sgRNA
  mm16756_Stat4
aaatccaatgcatgtagctg

SEQ ID NO: 3004 - DNA, 20 bp, Artificial Sequence
  sgRNA
  mm16757_Stat4
tggcctcaccattaacctag

SEQ ID NO: 3005 - DNA, 20 bp, Artificial Sequence
  sgRNA
  mm16802_Stim1
tgaggataagcttatcagcg

SEQ ID NO: 3006 - DNA, 20 bp, Artificial Sequence
  sgRNA
  mm16803_Stim1
gaatacaggagctagctccg

SEQ ID NO: 3007 - DNA, 20 bp, Artificial Sequence
  sgRNA
  mm16804_Stim1
gagccgtcaaaaatatgctg

SEQ ID NO: 3008 - DNA, 20 bp, Artificial Sequence
  sgRNA
  mm16805_Stim1
cagcagatcgagatcctctg

SEQ ID NO: 3009 - DNA, 20 bp, Artificial Sequence
  sgRNA
  mm16842_Wnt8a
gggaggctgcagcgacaacg

SEQ ID NO: 3010 - DNA, 20 bp, Artificial Sequence
  sgRNA
  mm16843_Wnt8a
ccgcgcgctgaaaattgaga

SEQ ID NO: 3011 - DNA, 20 bp, Artificial Sequence
  sgRNA
  mm16844_Wnt8a
tctgacctacaccgccagtg

SEQ ID NO: 3012 - DNA, 20 bp, Artificial Sequence
  sgRNA
  mm16845_Wnt8a
aaaaggacctgcaagtgtca

SEQ ID NO: 3013 - DNA, 20 bp, Artificial Sequence
  sgRNA
  mm16874_Stx4a
tgctggaatggtgtctgacg

SEQ ID NO: 3014 - DNA, 20 bp, Artificial Sequence
  sgRNA
  mm16875_Stx4a
tctcgtttaggcatgaagca

SEQ ID NO: 3015 - DNA, 20 bp, Artificial Sequence
  sgRNA
  mm16876_Stx4a
attacaactcagtcaacaca

SEQ ID NO: 3016 - DNA, 20 bp, Artificial Sequence
  sgRNA
  mm16877_Stx4a
cgaataccgagagaagaatg

SEQ ID NO: 3017 - DNA, 20 bp, Artificial Sequence
  sgRNA
  mm16982_Sdc1
gtcacatctcatccgcacgg

SEQ ID NO: 3018 - DNA, 20 bp, Artificial Sequence
  sgRNA
  mm16983_Sdc1
aggaaaaggaggtcaccacc

SEQ ID NO: 3019 - DNA, 20 bp, Artificial Sequence
  sgRNA
  mm16984_Sdc1
cacacgtccttccaagtgga

SEQ ID NO: 3020 - DNA, 20 bp, Artificial Sequence
  sgRNA
  mm16985_Sdc1
tgtcatcaaagaggttgtcg

SEQ ID NO: 3021 - DNA, 20 bp, Artificial Sequence
  sgRNA
  mm16986_Sdc3
cacaaccgttatccagcccg

SEQ ID NO: 3022 - DNA, 20 bp, Artificial Sequence
  sgRNA
  mm16987_Sdc3
aggaagggctcgtggcctcg

SEQ ID NO: 3023 - DNA, 20 bp, Artificial Sequence
  sgRNA
  mm16988_Sdc3
aactagacgacctctactcg

SEQ ID NO: 3024 - DNA, 20 bp, Artificial Sequence
  sgRNA
  mm16989_Sdc3
ggcgcaatgagaacttcgag

SEQ ID NO: 3025 - DNA, 20 bp, Artificial Sequence
  sgRNA
  mm16990_Sdc4
ggacatgtcatcccccacgt

SEQ ID NO: 3026 - DNA, 20 bp, Artificial Sequence
  sgRNA
  mm16991_Sdc4
ttcttagattcgagagacag

SEQ ID NO: 3027 - DNA, 20 bp, Artificial Sequence
  sgRNA
  mm16992_Sdc4
tcagggatgtggttatccag

SEQ ID NO: 3028 - DNA, 20 bp, Artificial Sequence
  sgRNA
  mm16993_Sdc4
cagcatcttcgtcgtcgggg

SEQ ID NO: 3029 - DNA, 20 bp, Artificial Sequence
  sgRNA
  mm17010_Syp
gcaccctcctgcgttaaagg

SEQ ID NO: 3030 - DNA, 20 bp, Artificial Sequence
  sgRNA
  mm17011_Syp
gtagctgccgcacgtagcaa

SEQ ID NO: 3031 - DNA, 20 bp, Artificial Sequence
  sgRNA
  mm17012_Syp
caaattcgacttcgatgttg

SEQ ID NO: 3032 - DNA, 20 bp, Artificial Sequence
  sgRNA
  mm17013_Syp
aagtaccgagagaacaacaa

SEQ ID NO: 3033 - DNA, 20 bp, Artificial Sequence
  sgRNA
  mm17046_Tacr1
catggctgcattcaatacag

SEQ ID NO: 3034 - DNA, 20 bp, Artificial Sequence
  sgRNA
  mm17047_Tacr1
ggtggtcaaaatgatgatcg

SEQ ID NO: 3035 - DNA, 20 bp, Artificial Sequence
  sgRNA
  mm17048_Tacr1
gattggctatgcatacactg

SEQ ID NO: 3036 - DNA, 20 bp, Artificial Sequence
  sgRNA
  mm17049_Tacr1
caccacgatgaccgtatagg

SEQ ID NO: 3037 - DNA, 20 bp, Artificial Sequence
  sgRNA
  mm17110_Slc6a6
ggcccccaggcagattgcgt

SEQ ID NO: 3038 - DNA, 20 bp, Artificial Sequence
  sgRNA
  mm17111_Slc6a6
ggccagtacacatcagaagg

SEQ ID NO: 3039 - DNA, 20 bp, Artificial Sequence
  sgRNA
  mm17112_Slc6a6
aaacagaatagaccaaaagg

SEQ ID NO: 3040 - DNA, 20 bp, Artificial Sequence
  sgRNA
  mm17113_Slc6a6
catggcaaacgggaaagtag

SEQ ID NO: 3041 - DNA, 20 bp, Artificial Sequence
  sgRNA
  mm17114_Cntn2
gaccccgtgaaaacccacga

SEQ ID NO: 3042 - DNA, 20 bp, Artificial Sequence
  sgRNA
  mm17115_Cntn2
ctcaccaccacacccccagg

SEQ ID NO: 3043 - DNA, 20 bp, Artificial Sequence
  sgRNA
  mm17116_Cntn2
tgtgaatatcgagggcaacg

SEQ ID NO: 3044 - DNA, 20 bp, Artificial Sequence
  sgRNA
  mm17117_Cntn2
aagggccgtgacaccgtcca

SEQ ID NO: 3045 - DNA, 20 bp, Artificial Sequence
  sgRNA
  mm17170_Tbxa2r
gacgtgccatcgcgtcgcca

SEQ ID NO: 3046 - DNA, 20 bp, Artificial Sequence
  sgRNA
  mm17171_Tbxa2r
ctgacactcgggacacagcg

SEQ ID NO: 3047 - DNA, 20 bp, Artificial Sequence
  sgRNA
  mm17172_Tbxa2r
agtggctcgccagtccaaca

SEQ ID NO: 3048 - DNA, 20 bp, Artificial Sequence
  sgRNA
  mm17173_Tbxa2r
agcgcttcgtgggcatcaca

SEQ ID NO: 3049 - DNA, 20 bp, Artificial Sequence
  sgRNA
  mm17342_Tdgf1
gggtccaaattcaaacgcac

SEQ ID NO: 3050 - DNA, 20 bp, Artificial Sequence
  sgRNA
  mm17343_Tdgf1
cagttgcgtccatagaagga

SEQ ID NO: 3051 - DNA, 20 bp, Artificial Sequence
  sgRNA
  mm17344_Tdgf1
ctgttctgtatccccacgga

SEQ ID NO: 3052 - DNA, 20 bp, Artificial Sequence
  sgRNA
  mm17345_Tdgf1
aagaacctgccgtacgcgat

SEQ ID NO: 3053 - DNA, 20 bp, Artificial Sequence
  sgRNA
  mm17394_Tek
ttaactatgaccgtggacag

SEQ ID NO: 3054 - DNA, 20 bp, Artificial Sequence
  sgRNA
  mm17395_Tek
agtacaaggacggctacagt

SEQ ID NO: 3055 - DNA, 20 bp, Artificial Sequence
  sgRNA
  mm17396_Tek
ctatacagatcgtttctcag

SEQ ID NO: 3056 - DNA, 20 bp, Artificial Sequence
  sgRNA
  mm17397_Tek
ctggtccgtagtaaccagat

SEQ ID NO: 3057 - DNA, 20 bp, Artificial Sequence
  sgRNA
  mm17502_Tfpi
tgtgaacgattcgtgtacgg

SEQ ID NO: 3058 - DNA, 20 bp, Artificial Sequence
  sgRNA
  mm17503_Tfpi
tgtgaagaatttatatacgg

SEQ ID NO: 3059 - DNA, 20 bp, Artificial Sequence
  sgRNA
  mm17504_Tfpi
accttgtagattctgagctg

SEQ ID NO: 3060 - DNA, 20 bp, Artificial Sequence
  sgRNA
  mm17505_Tfpi
gatacctcttcatgtaacct

SEQ ID NO: 3061 - DNA, 20 bp, Artificial Sequence
  sgRNA
  mm17510_Tgfa
aacagcacatcccccctgag

SEQ ID NO: 3062 - DNA, 20 bp, Artificial Sequence
  sgRNA
  mm17511_Tgfa
gggaatacttacacacatgc

SEQ ID NO: 3063 - DNA, 20 bp, Artificial Sequence
  sgRNA
  mm17512_Tgfa
atggaagcagtactgagtgt

SEQ ID NO: 3064 - DNA, 20 bp, Artificial Sequence
  sgRNA
  mm17513_Tgfa
ttcctgcaccaaaaaccggc

SEQ ID NO: 3065 - DNA, 20 bp, Artificial Sequence
  sgRNA
  mm17514_Tgfb1
ccactcaggcgtatcagtgg

SEQ ID NO: 3066 - DNA, 20 bp, Artificial Sequence
  sgRNA
  mm17515_Tgfb1
gggatcagccccaaacgtcg

SEQ ID NO: 3067 - DNA, 20 bp, Artificial Sequence
  sgRNA
  mm17516_Tgfb1
gcggtccaccattagcacgc

SEQ ID NO: 3068 - DNA, 20 bp, Artificial Sequence
  sgRNA
  mm17517_Tgfb1
tctgcacgggacagcaatgg

SEQ ID NO: 3069 - DNA, 20 bp, Artificial Sequence
  sgRNA
  mm17526_Tgfb2
gtaattattagacggcacga

SEQ ID NO: 3070 - DNA, 20 bp, Artificial Sequence
  sgRNA
  mm17527_Tgfb2
gctccggatagtcttccggg

SEQ ID NO: 3071 - DNA, 20 bp, Artificial Sequence
  sgRNA
  mm17528_Tgfb2
ccagcgctacatcgatagca

SEQ ID NO: 3072 - DNA, 20 bp, Artificial Sequence
  sgRNA
  mm17529_Tgfb2
gcataaactgatccatgtcg

SEQ ID NO: 3073 - DNA, 20 bp, Artificial Sequence
  sgRNA
  mm17530_Tgfb3
aaagtgccaggacctgatag

SEQ ID NO: 3074 - DNA, 20 bp, Artificial Sequence
  sgRNA
  mm17531_Tgfb3
ggcatagtactcagactccg

SEQ ID NO: 3075 - DNA, 20 bp, Artificial Sequence
  sgRNA
  mm17532_Tgfb3
gccaagcagcgctacatagg

SEQ ID NO: 3076 - DNA, 20 bp, Artificial Sequence
  sgRNA
  mm17533_Tgfb3
aagagggtggaagccattag

SEQ ID NO: 3077 - DNA, 20 bp, Artificial Sequence
  sgRNA
  mm17538_Tgfbr1
agagcgttcatggttccgag

SEQ ID NO: 3078 - DNA, 20 bp, Artificial Sequence
  sgRNA
  mm17539_Tgfbr1
atgaaagggcgatctagtga

SEQ ID NO: 3079 - DNA, 20 bp, Artificial Sequence
  sgRNA
  mm17540_Tgfbr1
attgtgttacaagaaagcat

SEQ ID NO: 3080 - DNA, 20 bp, Artificial Sequence
  sgRNA
  mm17541_Tgfbr1
gtgtcagattatcatgagca

SEQ ID NO: 3081 - DNA, 20 bp, Artificial Sequence
  sgRNA
  mm17542_Tgfbr2
cctacgaggagtactcctcg

SEQ ID NO: 3082 - DNA, 20 bp, Artificial Sequence
  sgRNA
  mm17543_Tgfbr2
acctgcaggagtacctcacg

SEQ ID NO: 3083 - DNA, 20 bp, Artificial Sequence
  sgRNA
  mm17544_Tgfbr2
gaagccgcatgaagtctgcg

SEQ ID NO: 3084 - DNA, 20 bp, Artificial Sequence
  sgRNA
  mm17545_Tgfbr2
ccttgtagacctcggcgaag

SEQ ID NO: 3085 - DNA, 20 bp, Artificial Sequence
  sgRNA
  mm17546_Tgfbr3
gctgtggtactagacatagg

SEQ ID NO: 3086 - DNA, 20 bp, Artificial Sequence
  sgRNA
  mm17547_Tgfbr3
catcttcggcttgagaacaa

SEQ ID NO: 3087 - DNA, 20 bp, Artificial Sequence
  sgRNA
  mm17548_Tgfbr3
attgtcacatttgactgaca

SEQ ID NO: 3088 - DNA, 20 bp, Artificial Sequence
  sgRNA
  mm17549_Tgfbr3
aacctccgcagtacagacca

SEQ ID NO: 3089 - DNA, 20 bp, Artificial Sequence
  sgRNA
  mm17582_Thbd
tacctacaacaccccgttcg

SEQ ID NO: 3090 - DNA, 20 bp, Artificial Sequence
  sgRNA
  mm17583_Thbd
gtgtgagacaggctaccagt

SEQ ID NO: 3091 - DNA, 20 bp, Artificial Sequence
  sgRNA
  mm17584_Thbd
ctgtgaagtaaaactcacag

SEQ ID NO: 3092 - DNA, 20 bp, Artificial Sequence
  sgRNA
  mm17585_Thbd
tcgcagttagatccgaaaca

SEQ ID NO: 3093 - DNA, 20 bp, Artificial Sequence
  sgRNA
  mm17586_Thbs1
ccagtgcaaagacgtcgatg

SEQ ID NO: 3094 - DNA, 20 bp, Artificial Sequence
  sgRNA
  mm17587_Thbs1
gtcacagaacaggacgacca

SEQ ID NO: 3095 - DNA, 20 bp, Artificial Sequence
  sgRNA
  mm17588_Thbs1
gaacttgtcatccggcacag

SEQ ID NO: 3096 - DNA, 20 bp, Artificial Sequence
  sgRNA
  mm17589_Thbs1
ctgtgataagatggagagcg

SEQ ID NO: 3097 - DNA, 20 bp, Artificial Sequence
  sgRNA
  mm17622_Thy1
ccttggtgttattctcatgg

SEQ ID NO: 3098 - DNA, 20 bp, Artificial Sequence
  sgRNA
  mm17623_Thy1
taaggaccttgatatagggc

SEQ ID NO: 3099 - DNA, 20 bp, Artificial Sequence
  sgRNA
  mm17624_Thy1
cagtcttgcaggtgtcccga

SEQ ID NO: 3100 - DNA, 20 bp, Artificial Sequence
  sgRNA
  mm17625_Thy1
cgtgtgctcgggtatcccaa

SEQ ID NO: 3101 - DNA, 20 bp, Artificial Sequence
  sgRNA
  mm17650_Trim28
atgaaggagctgaataagcg

SEQ ID NO: 3102 - DNA, 20 bp, Artificial Sequence
  sgRNA
  mm17651_Trim28
cgccgcagcgaataattcgg

SEQ ID NO: 3103 - DNA, 20 bp, Artificial Sequence
  sgRNA
  mm17652_Trim28
gcactccacacaatagctag

SEQ ID NO: 3104 - DNA, 20 bp, Artificial Sequence
  sgRNA
  mm17653_Trim28
aggcgttcaaggctcacacg

SEQ ID NO: 3105 - DNA, 20 bp, Artificial Sequence
  sgRNA
  mm17670_Timp1
gtaggcgtaccggatatctg

SEQ ID NO: 3106 - DNA, 20 bp, Artificial Sequence
  sgRNA
  mm17671_Timp1
gcagggctcagagtacgcca

SEQ ID NO: 3107 - DNA, 20 bp, Artificial Sequence
  sgRNA
  mm17672_Timp1
cttataacgctggtataagg

SEQ ID NO: 3108 - DNA, 20 bp, Artificial Sequence
  sgRNA
  mm17673_Timp1
tgatgagaaactcttcactg

SEQ ID NO: 3109 - DNA, 20 bp, Artificial Sequence
  sgRNA
  mm17674_Timp2
agacatcgagtttatctaca

SEQ ID NO: 3110 - DNA, 20 bp, Artificial Sequence
  sgRNA
  mm17675_Timp2
catactgaatcctcttgatg

SEQ ID NO: 3111 - DNA, 20 bp, Artificial Sequence
  sgRNA
  mm17676_Timp2
gtgatgctaagcgtgtccca

SEQ ID NO: 3112 - DNA, 20 bp, Artificial Sequence
  sgRNA
  mm17677_Timp2
gcattgcaaaacgcctgttg

SEQ ID NO: 3113 - DNA, 20 bp, Artificial Sequence
  sgRNA
  mm17686_Tjp1
ttctgttcgctaaagcaccg

SEQ ID NO: 3114 - DNA, 20 bp, Artificial Sequence
  sgRNA
  mm17687_Tjp1
agagcgaatgtctaaacctg

SEQ ID NO: 3115 - DNA, 20 bp, Artificial Sequence
  sgRNA
  mm17688_Tjp1
gttctactgtcgtacgacag

SEQ ID NO: 3116 - DNA, 20 bp, Artificial Sequence
  sgRNA
  mm17689_Tjp1
attagatgtaacgccaaatg

SEQ ID NO: 3117 - DNA, 20 bp, Artificial Sequence
  sgRNA
  mm17690_Tjp2
gcttatgaacccgactacgg

SEQ ID NO: 3118 - DNA, 20 bp, Artificial Sequence
  sgRNA
  mm17691_Tjp2
tatggggccaaacagaacca

SEQ ID NO: 3119 - DNA, 20 bp, Artificial Sequence
  sgRNA
  mm17692_Tjp2
cctcggtcgtcatgactgag

SEQ ID NO: 3120 - DNA, 20 bp, Artificial Sequence
  sgRNA
  mm17693_Tjp2
ccacgccgttcaagtccacg

SEQ ID NO: 3121 - DNA, 20 bp, Artificial Sequence
  sgRNA
  mm17730_Tlr1
taacgtgccgaagagattcg

SEQ ID NO: 3122 - DNA, 20 bp, Artificial Sequence
  sgRNA
  mm17731_Tlr1
tactgtatatgtaactttgg

SEQ ID NO: 3123 - DNA, 20 bp, Artificial Sequence
  sgRNA
  mm17732_Tlr1
tgaacaatgtggaaacaacg

SEQ ID NO: 3124 - DNA, 20 bp, Artificial Sequence
  sgRNA
  mm17733_Tlr1
gcttgaggctgactgttggg

SEQ ID NO: 3125 - DNA, 20 bp, Artificial Sequence
  sgRNA
  mm17734_Tlr4
attctcccaagatcaaccga

SEQ ID NO: 3126 - DNA, 20 bp, Artificial Sequence
  sgRNA
  mm17735_Tlr4
tctgacgaacctagtacatg

SEQ ID NO: 3127 - DNA, 20 bp, Artificial Sequence
  sgRNA
  mm17736_Tlr4
cagaaacattcgccaagcaa

SEQ ID NO: 3128 - DNA, 20 bp, Artificial Sequence
  sgRNA
  mm17737_Tlr4
tcagtatcaagtttgagagg

SEQ ID NO: 3129 - DNA, 20 bp, Artificial Sequence
  sgRNA
  mm17738_Tlr6
gagttatcatataaaaggcg

SEQ ID NO: 3130 - DNA, 20 bp, Artificial Sequence
  sgRNA
  mm17739_Tlr6
gataactgagagaatcgaca

SEQ ID NO: 3131 - DNA, 20 bp, Artificial Sequence
  sgRNA
  mm17740_Tlr6
ttgccaaattccttacacac

SEQ ID NO: 3132 - DNA, 20 bp, Artificial Sequence
  sgRNA
  mm17741_Tlr6
aacatccaaagtttccagag

SEQ ID NO: 3133 - DNA, 20 bp, Artificial Sequence
  sgRNA
  mm17758_Tspan7
tcagcatccatggactacca

SEQ ID NO: 3134 - DNA, 20 bp, Artificial Sequence
  sgRNA
  mm17759_Tspan7
tggaaccggcaccaccatcg

SEQ ID NO: 3135 - DNA, 20 bp, Artificial Sequence
  sgRNA
  mm17760_Tspan7
atccgtgtaagtcctcagga

SEQ ID NO: 3136 - DNA, 20 bp, Artificial Sequence
  sgRNA
  mm17761_Tspan7
tctcctttcgcagatcactg

SEQ ID NO: 3137 - DNA, 20 bp, Artificial Sequence
  sgRNA
  mm17770_Tmpo
gcccgacttctcgagcgacg

SEQ ID NO: 3138 - DNA, 20 bp, Artificial Sequence
  sgRNA
  mm17771_Tmpo
atagtggaaaatatttgccg

SEQ ID NO: 3139 - DNA, 20 bp, Artificial Sequence
  sgRNA
  mm17772_Tmpo
aataaataaactccgtccag

SEQ ID NO: 3140 - DNA, 20 bp, Artificial Sequence
  sgRNA
  mm17773_Tmpo
caagaaagtgaagtccgcta

SEQ ID NO: 3141 - DNA, 20 bp, Artificial Sequence
  sgRNA
  mm17786_Tnf
aagaaatcttacctacgacg

SEQ ID NO: 3142 - DNA, 20 bp, Artificial Sequence
  sgRNA
  mm17787_Tnf
gtagacaaggtacaacccat

SEQ ID NO: 3143 - DNA, 20 bp, Artificial Sequence
  sgRNA
  mm17788_Tnf
tgggccatagaactgatgag

SEQ ID NO: 3144 - DNA, 20 bp, Artificial Sequence
  sgRNA
  mm17789_Tnf
cagtagacagaagagcgtgg

SEQ ID NO: 3145 - DNA, 20 bp, Artificial Sequence
  sgRNA
  mm17806_Tnfrsf10b
tagaatgtacctgctagaca

SEQ ID NO: 3146 - DNA, 20 bp, Artificial Sequence
  sgRNA
  mm17807_Tnfrsf10b
aaatgactctaaccacaaca

SEQ ID NO: 3147 - DNA, 20 bp, Artificial Sequence
  sgRNA
  mm17808_Tnfrsf10b
acggtgtgtcgatgcaaacc

SEQ ID NO: 3148 - DNA, 20 bp, Artificial Sequence
  sgRNA
  mm17809_Tnfrsf10b
tggttgctctgtataaaaag

SEQ ID NO: 3149 - DNA, 20 bp, Artificial Sequence
  sgRNA
  mm17810_Tnfrsf11a
accagcacaacggtcccctg

SEQ ID NO: 3150 - DNA, 20 bp, Artificial Sequence
  sgRNA
  mm17811_Tnfrsf11a
acactgaggagaccacccaa

SEQ ID NO: 3151 - DNA, 20 bp, Artificial Sequence
  sgRNA
  mm17812_Tnfrsf11a
gtttaagccagtgtttcacc

SEQ ID NO: 3152 - DNA, 20 bp, Artificial Sequence
  sgRNA
  mm17813_Tnfrsf11a
agacgcaaggagacctctcg

SEQ ID NO: 3153 - DNA, 20 bp, Artificial Sequence
  sgRNA
  mm17818_Tnfrsf18
gccaaacacaatatcccctg

SEQ ID NO: 3154 - DNA, 20 bp, Artificial Sequence
  sgRNA
  mm17819_Tnfrsf18
gtcacacctgagtaccactg

SEQ ID NO: 3155 - DNA, 20 bp, Artificial Sequence
  sgRNA
  mm17820_Tnfrsf18
gcagtgaccgtcacgacctg

SEQ ID NO: 3156 - DNA, 20 bp, Artificial Sequence
  sgRNA
  mm17821_Tnfrsf18
ttattcttgtccaggcaagg

SEQ ID NO: 3157 - DNA, 20 bp, Artificial Sequence
  sgRNA
  mm17822_Tnfrsf1a
agttgcaagacatgtcggaa

SEQ ID NO: 3158 - DNA, 20 bp, Artificial Sequence
  sgRNA
  mm17823_Tnfrsf1a
agacctagcaagataaccag

SEQ ID NO: 3159 - DNA, 20 bp, Artificial Sequence
  sgRNA
  mm17824_Tnfrsf1a
gatggggatacatccatcag

SEQ ID NO: 3160 - DNA, 20 bp, Artificial Sequence
  sgRNA
  mm17825_Tnfrsf1a
ggatcccgtgcctgtcaaag

SEQ ID NO: 3161 - DNA, 20 bp, Artificial Sequence
  sgRNA
  mm17830_Cd40
attcgcctgagtcacatggg

SEQ ID NO: 3162 - DNA, 20 bp, Artificial Sequence
  sgRNA
  mm17831_Cd40
gggatgacagacggtatcag

SEQ ID NO: 3163 - DNA, 20 bp, Artificial Sequence
  sgRNA
  mm17832_Cd40
agtcagactaatgtcatctg

SEQ ID NO: 3164 - DNA, 20 bp, Artificial Sequence
  sgRNA
  mm17833_Cd40
ctgcaccagcaaggattgcg

SEQ ID NO: 3165 - DNA, 20 bp, Artificial Sequence
  sgRNA
  mm17834_Cd27
tctctccagactaccacacc

SEQ ID NO: 3166 - DNA, 20 bp, Artificial Sequence
  sgRNA
  mm17835_Cd27
tgctgcatacctgtgccatg

SEQ ID NO: 3167 - DNA, 20 bp, Artificial Sequence
  sgRNA
  mm17836_Cd27
agacaaacactactggactg

SEQ ID NO: 3168 - DNA, 20 bp, Artificial Sequence
  sgRNA
  mm17837_Cd27
ctcaggtacattctttgtga

SEQ ID NO: 3169 - DNA, 20 bp, Artificial Sequence
  sgRNA
  mm17838_Tnfrsf8
agacctcagccactacccag

SEQ ID NO: 3170 - DNA, 20 bp, Artificial Sequence
  sgRNA
  mm17839_Tnfrsf8
gcaattgggaccagatcccg

SEQ ID NO: 3171 - DNA, 20 bp, Artificial Sequence
  sgRNA
  mm17840_Tnfrsf8
atctaccacaaggcttaggg

SEQ ID NO: 3172 - DNA, 20 bp, Artificial Sequence
  sgRNA
  mm17841_Tnfrsf8
tacaggccttccagtaacac

SEQ ID NO: 3173 - DNA, 20 bp, Artificial Sequence
  sgRNA
  mm17842_Tnfrsf9
gtgcatacgtacttcgtcca

SEQ ID NO: 3174 - DNA, 20 bp, Artificial Sequence
  sgRNA
  mm17843_Tnfrsf9
tgtgcttaagaccgggacca

SEQ ID NO: 3175 - DNA, 20 bp, Artificial Sequence
  sgRNA
  mm17844_Tnfrsf9
ccaagtaccttctccagcat

SEQ ID NO: 3176 - DNA, 20 bp, Artificial Sequence
  sgRNA
  mm17845_Tnfrsf9
accaggctgacagttatcac

SEQ ID NO: 3177 - DNA, 20 bp, Artificial Sequence
  sgRNA
  mm17846_Tnfsf11
gcctcgatcgtggtaccaag

SEQ ID NO: 3178 - DNA, 20 bp, Artificial Sequence
  sgRNA
  mm17847_Tnfsf11
gaccctcgtgtgggacgccg

SEQ ID NO: 3179 - DNA, 20 bp, Artificial Sequence
  sgRNA
  mm17848_Tnfsf11
gttaagcaacggaaaactaa

SEQ ID NO: 3180 - DNA, 20 bp, Artificial Sequence
  sgRNA
  mm17849_Tnfsf11
agatttgcaggactcgactc

SEQ ID NO: 3181 - DNA, 20 bp, Artificial Sequence
  sgRNA
  mm17862_Cd40lg
tatttcaaaacaggtcgaag

SEQ ID NO: 3182 - DNA, 20 bp, Artificial Sequence
  sgRNA
  mm17863_Cd40lg
aagctaaagagatgcaacaa

SEQ ID NO: 3183 - DNA, 20 bp, Artificial Sequence
  sgRNA
  mm17864_Cd40lg
ttataccatgaaaagcaact

SEQ ID NO: 3184 - DNA, 20 bp, Artificial Sequence
  sgRNA
  mm17865_Cd40lg
tgaactgtgaggagatgaga

SEQ ID NO: 3185 - DNA, 20 bp, Artificial Sequence
  sgRNA
  mm17870_Tnfsf8
cacaacaaggcacaccagtg

SEQ ID NO: 3186 - DNA, 20 bp, Artificial Sequence
  sgRNA
  mm17871_Tnfsf8
ctggtatatgagtccgtgga

SEQ ID NO: 3187 - DNA, 20 bp, Artificial Sequence
  sgRNA
  mm17872_Tnfsf8
aatgatttgagcactgcacg

SEQ ID NO: 3188 - DNA, 20 bp, Artificial Sequence
  sgRNA
  mm17873_Tnfsf8
gctcttacctcctttaaggg

SEQ ID NO: 3189 - DNA, 20 bp, Artificial Sequence
  sgRNA
  mm17874_Tnfsf9
gggagctcatacctatctca

SEQ ID NO: 3190 - DNA, 20 bp, Artificial Sequence
  sgRNA
  mm17875_Tnfsf9
aaaaatacgtagtagagccc

SEQ ID NO: 3191 - DNA, 20 bp, Artificial Sequence
  sgRNA
  mm17876_Tnfsf9
ggttaatgttcgggatcgcg

SEQ ID NO: 3192 - DNA, 20 bp, Artificial Sequence
  sgRNA
  mm17877_Tnfsf9
agtgttggggcagccaatgt

SEQ ID NO: 3193 - DNA, 20 bp, Artificial Sequence
  sgRNA
  mm17914_Tnr
gcacgttgatgttatacaca

SEQ ID NO: 3194 - DNA, 20 bp, Artificial Sequence
  sgRNA
  mm17915_Tnr
acggagtactggcttaaggg

SEQ ID NO: 3195 - DNA, 20 bp, Artificial Sequence
  sgRNA
  mm17916_Tnr
taaaggacgtcacatcgctg

SEQ ID NO: 3196 - DNA, 20 bp, Artificial Sequence
  sgRNA
  mm17917_Tnr
ctgaggaggctgttaccatg

SEQ ID NO: 3197 - DNA, 20 bp, Artificial Sequence
  sgRNA
  mm17954_Tpbg
gccagccgagagatgccccg

SEQ ID NO: 3198 - DNA, 20 bp, Artificial Sequence
  sgRNA
  mm17955_Tpbg
gaatcacatcgtgccccctg

SEQ ID NO: 3199 - DNA, 20 bp, Artificial Sequence
  sgRNA
  mm17956_Tpbg
aaaaggttgcgcacgtaagg

SEQ ID NO: 3200 - DNA, 20 bp, Artificial Sequence
  sgRNA
  mm17957_Tpbg
gctgggttgggtctccgcgt

SEQ ID NO: 3201 - DNA, 20 bp, Artificial Sequence
  sgRNA
  mm17990_Tpo
ggtttggatccgatagtgag

SEQ ID NO: 3202 - DNA, 20 bp, Artificial Sequence
  sgRNA
  mm17991_Tpo
tctaaatgagtaccaaccgg

SEQ ID NO: 3203 - DNA, 20 bp, Artificial Sequence
  sgRNA
  mm17992_Tpo
tggcagcggtacacaccttg

SEQ ID NO: 3204 - DNA, 20 bp, Artificial Sequence
  sgRNA
  mm17993_Tpo
tgagggaaattacctgtatg

SEQ ID NO: 3205 - DNA, 20 bp, Artificial Sequence
  sgRNA
  mm17998_Tpst2
tgccatagcggtactccacg

SEQ ID NO: 3206 - DNA, 20 bp, Artificial Sequence
  sgRNA
  mm17999_Tpst2
gcactccatgatcacgcgca

SEQ ID NO: 3207 - DNA, 20 bp, Artificial Sequence
  sgRNA
  mm18000_Tpst2
ctgtgcgtacatcacctcga

SEQ ID NO: 3208 - DNA, 20 bp, Artificial Sequence
  sgRNA
  mm18001_Tpst2
gccgcatggccagcacacga

SEQ ID NO: 3209 - DNA, 20 bp, Artificial Sequence
  sgRNA
  mm18014_Hsp90b1
aagaccactcaaatcgaaca

SEQ ID NO: 3210 - DNA, 20 bp, Artificial Sequence
  sgRNA
  mm18015_Hsp90b1
tccacagacagagactgttg

SEQ ID NO: 3211 - DNA, 20 bp, Artificial Sequence
  sgRNA
  mm18016_Hsp90b1
tattcatcaaacagacctcg

SEQ ID NO: 3212 - DNA, 20 bp, Artificial Sequence
  sgRNA
  mm18017_Hsp90b1
agaggaaacacactaggtcg

SEQ ID NO: 3213 - DNA, 20 bp, Artificial Sequence
  sgRNA
  mm18058_Trf
ggggacccttaacagcccaa

SEQ ID NO: 3214 - DNA, 20 bp, Artificial Sequence
  sgRNA
  mm18059_Trf
acagacctactactacgctg

SEQ ID NO: 3215 - DNA, 20 bp, Artificial Sequence
  sgRNA
  mm18060_Trf
gtagccaaagaatggttgag

SEQ ID NO: 3216 - DNA, 20 bp, Artificial Sequence
  sgRNA
  mm18061_Trf
agagaaccaagtgtgacgag

SEQ ID NO: 3217 - DNA, 20 bp, Artificial Sequence
  sgRNA
  mm18062_Tfrc
ctacacgcttacaatagccc

SEQ ID NO: 3218 - DNA, 20 bp, Artificial Sequence
  sgRNA
  mm18063_Tfrc
gaatacatacactcctcgtg

SEQ ID NO: 3219 - DNA, 20 bp, Artificial Sequence
  sgRNA
  mm18064_Tfrc
gggctcctactacaacataa

SEQ ID NO: 3220 - DNA, 20 bp, Artificial Sequence
  sgRNA
  mm18065_Tfrc
aaccctcgggagactccact

SEQ ID NO: 3221 - DNA, 20 bp, Artificial Sequence
  sgRNA
  mm18070_Trhr
agatactgtcggttatgttg

SEQ ID NO: 3222 - DNA, 20 bp, Artificial Sequence
  sgRNA
  mm18071_Trhr
ggtggttaccatcttacttg

SEQ ID NO: 3223 - DNA, 20 bp, Artificial Sequence
  sgRNA
  mm18072_Trhr
cacctacaaaaacgctgttg

SEQ ID NO: 3224 - DNA, 20 bp, Artificial Sequence
  sgRNA
  mm18073_Trhr
ctaaagaaaactctaagatg

SEQ ID NO: 3225 - DNA, 20 bp, Artificial Sequence
  sgRNA
  mm18106_Trpc4
aactccgtgtctgatctagg

SEQ ID NO: 3226 - DNA, 20 bp, Artificial Sequence
  sgRNA
  mm18107_Trpc4
attaactgcatcgaccccct

SEQ ID NO: 3227 - DNA, 20 bp, Artificial Sequence
  sgRNA
  mm18108_Trpc4
ggagtggatgatattaccgt

SEQ ID NO: 3228 - DNA, 20 bp, Artificial Sequence
  sgRNA
  mm18109_Trpc4
gacattatatgtgccaaaca

SEQ ID NO: 3229 - DNA, 20 bp, Artificial Sequence
  sgRNA
  mm18206_Tgoln1
caaactgtgatcggtcgcgg

SEQ ID NO: 3230 - DNA, 20 bp, Artificial Sequence
  sgRNA
  mm18207_Tgoln1
aagactacaaggccgaccga

SEQ ID NO: 3231 - DNA, 20 bp, Artificial Sequence
  sgRNA
  mm18208_Tgoln1
ccgagttgaacgaaactgcg

SEQ ID NO: 3232 - DNA, 20 bp, Artificial Sequence
  sgRNA
  mm18209_Tgoln1
ggagtggaggactgtttgga

SEQ ID NO: 3233 - DNA, 20 bp, Artificial Sequence
  sgRNA
  mm18246_Tubb2a
cgggcaccatggactcagtg

SEQ ID NO: 3234 - DNA, 20 bp, Artificial Sequence
  sgRNA
  mm18247_Tubb2a
gaggtgataagcgatgagca

SEQ ID NO: 3235 - DNA, 20 bp, Artificial Sequence
  sgRNA
  mm18248_Tubb2a
actctgtcctagatgtggtg

SEQ ID NO: 3236 - DNA, 20 bp, Artificial Sequence
  sgRNA
  mm18249_Tubb2a
aacctattccattgacaatg

SEQ ID NO: 3237 - DNA, 20 bp, Artificial Sequence
  sgRNA
  mm18258_Tubb5
gaggtgataagcgatgaaca

SEQ ID NO: 3238 - DNA, 20 bp, Artificial Sequence
  sgRNA
  mm18259_Tubb5
gatccaccaagatagctcga

SEQ ID NO: 3239 - DNA, 20 bp, Artificial Sequence
  sgRNA
  mm18260_Tubb5
tatcatgaataccttcagtg

SEQ ID NO: 3240 - DNA, 20 bp, Artificial Sequence
  sgRNA
  mm18261_Tubb5
gggtaagttcaggcacagtg

SEQ ID NO: 3241 - DNA, 20 bp, Artificial Sequence
  sgRNA
  mm18278_Tnfrsf4
gagccgctgtgatcatacca

SEQ ID NO: 3242 - DNA, 20 bp, Artificial Sequence
  sgRNA
  mm18279_Tnfrsf4
tcacacttggagttacagca

SEQ ID NO: 3243 - DNA, 20 bp, Artificial Sequence
  sgRNA
  mm18280_Tnfrsf4
ttccagataaggtacaactg

SEQ ID NO: 3244 - DNA, 20 bp, Artificial Sequence
  sgRNA
  mm18281_Tnfrsf4
gtagaccaggcacccaacct

SEQ ID NO: 3245 - DNA, 20 bp, Artificial Sequence
  sgRNA
  mm18282_Tnfsf4
gaatgagtatcaaactatgg

SEQ ID NO: 3246 - DNA, 20 bp, Artificial Sequence
  sgRNA
  mm18283_Tnfsf4
actggtgcatcttaccggag

SEQ ID NO: 3247 - DNA, 20 bp, Artificial Sequence
  sgRNA
  mm18284_Tnfsf4
agatgggattatgatcctcc

SEQ ID NO: 3248 - DNA, 20 bp, Artificial Sequence
  sgRNA
  mm18285_Tnfsf4
cggttgtcatcaagtgcgat

SEQ ID NO: 3249 - DNA, 20 bp, Artificial Sequence
  sgRNA
  mm18306_Tyro3
ggagtttgaccatccacacg

SEQ ID NO: 3250 - DNA, 20 bp, Artificial Sequence
  sgRNA
  mm18307_Tyro3
taggagagtttggatcagtg

SEQ ID NO: 3251 - DNA, 20 bp, Artificial Sequence
  sgRNA
  mm18308_Tyro3
acagcttataaggtcctagg

SEQ ID NO: 3252 - DNA, 20 bp, Artificial Sequence
  sgRNA
  mm18309_Tyro3
aacccgtaaccatttactgg

SEQ ID NO: 3253 - DNA, 20 bp, Artificial Sequence
  sgRNA
  mm18310_Tyrobp
ctgtacgggacttaatccta

SEQ ID NO: 3254 - DNA, 20 bp, Artificial Sequence
  sgRNA
  mm18311_Tyrobp
aaggaacagaaggcaccagg

SEQ ID NO: 3255 - DNA, 20 bp, Artificial Sequence
  sgRNA
  mm18312_Tyrobp
caatcccagccagtacacca

SEQ ID NO: 3256 - DNA, 20 bp, Artificial Sequence
  sgRNA
  mm18313_Tyrobp
cttgacctcgggagaccagg

SEQ ID NO: 3257 - DNA, 20 bp, Artificial Sequence
  sgRNA
  mm18494_Unc5c
aggcactacgaagagtcgga

SEQ ID NO: 3258 - DNA, 20 bp, Artificial Sequence
  sgRNA
  mm18495_Unc5c
cttaccatacacgatgacag

SEQ ID NO: 3259 - DNA, 20 bp, Artificial Sequence
  sgRNA
  mm18496_Unc5c
tcagaccctacttacccctg

SEQ ID NO: 3260 - DNA, 20 bp, Artificial Sequence
  sgRNA
  mm18497_Unc5c
atgatgtggctctctacgtg

SEQ ID NO: 3261 - DNA, 20 bp, Artificial Sequence
  sgRNA
  mm18638_Vamp1
ccaacatgaccagtaacagg

SEQ ID NO: 3262 - DNA, 20 bp, Artificial Sequence
  sgRNA
  mm18639_Vamp1
gctctcaaattgtgatgctc

SEQ ID NO: 3263 - DNA, 20 bp, Artificial Sequence
  sgRNA
  mm18640_Vamp1
tctgcaatctccttaggtgg

SEQ ID NO: 3264 - DNA, 20 bp, Artificial Sequence
  sgRNA
  mm18641_Vamp1
ggacatcatgcgtgtgaatg

SEQ ID NO: 3265 - DNA, 20 bp, Artificial Sequence
  sgRNA
  mm18646_Vamp3
tgacatcatgagagtcaatg

SEQ ID NO: 3266 - DNA, 20 bp, Artificial Sequence
  sgRNA
  mm18647_Vamp3
agcacttgtttcaaactgcg

SEQ ID NO: 3267 - DNA, 20 bp, Artificial Sequence
  sgRNA
  mm18648_Vamp3
gagtcttcgattactgccag

SEQ ID NO: 3268 - DNA, 20 bp, Artificial Sequence
  sgRNA
  mm18649_Vamp3
tgaccgcgcagatgcactgc

SEQ ID NO: 3269 - DNA, 20 bp, Artificial Sequence
  sgRNA
  mm18650_Vamp8
ccacctccgaaacaagacag

SEQ ID NO: 3270 - DNA, 20 bp, Artificial Sequence
  sgRNA
  mm18651_Vamp8
ttatgacccagaatgtggag

SEQ ID NO: 3271 - DNA, 20 bp, Artificial Sequence
  sgRNA
  mm18652_Vamp8
cttcaagacaacgtcccaga

SEQ ID NO: 3272 - DNA, 20 bp, Artificial Sequence
  sgRNA
  mm18653_Vamp8
ggagcggatcttggccagag

SEQ ID NO: 3273 - DNA, 20 bp, Artificial Sequence
  sgRNA
  mm18674_Vcam1
gctggaacgaagtatccacg

SEQ ID NO: 3274 - DNA, 20 bp, Artificial Sequence
  sgRNA
  mm18675_Vcam1
agacagcccactaaacgcga

SEQ ID NO: 3275 - DNA, 20 bp, Artificial Sequence
  sgRNA
  mm18676_Vcam1
cacagagctcaacacaagcg

SEQ ID NO: 3276 - DNA, 20 bp, Artificial Sequence
  sgRNA
  mm18677_Vcam1
tccctccacaaggcttcaag

SEQ ID NO: 3277 - DNA, 20 bp, Artificial Sequence
  sgRNA
  mm18682_Vdac1
aagagggagcacatcaacct

SEQ ID NO: 3278 - DNA, 20 bp, Artificial Sequence
  sgRNA
  mm18683_Vdac1
cggcgagaatgacgaatcaa

SEQ ID NO: 3279 - DNA, 20 bp, Artificial Sequence
  sgRNA
  mm18684_Vdac1
tggaacacagacaacaccct

SEQ ID NO: 3280 - DNA, 20 bp, Artificial Sequence
  sgRNA
  mm18685_Vdac1
cttcgcagttggctataaga

SEQ ID NO: 3281 - DNA, 20 bp, Artificial Sequence
  sgRNA
  mm18694_Vegfa
agatgtactctatctcgtcg

SEQ ID NO: 3282 - DNA, 20 bp, Artificial Sequence
  sgRNA
  mm18695_Vegfa
tggtttcggaggcccgtccg

SEQ ID NO: 3283 - DNA, 20 bp, Artificial Sequence
  sgRNA
  mm18696_Vegfa
gcgcgggcttcggttcctcg

SEQ ID NO: 3284 - DNA, 20 bp, Artificial Sequence
  sgRNA
  mm18697_Vegfa
gccgcaggagacaaaccgat

SEQ ID NO: 3285 - DNA, 20 bp, Artificial Sequence
  sgRNA
  mm18754_Vldlr
ttgatgaatgccaaaacccg

SEQ ID NO: 3286 - DNA, 20 bp, Artificial Sequence
  sgRNA
  mm18755_Vldlr
tagaatacaaaccccgacaa

SEQ ID NO: 3287 - DNA, 20 bp, Artificial Sequence
  sgRNA
  mm18756_Vldlr
agtgcattcacaaaaaatgg

SEQ ID NO: 3288 - DNA, 20 bp, Artificial Sequence
  sgRNA
  mm18757_Vldlr
agagcaactaaggaacacgg

SEQ ID NO: 3289 - DNA, 20 bp, Artificial Sequence
  sgRNA
  mm18762_Vnn1
catgctcgtaaacagccgcg

SEQ ID NO: 3290 - DNA, 20 bp, Artificial Sequence
  sgRNA
  mm18763_Vnn1
ctatgcacccgattctccaa

SEQ ID NO: 3291 - DNA, 20 bp, Artificial Sequence
  sgRNA
  mm18764_Vnn1
taccagatttggctctaccc

SEQ ID NO: 3292 - DNA, 20 bp, Artificial Sequence
  sgRNA
  mm18765_Vnn1
aggaaggacgtccatccagg

SEQ ID NO: 3293 - DNA, 20 bp, Artificial Sequence
  sgRNA
  mm18766_Vpreb1
agggaagaagatgctaatgg

SEQ ID NO: 3294 - DNA, 20 bp, Artificial Sequence
  sgRNA
  mm18767_Vpreb1
ccgggtccaaagatacgacc

SEQ ID NO: 3295 - DNA, 20 bp, Artificial Sequence
  sgRNA
  mm18768_Vpreb1
gctggcctatctcacaggta

SEQ ID NO: 3296 - DNA, 20 bp, Artificial Sequence
  sgRNA
  mm18769_Vpreb1
tcacactcagacaagcacca

SEQ ID NO: 3297 - DNA, 20 bp, Artificial Sequence
  sgRNA
  mm18786_Trpv2
tgcaccgatgagttctaccg

SEQ ID NO: 3298 - DNA, 20 bp, Artificial Sequence
  sgRNA
  mm18787_Trpv2
ccgtgaccgactcttcagtg

SEQ ID NO: 3299 - DNA, 20 bp, Artificial Sequence
  sgRNA
  mm18788_Trpv2
tgacagccttctccaaatgg

SEQ ID NO: 3300 - DNA, 20 bp, Artificial Sequence
  sgRNA
  mm18789_Trpv2
tttcccgaaagttcaccgag

SEQ ID NO: 3301 - DNA, 20 bp, Artificial Sequence
  sgRNA
  mm18790_Vtn
ggacgtgttcactatgccag

SEQ ID NO: 3302 - DNA, 20 bp, Artificial Sequence
  sgRNA
  mm18791_Vtn
cgaggatttaggtcaccggg

SEQ ID NO: 3303 - DNA, 20 bp, Artificial Sequence
  sgRNA
  mm18792_Vtn
gcctaaagtggagcaacagg

SEQ ID NO: 3304 - DNA, 20 bp, Artificial Sequence
  sgRNA
  mm18793_Vtn
agatgtttcggggataacca

SEQ ID NO: 3305 - DNA, 20 bp, Artificial Sequence
  sgRNA
  mm18794_Vwf
aaattcctagccatccgtgg

SEQ ID NO: 3306 - DNA, 20 bp, Artificial Sequence
  sgRNA
  mm18795_Vwf
gcaacttacgacaggcactg

SEQ ID NO: 3307 - DNA, 20 bp, Artificial Sequence
  sgRNA
  mm18796_Vwf
cattgatgtaccatggaatg

SEQ ID NO: 3308 - DNA, 20 bp, Artificial Sequence
  sgRNA
  mm18797_Vwf
tggtctgagaaaatgtccgc

SEQ ID NO: 3309 - DNA, 20 bp, Artificial Sequence
  sgRNA
  mm18854_Wisp2
gctgtcgagtgtgtgcacgg

SEQ ID NO: 3310 - DNA, 20 bp, Artificial Sequence
  sgRNA
  mm18855_Wisp2
ttgtgccgctgtgatgacgg

SEQ ID NO: 3311 - DNA, 20 bp, Artificial Sequence
  sgRNA
  mm18856_Wisp2
gctgtgaggtgaatggccgc

SEQ ID NO: 3312 - DNA, 20 bp, Artificial Sequence
  sgRNA
  mm18857_Wisp2
cctggtcacacacccactcg

SEQ ID NO: 3313 - DNA, 20 bp, Artificial Sequence
  sgRNA
  mm18862_Wnt1
cctgcacctgcgactaccgg

SEQ ID NO: 3314 - DNA, 20 bp, Artificial Sequence
  sgRNA
  mm18863_Wnt1
ttcggcaagatcgtcaaccg

SEQ ID NO: 3315 - DNA, 20 bp, Artificial Sequence
  sgRNA
  mm18864_Wnt1
atccgtcaacaggttcgtgg

SEQ ID NO: 3316 - DNA, 20 bp, Artificial Sequence
  sgRNA
  mm18865_Wnt1
ccacgaactctcggccaaag

SEQ ID NO: 3317 - DNA, 20 bp, Artificial Sequence
  sgRNA
  mm18894_Wnt3a
accgtcacaacaatgaggct

SEQ ID NO: 3318 - DNA, 20 bp, Artificial Sequence
  sgRNA
  mm18895_Wnt3a
gtgaagtgaagacctgctgg

SEQ ID NO: 3319 - DNA, 20 bp, Artificial Sequence
  sgRNA
  mm18896_Wnt3a
gtgctcagagaggagtactg

SEQ ID NO: 3320 - DNA, 20 bp, Artificial Sequence
  sgRNA
  mm18897_Wnt3a
cactgcgaaagctactccag

SEQ ID NO: 3321 - DNA, 20 bp, Artificial Sequence
  sgRNA
  mm18898_Wnt4
gtgatggactcagtgcgccg

SEQ ID NO: 3322 - DNA, 20 bp, Artificial Sequence
  sgRNA
  mm18899_Wnt4
ggtggagtgcaagtgtcacg

SEQ ID NO: 3323 - DNA, 20 bp, Artificial Sequence
  sgRNA
  mm18900_Wnt4
ttacagccaattgctcgcgg

SEQ ID NO: 3324 - DNA, 20 bp, Artificial Sequence
  sgRNA
  mm18901_Wnt4
tttgggaaggtggtgacaca

SEQ ID NO: 3325 - DNA, 20 bp, Artificial Sequence
  sgRNA
  mm18902_Wnt5a
agggaacgaatccacgctaa

SEQ ID NO: 3326 - DNA, 20 bp, Artificial Sequence
  sgRNA
  mm18903_Wnt5a
acaacaatgaagcaggccgt

SEQ ID NO: 3327 - DNA, 20 bp, Artificial Sequence
  sgRNA
  mm18904_Wnt5a
ctgggcgaaggagaaaaacg

SEQ ID NO: 3328 - DNA, 20 bp, Artificial Sequence
  sgRNA
  mm18905_Wnt5a
gcatgtggtcctgatacaag

SEQ ID NO: 3329 - DNA, 20 bp, Artificial Sequence
  sgRNA
  mm18906_Wnt5b
ggagcacatgtcctacatcg

SEQ ID NO: 3330 - DNA, 20 bp, Artificial Sequence
  sgRNA
  mm18907_Wnt5b
gacatcagccatcttataca

SEQ ID NO: 3331 - DNA, 20 bp, Artificial Sequence
  sgRNA
  mm18908_Wnt5b
gcgccaatgatgaacatctc

SEQ ID NO: 3332 - DNA, 20 bp, Artificial Sequence
  sgRNA
  mm18909_Wnt5b
ggcgctcactgcatacgtga

SEQ ID NO: 3333 - DNA, 20 bp, Artificial Sequence
  sgRNA
  mm18910_Wnt6
ccgcgcacgtcgatggactg

SEQ ID NO: 3334 - DNA, 20 bp, Artificial Sequence
  sgRNA
  mm18911_Wnt6
tgtgcagttgcaccaatgca

SEQ ID NO: 3335 - DNA, 20 bp, Artificial Sequence
  sgRNA
  mm18912_Wnt6
gtagtggcagagcttgcccg

SEQ ID NO: 3336 - DNA, 20 bp, Artificial Sequence
  sgRNA
  mm18913_Wnt6
aagcccatggcacttacact

SEQ ID NO: 3337 - DNA, 20 bp, Artificial Sequence
  sgRNA
  mm18914_Wnt7a
gcccgcagcgataatcgcat

SEQ ID NO: 3338 - DNA, 20 bp, Artificial Sequence
  sgRNA
  mm18915_Wnt7a
catgaacttacacaataacg

SEQ ID NO: 3339 - DNA, 20 bp, Artificial Sequence
  sgRNA
  mm18916_Wnt7a
ggccagtaccaccgggacga

SEQ ID NO: 3340 - DNA, 20 bp, Artificial Sequence
  sgRNA
  mm18917_Wnt7a
tagcctagctctcggaactg

SEQ ID NO: 3341 - DNA, 20 bp, Artificial Sequence
  sgRNA
  mm18918_Wnt7b
cacgctacctaagttccgcg

SEQ ID NO: 3342 - DNA, 20 bp, Artificial Sequence
  sgRNA
  mm18919_Wnt7b
gaagcaaggctactacaacc

SEQ ID NO: 3343 - DNA, 20 bp, Artificial Sequence
  sgRNA
  mm18920_Wnt7b
tcacaatgatggcatcgggt

SEQ ID NO: 3344 - DNA, 20 bp, Artificial Sequence
  sgRNA
  mm18921_Wnt7b
cagagcattgtcatccgtgg

SEQ ID NO: 3345 - DNA, 20 bp, Artificial Sequence
  sgRNA
  mm19006_Ybx1
gtcttacaggaatgacacca

SEQ ID NO: 3346 - DNA, 20 bp, Artificial Sequence
  sgRNA
  mm19007_Ybx1
ttgttgaaggagaaaaggtg

SEQ ID NO: 3347 - DNA, 20 bp, Artificial Sequence
  sgRNA
  mm19008_Ybx1
gccggccctatcgcaggcga

SEQ ID NO: 3348 - DNA, 20 bp, Artificial Sequence
  sgRNA
  mm19009_Ybx1
gagagtggggaaaagaacga

SEQ ID NO: 3349 - DNA, 20 bp, Artificial Sequence
  sgRNA
  mm19338_Slc30a1
tgggccagcgtcacgcatcg

SEQ ID NO: 3350 - DNA, 20 bp, Artificial Sequence
  sgRNA
  mm19339_Slc30a1
ccaggaggagaccaacacgc

SEQ ID NO: 3351 - DNA, 20 bp, Artificial Sequence
  sgRNA
  mm19340_Slc30a1
ggcattcacgaccacgatca

SEQ ID NO: 3352 - DNA, 20 bp, Artificial Sequence
  sgRNA
  mm19341_Slc30a1
ggagtctgacaatctggaag

SEQ ID NO: 3353 - DNA, 20 bp, Artificial Sequence
  sgRNA
  mm19358_Zp3
agagactctccagttcacgg

SEQ ID NO: 3354 - DNA, 20 bp, Artificial Sequence
  sgRNA
  mm19359_Zp3
ggtgtccgtggataccgacg

SEQ ID NO: 3355 - DNA, 20 bp, Artificial Sequence
  sgRNA
  mm19360_Zp3
catcctcaggactaaccgtg

SEQ ID NO: 3356 - DNA, 20 bp, Artificial Sequence
  sgRNA
  mm19361_Zp3
tctcagatagaccatccaca

SEQ ID NO: 3357 - DNA, 20 bp, Artificial Sequence
  sgRNA
  mm19382_Adam23
cgtgtgttctcgaataagag

SEQ ID NO: 3358 - DNA, 20 bp, Artificial Sequence
  sgRNA
  mm19383_Adam23
tctgcagtttcattccagtg

SEQ ID NO: 3359 - DNA, 20 bp, Artificial Sequence
  sgRNA
  mm19384_Adam23
tttgctatcttctgactacg

SEQ ID NO: 3360 - DNA, 20 bp, Artificial Sequence
  sgRNA
  mm19385_Adam23
gaagtgttcgctctccaatg

SEQ ID NO: 3361 - DNA, 20 bp, Artificial Sequence
  sgRNA
  mm19470_Cdh20
agagatgaagtataccattg

SEQ ID NO: 3362 - DNA, 20 bp, Artificial Sequence
  sgRNA
  mm19471_Cdh20
ttagacaatccctcccaagt

SEQ ID NO: 3363 - DNA, 20 bp, Artificial Sequence
  sgRNA
  mm19472_Cdh20
ttggataacagatgtacctg

SEQ ID NO: 3364 - DNA, 20 bp, Artificial Sequence
  sgRNA
  mm19473_Cdh20
aacaacagtgcacatcagtg

SEQ ID NO: 3365 - DNA, 20 bp, Artificial Sequence
  sgRNA
  mm19482_Clec5a
agtggttccgtagctctccg

SEQ ID NO: 3366 - DNA, 20 bp, Artificial Sequence
  sgRNA
  mm19483_Clec5a
acgaaagtaccatgcctaca

SEQ ID NO: 3367 - DNA, 20 bp, Artificial Sequence
  sgRNA
  mm19484_Clec5a
agtgttgacaattgccagtg

SEQ ID NO: 3368 - DNA, 20 bp, Artificial Sequence
  sgRNA
  mm19485_Clec5a
tccagtctgtcccagaaact

SEQ ID NO: 3369 - DNA, 20 bp, Artificial Sequence
  sgRNA
  mm19566_Ggt5
gtgcggaggtcttatacaca

SEQ ID NO: 3370 - DNA, 20 bp, Artificial Sequence
  sgRNA
  mm19567_Ggt5
agatctgctcggatattgga

SEQ ID NO: 3371 - DNA, 20 bp, Artificial Sequence
  sgRNA
  mm19568_Ggt5
tgcagagaagttgaaccctg

SEQ ID NO: 3372 - DNA, 20 bp, Artificial Sequence
  sgRNA
  mm19569_Ggt5
gctgggctagatcttcccgg

SEQ ID NO: 3373 - DNA, 20 bp, Artificial Sequence
  sgRNA
  mm19578_Grem1
gggaaaaagaaaggttccca

SEQ ID NO: 3374 - DNA, 20 bp, Artificial Sequence
  sgRNA
  mm19579_Grem1
cctgaagcagaccatccacg

SEQ ID NO: 3375 - DNA, 20 bp, Artificial Sequence
  sgRNA
  mm19580_Grem1
tgcactggccataacagaag

SEQ ID NO: 3376 - DNA, 20 bp, Artificial Sequence
  sgRNA
  mm19581_Grem1
cttgcgctctgtcacgtgca

SEQ ID NO: 3377 - DNA, 20 bp, Artificial Sequence
  sgRNA
  mm19594_Hcst
catgtcactcctaattgtag

SEQ ID NO: 3378 - DNA, 20 bp, Artificial Sequence
  sgRNA
  mm19595_Hcst
agtggctgcaagtcagacat

SEQ ID NO: 3379 - DNA, 20 bp, Artificial Sequence
  sgRNA
  mm19596_Hcst
cagagacagagtcccacatc

SEQ ID NO: 3380 - DNA, 20 bp, Artificial Sequence
  sgRNA
  mm19597_Hcst
tgaccgcatctgcagccact

SEQ ID NO: 3381 - DNA, 20 bp, Artificial Sequence
  sgRNA
  mm19598_Hs2st1
gtaggctatattggtgaacg

SEQ ID NO: 3382 - DNA, 20 bp, Artificial Sequence
  sgRNA
  mm19599_Hs2st1
gtcccgggcgaagctaggtg

SEQ ID NO: 3383 - DNA, 20 bp, Artificial Sequence
  sgRNA
  mm19600_Hs2st1
aatttatatcaatgtcatca

SEQ ID NO: 3384 - DNA, 20 bp, Artificial Sequence
  sgRNA
  mm19601_Hs2st1
ttgtgaagaacataaccacc

SEQ ID NO: 3385 - DNA, 20 bp, Artificial Sequence
  sgRNA
  mm19650_Ly6h
ccgcttaacgaagtcgcagg

SEQ ID NO: 3386 - DNA, 20 bp, Artificial Sequence
  sgRNA
  mm19651_Ly6h
ctggcacaaacggtatcggt

SEQ ID NO: 3387 - DNA, 20 bp, Artificial Sequence
  sgRNA
  mm19652_Ly6h
tagggcctgaaagaggcgcg

SEQ ID NO: 3388 - DNA, 20 bp, Artificial Sequence
  sgRNA
  mm19653_Ly6h
gtcctggcaccacaggccat

SEQ ID NO: 3389 - DNA, 20 bp, Artificial Sequence
  sgRNA
  mm19714_Nt5e
tcatgaatttgataacggtg

SEQ ID NO: 3390 - DNA, 20 bp, Artificial Sequence
  sgRNA
  mm19715_Nt5e
tgaataagatcatcgccctg

SEQ ID NO: 3391 - DNA, 20 bp, Artificial Sequence
  sgRNA
  mm19716_Nt5e
tatgcctttggcaaatacct

SEQ ID NO: 3392 - DNA, 20 bp, Artificial Sequence
  sgRNA
  mm19717_Nt5e
cctgaagcggcacgtctgag

SEQ ID NO: 3393 - DNA, 20 bp, Artificial Sequence
  sgRNA
  mm19758_Pebp1
aagggtaatgacattagcag

SEQ ID NO: 3394 - DNA, 20 bp, Artificial Sequence
  sgRNA
  mm19759_Pebp1
cgtacaccagccagacatag

SEQ ID NO: 3395 - DNA, 20 bp, Artificial Sequence
  sgRNA
  mm19760_Pebp1
ggagtggcaccacttcctgg

SEQ ID NO: 3396 - DNA, 20 bp, Artificial Sequence
  sgRNA
  mm19761_Pebp1
cctgcgggtcgactacgccg

SEQ ID NO: 3397 - DNA, 20 bp, Artificial Sequence
  sgRNA
  mm19858_Ccl19
tctggggggtgctaatgatg

SEQ ID NO: 3398 - DNA, 20 bp, Artificial Sequence
  sgRNA
  mm19859_Ccl19
tacaggttcaccacactaag

SEQ ID NO: 3399 - DNA, 20 bp, Artificial Sequence
  sgRNA
  mm19860_Ccl19
attagcaccccccagagttg

SEQ ID NO: 3400 - DNA, 20 bp, Artificial Sequence
  sgRNA
  mm19861_Ccl19
caagcaactcacacaacagc

SEQ ID NO: 3401 - DNA, 20 bp, Artificial Sequence
  sgRNA
  mm19866_Sgcb
cacacccatttggcccaatg

SEQ ID NO: 3402 - DNA, 20 bp, Artificial Sequence
  sgRNA
  mm19867_Sgcb
aggaccggctccataagact

SEQ ID NO: 3403 - DNA, 20 bp, Artificial Sequence
  sgRNA
  mm19868_Sgcb
ccgtgctcttataaagcggg

SEQ ID NO: 3404 - DNA, 20 bp, Artificial Sequence
  sgRNA
  mm19869_Sgcb
tgacggccaggataaacagg

SEQ ID NO: 3405 - DNA, 20 bp, Artificial Sequence
  sgRNA
  mm19870_Sgcd
atccccactttgtatatgtg

SEQ ID NO: 3406 - DNA, 20 bp, Artificial Sequence
  sgRNA
  mm19871_Sgcd
gagattgagagtcttaggtg

SEQ ID NO: 3407 - DNA, 20 bp, Artificial Sequence
  sgRNA
  mm19872_Sgcd
catgaccttgagaatccaga

SEQ ID NO: 3408 - DNA, 20 bp, Artificial Sequence
  sgRNA
  mm19873_Sgcd
cttaccttagttccttgaag

SEQ ID NO: 3409 - DNA, 20 bp, Artificial Sequence
  sgRNA
  mm19890_Sigirr
ttggtaccaagacacttacg

SEQ ID NO: 3410 - DNA, 20 bp, Artificial Sequence
  sgRNA
  mm19891_Sigirr
cctcagttggagcggcgtcg

SEQ ID NO: 3411 - DNA, 20 bp, Artificial Sequence
  sgRNA
  mm19892_Sigirr
aagccacttcagcctccatg

SEQ ID NO: 3412 - DNA, 20 bp, Artificial Sequence
  sgRNA
  mm19893_Sigirr
cggaagctctggctacacca

SEQ ID NO: 3413 - DNA, 20 bp, Artificial Sequence
  sgRNA
  mm19894_Slco2a1
cccacggatgatcggcatag

SEQ ID NO: 3414 - DNA, 20 bp, Artificial Sequence
  sgRNA
  mm19895_Slco2a1
actcgggggatggtttgcag

SEQ ID NO: 3415 - DNA, 20 bp, Artificial Sequence
  sgRNA
  mm19896_Slco2a1
cttcgtggactacggcagag

SEQ ID NO: 3416 - DNA, 20 bp, Artificial Sequence
  sgRNA
  mm19897_Slco2a1
ctctgcaaagtcgtccacat

SEQ ID NO: 3417 - DNA, 20 bp, Artificial Sequence
  sgRNA
  mm19926_Synj2bp
ggtggattatttagtcacgg

SEQ ID NO: 3418 - DNA, 20 bp, Artificial Sequence
  sgRNA
  mm19927_Synj2bp
ctacgtcagccgtatcaaag

SEQ ID NO: 3419 - DNA, 20 bp, Artificial Sequence
  sgRNA
  mm19928_Synj2bp
cagtatgtctccaacgacag

SEQ ID NO: 3420 - DNA, 20 bp, Artificial Sequence
  sgRNA
  mm19929_Synj2bp
cgaagccatttctcaccgag

SEQ ID NO: 3421 - DNA, 20 bp, Artificial Sequence
  sgRNA
  mm19954_Tlr2
tcactacgtctgactccgag

SEQ ID NO: 3422 - DNA, 20 bp, Artificial Sequence
  sgRNA
  mm19955_Tlr2
ggaggttcgcacacgctcgg

SEQ ID NO: 3423 - DNA, 20 bp, Artificial Sequence
  sgRNA
  mm19956_Tlr2
ggaaaggggcccgaaccagg

SEQ ID NO: 3424 - DNA, 20 bp, Artificial Sequence
  sgRNA
  mm19957_Tlr2
cagggaacaacgaagcatct

SEQ ID NO: 3425 - DNA, 20 bp, Artificial Sequence
  sgRNA
  mm20046_Angptl2
tgtgaccagagacatgaccc

SEQ ID NO: 3426 - DNA, 20 bp, Artificial Sequence
  sgRNA
  mm20047_Angptl2
gtgggtggttggtagacccg

SEQ ID NO: 3427 - DNA, 20 bp, Artificial Sequence
  sgRNA
  mm20048_Angptl2
gctggcacacaaccaatcag

SEQ ID NO: 3428 - DNA, 20 bp, Artificial Sequence
  sgRNA
  mm20049_Angptl2
ttacctcaacaggtacaagc

SEQ ID NO: 3429 - DNA, 20 bp, Artificial Sequence
  sgRNA
  mm20054_Axl
ggatatccggatgtgatacg

SEQ ID NO: 3430 - DNA, 20 bp, Artificial Sequence
  sgRNA
  mm20055_Axl
cccagcagtacataccacca

SEQ ID NO: 3431 - DNA, 20 bp, Artificial Sequence
  sgRNA
  mm20056_Axl
cagacaacctacggagctag

SEQ ID NO: 3432 - DNA, 20 bp, Artificial Sequence
  sgRNA
  mm20057_Axl
ttgaccaccccaacgtcatg

SEQ ID NO: 3433 - DNA, 20 bp, Artificial Sequence
  sgRNA
  mm20058_Btd
cttgctgttcatagacgtcg

SEQ ID NO: 3434 - DNA, 20 bp, Artificial Sequence
  sgRNA
  mm20059_Btd
gtaccaaaaggacttgagag

SEQ ID NO: 3435 - DNA, 20 bp, Artificial Sequence
  sgRNA
  mm20060_Btd
ataccagtttaacacaaatg

SEQ ID NO: 3436 - DNA, 20 bp, Artificial Sequence
  sgRNA
  mm20061_Btd
ccgcgaggctgagtactacg

SEQ ID NO: 3437 - DNA, 20 bp, Artificial Sequence
  sgRNA
  mm20066_Ceacam1
atagtaatatgaatttcacg

SEQ ID NO: 3438 - DNA, 20 bp, Artificial Sequence
  sgRNA
  mm20067_Ceacam1
aagcaacaactccaatcccg

SEQ ID NO: 3439 - DNA, 20 bp, Artificial Sequence
  sgRNA
  mm20068_Ceacam1
ttgttgtcttcagcaacctg

SEQ ID NO: 3440 - DNA, 20 bp, Artificial Sequence
  sgRNA
  mm20069_Ceacam1
agctcttgggaggatgcatg

SEQ ID NO: 3441 - DNA, 20 bp, Artificial Sequence
  sgRNA
  mm20074_Ceacam2
tcggcctttagctggcacaa

SEQ ID NO: 3442 - DNA, 20 bp, Artificial Sequence
  sgRNA
  mm20075_Ceacam2
agatcaaaactatcgtcgta

SEQ ID NO: 3443 - DNA, 20 bp, Artificial Sequence
  sgRNA
  mm20076_Ceacam2
acaggtaggttatattatca

SEQ ID NO: 3444 - DNA, 20 bp, Artificial Sequence
  sgRNA
  mm20077_Ceacam2
acagtcacttgtgcagtggt

SEQ ID NO: 3445 - DNA, 20 bp, Artificial Sequence
  sgRNA
  mm20094_Clcn6
gaaagggcgaagatacgagg

SEQ ID NO: 3446 - DNA, 20 bp, Artificial Sequence
  sgRNA
  mm20095_Clcn6
ctacaaatgagatcacctat

SEQ ID NO: 3447 - DNA, 20 bp, Artificial Sequence
  sgRNA
  mm20096_Clcn6
gcgtgactttgtgtcagcgg

SEQ ID NO: 3448 - DNA, 20 bp, Artificial Sequence
  sgRNA
  mm20097_Clcn6
agaataaggccagggtgacg

SEQ ID NO: 3449 - DNA, 20 bp, Artificial Sequence
  sgRNA
  mm20202_Map3k5
atgcgtaatgaaacttcacg

SEQ ID NO: 3450 - DNA, 20 bp, Artificial Sequence
  sgRNA
  mm20203_Map3k5
ataatcgataaaggaccacg

SEQ ID NO: 3451 - DNA, 20 bp, Artificial Sequence
  sgRNA
  mm20204_Map3k5
ctgaacgaaacggtccacga

SEQ ID NO: 3452 - DNA, 20 bp, Artificial Sequence
  sgRNA
  mm20205_Map3k5
gggcggccggcgtaccaccg

SEQ ID NO: 3453 - DNA, 20 bp, Artificial Sequence
  sgRNA
  mm20286_Plod2
gtgtgattactactttagtg

SEQ ID NO: 3454 - DNA, 20 bp, Artificial Sequence
  sgRNA
  mm20287_Plod2
atggaatgaacagtatcgga

SEQ ID NO: 3455 - DNA, 20 bp, Artificial Sequence
  sgRNA
  mm20288_Plod2
aaacgctacctgaattctgg

SEQ ID NO: 3456 - DNA, 20 bp, Artificial Sequence
  sgRNA
  mm20289_Plod2
tgctcgctctgaagattacg

SEQ ID NO: 3457 - DNA, 20 bp, Artificial Sequence
  sgRNA
  mm20290_Plod3
agagagagatcctgtccggg

SEQ ID NO: 3458 - DNA, 20 bp, Artificial Sequence
  sgRNA
  mm20291_Plod3
tcaggcatatgtgatccgcg

SEQ ID NO: 3459 - DNA, 20 bp, Artificial Sequence
  sgRNA
  mm20292_Plod3
ctggcggacaatctgatgga

SEQ ID NO: 3460 - DNA, 20 bp, Artificial Sequence
  sgRNA
  mm20293_Plod3
agctccagctcaactacctg

SEQ ID NO: 3461 - DNA, 20 bp, Artificial Sequence
  sgRNA
  mm20298_Psg16
ctacggaccgtaaatagacg

SEQ ID NO: 3462 - DNA, 20 bp, Artificial Sequence
  sgRNA
  mm20299_Psg16
agggctttcctggtacaaag

SEQ ID NO: 3463 - DNA, 20 bp, Artificial Sequence
  sgRNA
  mm20300_Psg16
tacaaactctgagtagacat

SEQ ID NO: 3464 - DNA, 20 bp, Artificial Sequence
  sgRNA
  mm20301_Psg16
tcatcatcgatccaatgcca

SEQ ID NO: 3465 - DNA, 20 bp, Artificial Sequence
  sgRNA
  mm20354_Rpl27a
gaggcgcacacttaccgatg

SEQ ID NO: 3466 - DNA, 20 bp, Artificial Sequence
  sgRNA
  mm20355_Rpl27a
cgagcagacacgggtcaatg

SEQ ID NO: 3467 - DNA, 20 bp, Artificial Sequence
  sgRNA
  mm20356_Rpl27a
caaagtaacctgggtgactg

SEQ ID NO: 3468 - DNA, 20 bp, Artificial Sequence
  sgRNA
  mm20357_Rpl27a
cctggataaactgtggacat

SEQ ID NO: 3469 - DNA, 20 bp, Artificial Sequence
  sgRNA
  mm20358_Sema4g
acagtatgagacactacgtg

SEQ ID NO: 3470 - DNA, 20 bp, Artificial Sequence
  sgRNA
  mm20359_Sema4g
gccgctgtagaaatcgcacg

SEQ ID NO: 3471 - DNA, 20 bp, Artificial Sequence
  sgRNA
  mm20360_Sema4g
agaaagagcaggtcataggt

SEQ ID NO: 3472 - DNA, 20 bp, Artificial Sequence
  sgRNA
  mm20361_Sema4g
ggagaaatgtccttatgacc

SEQ ID NO: 3473 - DNA, 20 bp, Artificial Sequence
  sgRNA
  mm20426_Ror1
agcacgggtgtagactaccg

SEQ ID NO: 3474 - DNA, 20 bp, Artificial Sequence
  sgRNA
  mm20427_Ror1
tcatcacgacacaagtcacg

SEQ ID NO: 3475 - DNA, 20 bp, Artificial Sequence
  sgRNA
  mm20428_Ror1
acttcaagtgaaatcgacaa

SEQ ID NO: 3476 - DNA, 20 bp, Artificial Sequence
  sgRNA
  mm20429_Ror1
acagccgacatcggaatgcg

SEQ ID NO: 3477 - DNA, 20 bp, Artificial Sequence
  sgRNA
  mm20430_Ror2
agagaatacatactacacgg

SEQ ID NO: 3478 - DNA, 20 bp, Artificial Sequence
  sgRNA
  mm20431_Ror2
tggtggcgcagatcgctgcg

SEQ ID NO: 3479 - DNA, 20 bp, Artificial Sequence
  sgRNA
  mm20432_Ror2
gctctggcgccgattacagg

SEQ ID NO: 3480 - DNA, 20 bp, Artificial Sequence
  sgRNA
  mm20433_Ror2
ctggtctgacagttgcgtgg

SEQ ID NO: 3481 - DNA, 20 bp, Artificial Sequence
  sgRNA
  mm20446_Slc7a11
tcattacacatacattctgg

SEQ ID NO: 3482 - DNA, 20 bp, Artificial Sequence
  sgRNA
  mm20447_Slc7a11
gaagagacacaagtctaatg

SEQ ID NO: 3483 - DNA, 20 bp, Artificial Sequence
  sgRNA
  mm20448_Slc7a11
gggctacgtactgacaaacg

SEQ ID NO: 3484 - DNA, 20 bp, Artificial Sequence
  sgRNA
  mm20449_Slc7a11
acaggcagaccagaaaacca

SEQ ID NO: 3485 - DNA, 20 bp, Artificial Sequence
  sgRNA
  mm20478_B3galt1
tcaccctcaaaaccttaatg

SEQ ID NO: 3486 - DNA, 20 bp, Artificial Sequence
  sgRNA
  mm20479_B3galt1
ttcactggttacgtcatcaa

SEQ ID NO: 3487 - DNA, 20 bp, Artificial Sequence
  sgRNA
  mm20480_B3galt1
ggcatcaaattccttgtgtg

SEQ ID NO: 3488 - DNA, 20 bp, Artificial Sequence
  sgRNA
  mm20481_B3galt1
ggggatgaaaacaacttcaa

SEQ ID NO: 3489 - DNA, 20 bp, Artificial Sequence
  sgRNA
  mm20482_B3galt2
acctggcatccaaatcatac

SEQ ID NO: 3490 - DNA, 20 bp, Artificial Sequence
  sgRNA
  mm20483_B3galt2
agagaaagcacacccgtaag

SEQ ID NO: 3491 - DNA, 20 bp, Artificial Sequence
  sgRNA
  mm20484_B3galt2
cctgtgacatacactttccg

SEQ ID NO: 3492 - DNA, 20 bp, Artificial Sequence
  sgRNA
  mm20485_B3galt2
taacaccgagctatcaccac

SEQ ID NO: 3493 - DNA, 20 bp, Artificial Sequence
  sgRNA
  mm20486_B3galnt1
caagccattagagttacttg

SEQ ID NO: 3494 - DNA, 20 bp, Artificial Sequence
  sgRNA
  mm20487_B3galnt1
gctcgatcacattgtagtgg

SEQ ID NO: 3495 - DNA, 20 bp, Artificial Sequence
  sgRNA
  mm20488_B3galnt1
tcatgatatacttggcattg

SEQ ID NO: 3496 - DNA, 20 bp, Artificial Sequence
  sgRNA
  mm20489_B3galnt1
gagaacagttcgagtgttcg

SEQ ID NO: 3497 - DNA, 20 bp, Artificial Sequence
  sgRNA
  mm20610_Racgap1
gacaccggttaagattggag

SEQ ID NO: 3498 - DNA, 20 bp, Artificial Sequence
  sgRNA
  mm20611_Racgap1
tggcagtattcagctgagcg

SEQ ID NO: 3499 - DNA, 20 bp, Artificial Sequence
  sgRNA
  mm20612_Racgap1
gaagtatcaaagaaccaacc

SEQ ID NO: 3500 - DNA, 20 bp, Artificial Sequence
  sgRNA
  mm20613_Racgap1
tggacgtggagatcaagcgg

SEQ ID NO: 3501 - DNA, 20 bp, Artificial Sequence
  sgRNA
  mm20674_Islr
ttctggaatagacaccgctg

SEQ ID NO: 3502 - DNA, 20 bp, Artificial Sequence
  sgRNA
  mm20675_Islr
tgtgcctatcgtgacctaga

SEQ ID NO: 3503 - DNA, 20 bp, Artificial Sequence
  sgRNA
  mm20676_Islr
tcacaccccgggcggcacgg

SEQ ID NO: 3504 - DNA, 20 bp, Artificial Sequence
  sgRNA
  mm20677_Islr
ctggtagcttagttgcactg

SEQ ID NO: 3505 - DNA, 20 bp, Artificial Sequence
  sgRNA
  mm20698_Klrk1
aagggtgaatcgaattgcca

SEQ ID NO: 3506 - DNA, 20 bp, Artificial Sequence
  sgRNA
  mm20699_Klrk1
atatccagttgttagggcat

SEQ ID NO: 3507 - DNA, 20 bp, Artificial Sequence
  sgRNA
  mm20700_Klrk1
gcactaactaccagtcaacc

SEQ ID NO: 3508 - DNA, 20 bp, Artificial Sequence
  sgRNA
  mm20701_Klrk1
cgacctcaagccagcaaagt

SEQ ID NO: 3509 - DNA, 20 bp, Artificial Sequence
  sgRNA
  mm20710_Tspan32
agagcccatctagcaactgg

SEQ ID NO: 3510 - DNA, 20 bp, Artificial Sequence
  sgRNA
  mm20711_Tspan32
gcaaagcacaggaaaccctg

SEQ ID NO: 3511 - DNA, 20 bp, Artificial Sequence
  sgRNA
  mm20712_Tspan32
ggggttgtagaatctccaga

SEQ ID NO: 3512 - DNA, 20 bp, Artificial Sequence
  sgRNA
  mm20713_Tspan32
actggagccatcatgtgtca

SEQ ID NO: 3513 - DNA, 20 bp, Artificial Sequence
  sgRNA
  mm20754_Fkbp9
aaacctatgacacgtacgtg

SEQ ID NO: 3514 - DNA, 20 bp, Artificial Sequence
  sgRNA
  mm20755_Fkbp9
ttgggatgtgcgtaaacgag

SEQ ID NO: 3515 - DNA, 20 bp, Artificial Sequence
  sgRNA
  mm20756_Fkbp9
ccgatacttggatagtccga

SEQ ID NO: 3516 - DNA, 20 bp, Artificial Sequence
  sgRNA
  mm20757_Fkbp9
tcgtgcgctaccactacgtg

SEQ ID NO: 3517 - DNA, 20 bp, Artificial Sequence
  sgRNA
  mm20822_Podxl
aagcaagtgtagatgccact

SEQ ID NO: 3518 - DNA, 20 bp, Artificial Sequence
  sgRNA
  mm20823_Podxl
gggcacgtgtactcacgcaa

SEQ ID NO: 3519 - DNA, 20 bp, Artificial Sequence
  sgRNA
  mm20824_Podxl
aaccccacgagcaatcaaag

SEQ ID NO: 3520 - DNA, 20 bp, Artificial Sequence
  sgRNA
  mm20825_Podxl
gtgctcggtgaagaatccac

SEQ ID NO: 3521 - DNA, 20 bp, Artificial Sequence
  sgRNA
  mm20850_Slamf1
atctgatgttcattcgtcag

SEQ ID NO: 3522 - DNA, 20 bp, Artificial Sequence
  sgRNA
  mm20851_Slamf1
taaagtgctaaacaaaaccc

SEQ ID NO: 3523 - DNA, 20 bp, Artificial Sequence
  sgRNA
  mm20852_Slamf1
gagctatccagatcacctgg

SEQ ID NO: 3524 - DNA, 20 bp, Artificial Sequence
  sgRNA
  mm20853_Slamf1
aggatggtacttggtgagcg

SEQ ID NO: 3525 - DNA, 20 bp, Artificial Sequence
  sgRNA
  mm20882_Pla2g7
ggaaatggatcgtaccccgt

SEQ ID NO: 3526 - DNA, 20 bp, Artificial Sequence
  sgRNA
  mm20883_Pla2g7
ttgggatccaaacagtgtcg

SEQ ID NO: 3527 - DNA, 20 bp, Artificial Sequence
  sgRNA
  mm20884_Pla2g7
tagtggccactgtcgaacac

SEQ ID NO: 3528 - DNA, 20 bp, Artificial Sequence
  sgRNA
  mm20885_Pla2g7
gcgattcttgacattgaaca

SEQ ID NO: 3529 - DNA, 20 bp, Artificial Sequence
  sgRNA
  mm20926_Tnfrsf12a
ccaagccgaatcccaacacg

SEQ ID NO: 3530 - DNA, 20 bp, Artificial Sequence
  sgRNA
  mm20927_Tnfrsf12a
cgcagtccatgcacttgtcg

SEQ ID NO: 3531 - DNA, 20 bp, Artificial Sequence
  sgRNA
  mm20928_Tnfrsf12a
gctgccgctagagcatgggg

SEQ ID NO: 3532 - DNA, 20 bp, Artificial Sequence
  sgRNA
  mm20929_Tnfrsf12a
cttggtgttgatgcgcgccg

SEQ ID NO: 3533 - DNA, 20 bp, Artificial Sequence
  sgRNA
  mm20982_Rpl3
ttaggtgcttacctgagtgt

SEQ ID NO: 3534 - DNA, 20 bp, Artificial Sequence
  sgRNA
  mm20983_Rpl3
tgtggaaactcccccaatgg

SEQ ID NO: 3535 - DNA, 20 bp, Artificial Sequence
  sgRNA
  mm20984_Rpl3
cagagaaggcaacacgggca

SEQ ID NO: 3536 - DNA, 20 bp, Artificial Sequence
  sgRNA
  mm20985_Rpl3
aagcgcagcagccggcatcg

SEQ ID NO: 3537 - DNA, 20 bp, Artificial Sequence
  sgRNA
  mm21014_Tjp3
aagatggtccagtctcgcgt

SEQ ID NO: 3538 - DNA, 20 bp, Artificial Sequence
  sgRNA
  mm21015_Tjp3
tggctcctttcagatcaacg

SEQ ID NO: 3539 - DNA, 20 bp, Artificial Sequence
  sgRNA
  mm21016_Tjp3
actgaccgttcccgcctccg

SEQ ID NO: 3540 - DNA, 20 bp, Artificial Sequence
  sgRNA
  mm21017_Tjp3
cgtgggcatcttcgtatccg

SEQ ID NO: 3541 - DNA, 20 bp, Artificial Sequence
  sgRNA
  mm21062_Ptdss2
atcgtcgtagacttcagact

SEQ ID NO: 3542 - DNA, 20 bp, Artificial Sequence
  sgRNA
  mm21063_Ptdss2
attgccagagagggactacg

SEQ ID NO: 3543 - DNA, 20 bp, Artificial Sequence
  sgRNA
  mm21064_Ptdss2
aacgggctgggcatctactg

SEQ ID NO: 3544 - DNA, 20 bp, Artificial Sequence
  sgRNA
  mm21065_Ptdss2
tcatgcacatccaccagtca

SEQ ID NO: 3545 - DNA, 20 bp, Artificial Sequence
  sgRNA
  mm21070_Pign
ccagctccccaagtaacgaa

SEQ ID NO: 3546 - DNA, 20 bp, Artificial Sequence
  sgRNA
  mm21071_Pign
gtgttgttaagataacccac

SEQ ID NO: 3547 - DNA, 20 bp, Artificial Sequence
  sgRNA
  mm21072_Pign
tgccacaaaactggatacgt

SEQ ID NO: 3548 - DNA, 20 bp, Artificial Sequence
  sgRNA
  mm21073_Pign
aagtcaatagtgattcaacc

SEQ ID NO: 3549 - DNA, 20 bp, Artificial Sequence
  sgRNA
  mm21106_Abca7
gtgtcggcgcaagaaaagcg

SEQ ID NO: 3550 - DNA, 20 bp, Artificial Sequence
  sgRNA
  mm21107_Abca7
gagaaaccatgcgtgcgatg

SEQ ID NO: 3551 - DNA, 20 bp, Artificial Sequence
  sgRNA
  mm21108_Abca7
cagacacatttcggccagtg

SEQ ID NO: 3552 - DNA, 20 bp, Artificial Sequence
  sgRNA
  mm21109_Abca7
aatcctaggacaaatgatgg

SEQ ID NO: 3553 - DNA, 20 bp, Artificial Sequence
  sgRNA
  mm21130_Abca3
gaggagccacgaaaaagtag

SEQ ID NO: 3554 - DNA, 20 bp, Artificial Sequence
  sgRNA
  mm21131_Abca3
agctggctaccacatgacgc

SEQ ID NO: 3555 - DNA, 20 bp, Artificial Sequence
  sgRNA
  mm21132_Abca3
acacacgaagaaattacatg

SEQ ID NO: 3556 - DNA, 20 bp, Artificial Sequence
  sgRNA
  mm21133_Abca3
aaggaggcggctttaatgag

SEQ ID NO: 3557 - DNA, 20 bp, Artificial Sequence
  sgRNA
  mm21150_Abcc5
ggagctgatgaacttaaatg

SEQ ID NO: 3558 - DNA, 20 bp, Artificial Sequence
  sgRNA
  mm21151_Abcc5
aaatccgagaggaggaacgt

SEQ ID NO: 3559 - DNA, 20 bp, Artificial Sequence
  sgRNA
  mm21152_Abcc5
cattaaagaaaagtccctag

SEQ ID NO: 3560 - DNA, 20 bp, Artificial Sequence
  sgRNA
  mm21153_Abcc5
aaagacaagagggctaccag

SEQ ID NO: 3561 - DNA, 20 bp, Artificial Sequence
  sgRNA
  mm21170_Nagpa
agccaccgttctgagcgatg

SEQ ID NO: 3562 - DNA, 20 bp, Artificial Sequence
  sgRNA
  mm21171_Nagpa
gcgatggaaccatagtcacc

SEQ ID NO: 3563 - DNA, 20 bp, Artificial Sequence
  sgRNA
  mm21172_Nagpa
agcaccgagaaagtgcgtag

SEQ ID NO: 3564 - DNA, 20 bp, Artificial Sequence
  sgRNA
  mm21173_Nagpa
gttcttaccagtgatctgaa

SEQ ID NO: 3565 - DNA, 20 bp, Artificial Sequence
  sgRNA
  mm21410_Slco1a4
ccaacgcaagacccaacagg

SEQ ID NO: 3566 - DNA, 20 bp, Artificial Sequence
  sgRNA
  mm21411_Slco1a4
gataagcccaactacagacg

SEQ ID NO: 3567 - DNA, 20 bp, Artificial Sequence
  sgRNA
  mm21412_Slco1a4
aaccaccaattaaatatccg

SEQ ID NO: 3568 - DNA, 20 bp, Artificial Sequence
  sgRNA
  mm21413_Slco1a4
aaaatcaaggaggaaaaccg

SEQ ID NO: 3569 - DNA, 20 bp, Artificial Sequence
  sgRNA
  mm21554_Cspg5
cctacccggtacggccccag

SEQ ID NO: 3570 - DNA, 20 bp, Artificial Sequence
  sgRNA
  mm21555_Cspg5
gtcgcgtgccaatgacacgc

SEQ ID NO: 3571 - DNA, 20 bp, Artificial Sequence
  sgRNA
  mm21556_Cspg5
gtccatgataagcctagtgt

SEQ ID NO: 3572 - DNA, 20 bp, Artificial Sequence
  sgRNA
  mm21557_Cspg5
gaaaatcaccctgataccga

SEQ ID NO: 3573 - DNA, 20 bp, Artificial Sequence
  sgRNA
  mm21562_Clic4
tgttctcgtcgatttcgtcg

SEQ ID NO: 3574 - DNA, 20 bp, Artificial Sequence
  sgRNA
  mm21563_Clic4
tcaagaccagaggctaatga

SEQ ID NO: 3575 - DNA, 20 bp, Artificial Sequence
  sgRNA
  mm21564_Clic4
cttcaacagcgaagtcaaga

SEQ ID NO: 3576 - DNA, 20 bp, Artificial Sequence
  sgRNA
  mm21565_Clic4
cttgacgaagagctcgatga

SEQ ID NO: 3577 - DNA, 20 bp, Artificial Sequence
  sgRNA
  mm21626_Mfi2
gccgagccgacatcactgag

SEQ ID NO: 3578 - DNA, 20 bp, Artificial Sequence
  sgRNA
  mm21627_Mfi2
gagagatactacgactacag

SEQ ID NO: 3579 - DNA, 20 bp, Artificial Sequence
  sgRNA
  mm21628_Mfi2
cttgccgcgaagctcgtcca

SEQ ID NO: 3580 - DNA, 20 bp, Artificial Sequence
  sgRNA
  mm21629_Mfi2
acaggcattaaccggactgt

SEQ ID NO: 3581 - DNA, 20 bp, Artificial Sequence
  sgRNA
  mm21650_Slc22a4
cagagcaaagtaacccactg

SEQ ID NO: 3582 - DNA, 20 bp, Artificial Sequence
  sgRNA
  mm21651_Slc22a4
gagaacgcctacgaagaaca

SEQ ID NO: 3583 - DNA, 20 bp, Artificial Sequence
  sgRNA
  mm21652_Slc22a4
cgcaaagatgaacagcatcg

SEQ ID NO: 3584 - DNA, 20 bp, Artificial Sequence
  sgRNA
  mm21653_Slc22a4
aaccaggcaacggtgctcgg

SEQ ID NO: 3585 - DNA, 20 bp, Artificial Sequence
  sgRNA
  mm21694_Angptl3
tgctctgccgtttataacag

SEQ ID NO: 3586 - DNA, 20 bp, Artificial Sequence
  sgRNA
  mm21695_Angptl3
tacactacaagttaaaaacg

SEQ ID NO: 3587 - DNA, 20 bp, Artificial Sequence
  sgRNA
  mm21696_Angptl3
catggacattaattcaacac

SEQ ID NO: 3588 - DNA, 20 bp, Artificial Sequence
  sgRNA
  mm21697_Angptl3
gaagacagcccttcaacaca

SEQ ID NO: 3589 - DNA, 20 bp, Artificial Sequence
  sgRNA
  mm21698_Slamf6
gaacgccattcattagctgg

SEQ ID NO: 3590 - DNA, 20 bp, Artificial Sequence
  sgRNA
  mm21699_Slamf6
gattacttaggttgataacg

SEQ ID NO: 3591 - DNA, 20 bp, Artificial Sequence
  sgRNA
  mm21700_Slamf6
tgggacctgccagatacacc

SEQ ID NO: 3592 - DNA, 20 bp, Artificial Sequence
  sgRNA
  mm21701_Slamf6
cactgcgcagataaccacaa

SEQ ID NO: 3593 - DNA, 20 bp, Artificial Sequence
  sgRNA
  mm21726_Tor2a
gcttgtccatctcatcgaag

SEQ ID NO: 3594 - DNA, 20 bp, Artificial Sequence
  sgRNA
  mm21727_Tor2a
ggggagaagtgatggacgtg

SEQ ID NO: 3595 - DNA, 20 bp, Artificial Sequence
  sgRNA
  mm21728_Tor2a
caggtcacattccagaccta

SEQ ID NO: 3596 - DNA, 20 bp, Artificial Sequence
  sgRNA
  mm21729_Tor2a
ccgtgcagggaaaggaccaa

SEQ ID NO: 3597 - DNA, 20 bp, Artificial Sequence
  sgRNA
  mm21730_Tor1b
ggaacggcccctcaacacgt

SEQ ID NO: 3598 - DNA, 20 bp, Artificial Sequence
  sgRNA
  mm21731_Tor1b
cagctccagaagtggatccg

SEQ ID NO: 3599 - DNA, 20 bp, Artificial Sequence
  sgRNA
  mm21732_Tor1b
gtagccggtgagcgccgaca

SEQ ID NO: 3600 - DNA, 20 bp, Artificial Sequence
  sgRNA
  mm21733_Tor1b
caatgccttgagaatcactt

SEQ ID NO: 3601 - DNA, 20 bp, Artificial Sequence
  sgRNA
  mm21734_Tor3a
ttgaaccctacctggaaccg

SEQ ID NO: 3602 - DNA, 20 bp, Artificial Sequence
  sgRNA
  mm21735_Tor3a
cttacccagaggcggcacgg

SEQ ID NO: 3603 - DNA, 20 bp, Artificial Sequence
  sgRNA
  mm21736_Tor3a
tacttagagatgccccaagt

SEQ ID NO: 3604 - DNA, 20 bp, Artificial Sequence
  sgRNA
  mm21737_Tor3a
atggacaacctgtatcggga

SEQ ID NO: 3605 - DNA, 20 bp, Artificial Sequence
  sgRNA
  mm21738_Slc46a2
gatgggcacctatcgaaccc

SEQ ID NO: 3606 - DNA, 20 bp, Artificial Sequence
  sgRNA
  mm21739_Slc46a2
catgaccccggaccaataag

SEQ ID NO: 3607 - DNA, 20 bp, Artificial Sequence
  sgRNA
  mm21740_Slc46a2
agcccaggactaaatcgatg

SEQ ID NO: 3608 - DNA, 20 bp, Artificial Sequence
  sgRNA
  mm21741_Slc46a2
ggagtagtcctgcgtcgtag

SEQ ID NO: 3609 - DNA, 20 bp, Artificial Sequence
  sgRNA
  mm21890_Ero1l
ctgaaggagaaggcccacga

SEQ ID NO: 3610 - DNA, 20 bp, Artificial Sequence
  sgRNA
  mm21891_Ero1l
cttgctcacattcttcaatg

SEQ ID NO: 3611 - DNA, 20 bp, Artificial Sequence
  sgRNA
  mm21892_Ero1l
cttaaccctgagcgctacac

SEQ ID NO: 3612 - DNA, 20 bp, Artificial Sequence
  sgRNA
  mm21893_Ero1l
aaaggcctttgaattgtctg

SEQ ID NO: 3613 - DNA, 20 bp, Artificial Sequence
  sgRNA
  mm21902_Mfap5
gacagactggctacccctag

SEQ ID NO: 3614 - DNA, 20 bp, Artificial Sequence
  sgRNA
  mm21903_Mfap5
gtcacctgtatcgtctgtag

SEQ ID NO: 3615 - DNA, 20 bp, Artificial Sequence
  sgRNA
  mm21904_Mfap5
acaccttccacagatgacct

SEQ ID NO: 3616 - DNA, 20 bp, Artificial Sequence
  sgRNA
  mm21905_Mfap5
caagactgtactctgtccat

SEQ ID NO: 3617 - DNA, 20 bp, Artificial Sequence
  sgRNA
  mm21910_Elane
ccggccaccaacaatctctg

SEQ ID NO: 3618 - DNA, 20 bp, Artificial Sequence
  sgRNA
  mm21911_Elane
ctcacaggccgttcacacag

SEQ ID NO: 3619 - DNA, 20 bp, Artificial Sequence
  sgRNA
  mm21912_Elane
gaacgacattgtgattatcc

SEQ ID NO: 3620 - DNA, 20 bp, Artificial Sequence
  sgRNA
  mm21913_Elane
atgacctccacgcctctgca

SEQ ID NO: 3621 - DNA, 20 bp, Artificial Sequence
  sgRNA
  mm21918_Postn
gtacttcgcgccgagtaacg

SEQ ID NO: 3622 - DNA, 20 bp, Artificial Sequence
  sgRNA
  mm21919_Postn
ctggctatatgagaatggaa

SEQ ID NO: 3623 - DNA, 20 bp, Artificial Sequence
  sgRNA
  mm21920_Postn
ggccttagcgacctctacaa

SEQ ID NO: 3624 - DNA, 20 bp, Artificial Sequence
  sgRNA
  mm21921_Postn
ttaaccaaggacctgaaaca

SEQ ID NO: 3625 - DNA, 20 bp, Artificial Sequence
  sgRNA
  mm21922_Hist1h1c
ggccgccaagaagcccgccg

SEQ ID NO: 3626 - DNA, 20 bp, Artificial Sequence
  sgRNA
  mm21923_Hist1h1c
gggcatcctggtgcaaacca

SEQ ID NO: 3627 - DNA, 20 bp, Artificial Sequence
  sgRNA
  mm21924_Hist1h1c
gcaggcgccttctccgcagg

SEQ ID NO: 3628 - DNA, 20 bp, Artificial Sequence
  sgRNA
  mm21925_Hist1h1c
ttctggcgaggccaaacccc

SEQ ID NO: 3629 - DNA, 20 bp, Artificial Sequence
  sgRNA
  mm21926_Hist1h1e
cttgacgggtgtcttctcgg

SEQ ID NO: 3630 - DNA, 20 bp, Artificial Sequence
  sgRNA
  mm21927_Hist1h1e
gtgatgagttcggacaccgg

SEQ ID NO: 3631 - DNA, 20 bp, Artificial Sequence
  sgRNA
  mm21928_Hist1h1e
agaagcccaagaaggctgcg

SEQ ID NO: 3632 - DNA, 20 bp, Artificial Sequence
  sgRNA
  mm21929_Hist1h1e
ggctaagcccaaagcaaaaa

SEQ ID NO: 3633 - DNA, 20 bp, Artificial Sequence
  sgRNA
  mm21938_Icosl
ggacaatagcctaatagaca

SEQ ID NO: 3634 - DNA, 20 bp, Artificial Sequence
  sgRNA
  mm21939_Icosl
agagactgaagtcggtgcaa

SEQ ID NO: 3635 - DNA, 20 bp, Artificial Sequence
  sgRNA
  mm21940_Icosl
tggctgtattcataaatacc

SEQ ID NO: 3636 - DNA, 20 bp, Artificial Sequence
  sgRNA
  mm21941_Icosl
tccctggactccatgaagca

SEQ ID NO: 3637 - DNA, 20 bp, Artificial Sequence
  sgRNA
  mm21978_Tfr2
gaggtcgctccagtacaacg

SEQ ID NO: 3638 - DNA, 20 bp, Artificial Sequence
  sgRNA
  mm21979_Tfr2
agtgcgtgtcagtccacacg

SEQ ID NO: 3639 - DNA, 20 bp, Artificial Sequence
  sgRNA
  mm21980_Tfr2
tggtgtacgcccactacggg

SEQ ID NO: 3640 - DNA, 20 bp, Artificial Sequence
  sgRNA
  mm21981_Tfr2
acccccagtgaagattagca

SEQ ID NO: 3641 - DNA, 20 bp, Artificial Sequence
  sgRNA
  mm21982_Crim1
tggccatcatcataagaacg

SEQ ID NO: 3642 - DNA, 20 bp, Artificial Sequence
  sgRNA
  mm21983_Crim1
gagagaaccgcacttcacag

SEQ ID NO: 3643 - DNA, 20 bp, Artificial Sequence
  sgRNA
  mm21984_Crim1
acagctacgaaacgcaagtg

SEQ ID NO: 3644 - DNA, 20 bp, Artificial Sequence
  sgRNA
  mm21985_Crim1
aggtggatcaatcgtgatgt

SEQ ID NO: 3645 - DNA, 20 bp, Artificial Sequence
  sgRNA
  mm22030_Dkk3
cggagtccaagtgaccgtcg

SEQ ID NO: 3646 - DNA, 20 bp, Artificial Sequence
  sgRNA
  mm22031_Dkk3
ctatcacaatgagaccagca

SEQ ID NO: 3647 - DNA, 20 bp, Artificial Sequence
  sgRNA
  mm22032_Dkk3
gctcaatgagatgtttcgag

SEQ ID NO: 3648 - DNA, 20 bp, Artificial Sequence
  sgRNA
  mm22033_Dkk3
tagataaccaacaaccagag

SEQ ID NO: 3649 - DNA, 20 bp, Artificial Sequence
  sgRNA
  mm22042_Ppap2c
catgcaatacatgccaaagg

SEQ ID NO: 3650 - DNA, 20 bp, Artificial Sequence
  sgRNA
  mm22043_Ppap2c
agttggatcgcgaataaaga

SEQ ID NO: 3651 - DNA, 20 bp, Artificial Sequence
  sgRNA
  mm22044_Ppap2c
cagccctgctaatgtcacgg

SEQ ID NO: 3652 - DNA, 20 bp, Artificial Sequence
  sgRNA
  mm22045_Ppap2c
catagccagaacagttgacc

SEQ ID NO: 3653 - DNA, 20 bp, Artificial Sequence
  sgRNA
  mm22046_Hs6st1
ggcgcacgttctgcactagg

SEQ ID NO: 3654 - DNA, 20 bp, Artificial Sequence
  sgRNA
  mm22047_Hs6st1
atggcgacatgtacagcgtg

SEQ ID NO: 3655 - DNA, 20 bp, Artificial Sequence
  sgRNA
  mm22048_Hs6st1
ctcatcctttaccagtacgc

SEQ ID NO: 3656 - DNA, 20 bp, Artificial Sequence
  sgRNA
  mm22049_Hs6st1
cctataacctggctaacaac

SEQ ID NO: 3657 - DNA, 20 bp, Artificial Sequence
  sgRNA
  mm22050_Hs6st2
gcggtacggatccggcaccg

SEQ ID NO: 3658 - DNA, 20 bp, Artificial Sequence
  sgRNA
  mm22051_Hs6st2
gggtatagtaaggatagatg

SEQ ID NO: 3659 - DNA, 20 bp, Artificial Sequence
  sgRNA
  mm22052_Hs6st2
ccgccggcattccagagtag

SEQ ID NO: 3660 - DNA, 20 bp, Artificial Sequence
  sgRNA
  mm22053_Hs6st2
gcagccatgtgagtgccgcg

SEQ ID NO: 3661 - DNA, 20 bp, Artificial Sequence
  sgRNA
  mm22154_Il17rb
ggaactcgtcaagacaagtg

SEQ ID NO: 3662 - DNA, 20 bp, Artificial Sequence
  sgRNA
  mm22155_Il17rb
ttcaacgggacacgacattg

SEQ ID NO: 3663 - DNA, 20 bp, Artificial Sequence
  sgRNA
  mm22156_Il17rb
gcacaactgtcccttcgcgt

SEQ ID NO: 3664 - DNA, 20 bp, Artificial Sequence
  sgRNA
  mm22157_Il17rb
ctccacagggaagcctacat

SEQ ID NO: 3665 - DNA, 20 bp, Artificial Sequence
  sgRNA
  mm22222_Il27ra
cagtcactgtaattcgatag

SEQ ID NO: 3666 - DNA, 20 bp, Artificial Sequence
  sgRNA
  mm22223_Il27ra
tgctcactcccacgtcacag

SEQ ID NO: 3667 - DNA, 20 bp, Artificial Sequence
  sgRNA
  mm22224_Il27ra
tccccgggaacagttcacca

SEQ ID NO: 3668 - DNA, 20 bp, Artificial Sequence
  sgRNA
  mm22225_Il27ra
ccagacgccattcttaggtg

SEQ ID NO: 3669 - DNA, 20 bp, Artificial Sequence
  sgRNA
  mm22298_Ramp1
agcagccagaggccgcaccg

SEQ ID NO: 3670 - DNA, 20 bp, Artificial Sequence
  sgRNA
  mm22299_Ramp1
ggatgagagtcccatagtca

SEQ ID NO: 3671 - DNA, 20 bp, Artificial Sequence
  sgRNA
  mm22300_Ramp1
gaagacgctatggtgtgact

SEQ ID NO: 3672 - DNA, 20 bp, Artificial Sequence
  sgRNA
  mm22301_Ramp1
tttctggcccaatccggaag

SEQ ID NO: 3673 - DNA, 20 bp, Artificial Sequence
  sgRNA
  mm22302_Hnrnpu
aacggcagtctcgacctagg

SEQ ID NO: 3674 - DNA, 20 bp, Artificial Sequence
  sgRNA
  mm22303_Hnrnpu
agttatggcagagaacatgt

SEQ ID NO: 3675 - DNA, 20 bp, Artificial Sequence
  sgRNA
  mm22304_Hnrnpu
aggagctggaaaaactacct

SEQ ID NO: 3676 - DNA, 20 bp, Artificial Sequence
  sgRNA
  mm22305_Hnrnpu
cgtcaccgcgaagagcgagg

SEQ ID NO: 3677 - DNA, 20 bp, Artificial Sequence
  sgRNA
  mm22370_Umodl1
tgaactgtctgtaacaacga

SEQ ID NO: 3678 - DNA, 20 bp, Artificial Sequence
  sgRNA
  mm22371_Umodl1
gtgccacacaacatagcccg

SEQ ID NO: 3679 - DNA, 20 bp, Artificial Sequence
  sgRNA
  mm22372_Umodl1
ggtcccgggagtttgcatcg

SEQ ID NO: 3680 - DNA, 20 bp, Artificial Sequence
  sgRNA
  mm22373_Umodl1
cccgaggagagaccaatgtg

SEQ ID NO: 3681 - DNA, 20 bp, Artificial Sequence
  sgRNA
  mm22414_Pvr
aggtcagggtcaagttagtg

SEQ ID NO: 3682 - DNA, 20 bp, Artificial Sequence
  sgRNA
  mm22415_Pvr
aacttaagtgtagaagacga

SEQ ID NO: 3683 - DNA, 20 bp, Artificial Sequence
  sgRNA
  mm22416_Pvr
gaagacagccacaagagcgt

SEQ ID NO: 3684 - DNA, 20 bp, Artificial Sequence
  sgRNA
  mm22417_Pvr
gctaaatgcatctctgccaa

SEQ ID NO: 3685 - DNA, 20 bp, Artificial Sequence
  sgRNA
  mm22418_Hgsnat
cctgcaggttaactccacct

SEQ ID NO: 3686 - DNA, 20 bp, Artificial Sequence
  sgRNA
  mm22419_Hgsnat
atgacttctatcctgcaacg

SEQ ID NO: 3687 - DNA, 20 bp, Artificial Sequence
  sgRNA
  mm22420_Hgsnat
gatgtgtggacacatttagg

SEQ ID NO: 3688 - DNA, 20 bp, Artificial Sequence
  sgRNA
  mm22421_Hgsnat
gttgggagtgacatacttcg

SEQ ID NO: 3689 - DNA, 20 bp, Artificial Sequence
  sgRNA
  mm22498_Rcn3
gcagcggcacatccgtgact

SEQ ID NO: 3690 - DNA, 20 bp, Artificial Sequence
  sgRNA
  mm22499_Rcn3
atttgacaaactcagcccag

SEQ ID NO: 3691 - DNA, 20 bp, Artificial Sequence
  sgRNA
  mm22500_Rcn3
accgggctcataatggccat

SEQ ID NO: 3692 - DNA, 20 bp, Artificial Sequence
  sgRNA
  mm22501_Rcn3
ttccgggtagccgaccaaga

SEQ ID NO: 3693 - DNA, 20 bp, Artificial Sequence
  sgRNA
  mm22542_Slc46a1
agagctaacatctgccacag

SEQ ID NO: 3694 - DNA, 20 bp, Artificial Sequence
  sgRNA
  mm22543_Slc46a1
gggcaatggatcgatgatgg

SEQ ID NO: 3695 - DNA, 20 bp, Artificial Sequence
  sgRNA
  mm22544_Slc46a1
tggaccagaagagtcccacc

SEQ ID NO: 3696 - DNA, 20 bp, Artificial Sequence
  sgRNA
  mm22545_Slc46a1
gaactgtgggaaccaaagcg

SEQ ID NO: 3697 - DNA, 20 bp, Artificial Sequence
  sgRNA
  mm22578_Acaa2
gcccacgatgacactatcga

SEQ ID NO: 3698 - DNA, 20 bp, Artificial Sequence
  sgRNA
  mm22579_Acaa2
gctgaggtcgtcttgtgtgg

SEQ ID NO: 3699 - DNA, 20 bp, Artificial Sequence
  sgRNA
  mm22580_Acaa2
cgaggctggctacttcaatg

SEQ ID NO: 3700 - DNA, 20 bp, Artificial Sequence
  sgRNA
  mm22581_Acaa2
cgtccgtgttcaagaaagac

SEQ ID NO: 3701 - DNA, 20 bp, Artificial Sequence
  sgRNA
  mm22606_Tspan14
ggggtcgattccatgcaacc

SEQ ID NO: 3702 - DNA, 20 bp, Artificial Sequence
  sgRNA
  mm22607_Tspan14
caggtcgatgtcatcccgat

SEQ ID NO: 3703 - DNA, 20 bp, Artificial Sequence
  sgRNA
  mm22608_Tspan14
taatttcagaatcagtgctg

SEQ ID NO: 3704 - DNA, 20 bp, Artificial Sequence
  sgRNA
  mm22609_Tspan14
ttggaataaaaaggccaaca

SEQ ID NO: 3705 - DNA, 20 bp, Artificial Sequence
  sgRNA
  mm22618_Adgre4
atgagacttgatacctcatg

SEQ ID NO: 3706 - DNA, 20 bp, Artificial Sequence
  sgRNA
  mm22619_Adgre4
tagtggagccattcgctcag

SEQ ID NO: 3707 - DNA, 20 bp, Artificial Sequence
  sgRNA
  mm22620_Adgre4
tagacttaccataacaatca

SEQ ID NO: 3708 - DNA, 20 bp, Artificial Sequence
  sgRNA
  mm22621_Adgre4
agctggcaacaacacaatga

SEQ ID NO: 3709 - DNA, 20 bp, Artificial Sequence
  sgRNA
  mm22770_Lair1
caagtcttatgatctcccaa

SEQ ID NO: 3710 - DNA, 20 bp, Artificial Sequence
  sgRNA
  mm22771_Lair1
taaacacgacttgtataaca

SEQ ID NO: 3711 - DNA, 20 bp, Artificial Sequence
  sgRNA
  mm22772_Lair1
gtccgaacgtagtaagacgc

SEQ ID NO: 3712 - DNA, 20 bp, Artificial Sequence
  sgRNA
  mm22773_Lair1
acagctataatgtccagtaa

SEQ ID NO: 3713 - DNA, 20 bp, Artificial Sequence
  sgRNA
  mm22826_Atp2a3
cacggagccaggatccaccg

SEQ ID NO: 3714 - DNA, 20 bp, Artificial Sequence
  sgRNA
  mm22827_Atp2a3
ccagcgcagaatcattgcag

SEQ ID NO: 3715 - DNA, 20 bp, Artificial Sequence
  sgRNA
  mm22828_Atp2a3
accttggggtcagcacgagt

SEQ ID NO: 3716 - DNA, 20 bp, Artificial Sequence
  sgRNA
  mm22829_Atp2a3
ctgaccgcaagggtgtacag

SEQ ID NO: 3717 - DNA, 20 bp, Artificial Sequence
  sgRNA
  mm22850_Folh1
gcaaatgcaccataccaaag

SEQ ID NO: 3718 - DNA, 20 bp, Artificial Sequence
  sgRNA
  mm22851_Folh1
tctggataggacttcaccgc

SEQ ID NO: 3719 - DNA, 20 bp, Artificial Sequence
  sgRNA
  mm22852_Folh1
attaaaagtgccttacaacg

SEQ ID NO: 3720 - DNA, 20 bp, Artificial Sequence
  sgRNA
  mm22853_Folh1
aggacagcaagacatcgtaa

SEQ ID NO: 3721 - DNA, 20 bp, Artificial Sequence
  sgRNA
  mm22854_Cntnap1
gctccactctcacgtaaggt

SEQ ID NO: 3722 - DNA, 20 bp, Artificial Sequence
  sgRNA
  mm22855_Cntnap1
ttcctacagatattcatcgg

SEQ ID NO: 3723 - DNA, 20 bp, Artificial Sequence
  sgRNA
  mm22856_Cntnap1
agaagtatgaagtccctgtg

SEQ ID NO: 3724 - DNA, 20 bp, Artificial Sequence
  sgRNA
  mm22857_Cntnap1
gaggaacagcatttctactg

SEQ ID NO: 3725 - DNA, 20 bp, Artificial Sequence
  sgRNA
  mm22866_Nptx2
ctctatcagcacaatctcgt

SEQ ID NO: 3726 - DNA, 20 bp, Artificial Sequence
  sgRNA
  mm22867_Nptx2
gctgccgagcgacttccgag

SEQ ID NO: 3727 - DNA, 20 bp, Artificial Sequence
  sgRNA
  mm22868_Nptx2
gtagtttgtacggagaggaa

SEQ ID NO: 3728 - DNA, 20 bp, Artificial Sequence
  sgRNA
  mm22869_Nptx2
gcaacgcggtgcacacgaag

SEQ ID NO: 3729 - DNA, 20 bp, Artificial Sequence
  sgRNA
  mm22962_Corin
ggatatgttgatagcaactg

SEQ ID NO: 3730 - DNA, 20 bp, Artificial Sequence
  sgRNA
  mm22963_Corin
cctggaacttggacccggag

SEQ ID NO: 3731 - DNA, 20 bp, Artificial Sequence
  sgRNA
  mm22964_Corin
cactgctgttagtctcagtg

SEQ ID NO: 3732 - DNA, 20 bp, Artificial Sequence
  sgRNA
  mm22965_Corin
acagtttattatgagaacac

SEQ ID NO: 3733 - DNA, 20 bp, Artificial Sequence
  sgRNA
  mm22986_Cd164
caagtcagtgcggttcacct

SEQ ID NO: 3734 - DNA, 20 bp, Artificial Sequence
  sgRNA
  mm22987_Cd164
ttgcgtcgtcgggaccactt

SEQ ID NO: 3735 - DNA, 20 bp, Artificial Sequence
  sgRNA
  mm22988_Cd164
ggtcggcacctcggtcacgt

SEQ ID NO: 3736 - DNA, 20 bp, Artificial Sequence
  sgRNA
  mm22989_Cd164
ttggcaatgtaaccaaaagc

SEQ ID NO: 3737 - DNA, 20 bp, Artificial Sequence
  sgRNA
  mm23038_Reck
caatagtaaaggatgttccg

SEQ ID NO: 3738 - DNA, 20 bp, Artificial Sequence
  sgRNA
  mm23039_Reck
agtgcaatttggccccgtcg

SEQ ID NO: 3739 - DNA, 20 bp, Artificial Sequence
  sgRNA
  mm23040_Reck
ctgacttcatcgtccgccag

SEQ ID NO: 3740 - DNA, 20 bp, Artificial Sequence
  sgRNA
  mm23041_Reck
ttactgaggtacgtgtccag

SEQ ID NO: 3741 - DNA, 20 bp, Artificial Sequence
  sgRNA
  mm23054_Vamp5
catgctcaacaatttcgaca

SEQ ID NO: 3742 - DNA, 20 bp, Artificial Sequence
  sgRNA
  mm23055_Vamp5
ggagcgtcacggcaagctgg

SEQ ID NO: 3743 - DNA, 20 bp, Artificial Sequence
  sgRNA
  mm23056_Vamp5
tttagcccagcagaagcgct

SEQ ID NO: 3744 - DNA, 20 bp, Artificial Sequence
  sgRNA
  mm23057_Vamp5
atcggtcacacaccatgtcc

SEQ ID NO: 3745 - DNA, 20 bp, Artificial Sequence
  sgRNA
  mm23062_Gria3
tgtgacgaaagatgtatgca

SEQ ID NO: 3746 - DNA, 20 bp, Artificial Sequence
  sgRNA
  mm23063_Gria3
gtacaatgtcagtaaaaccc

SEQ ID NO: 3747 - DNA, 20 bp, Artificial Sequence
  sgRNA
  mm23064_Gria3
tacctctatgacacagaacg

SEQ ID NO: 3748 - DNA, 20 bp, Artificial Sequence
  sgRNA
  mm23065_Gria3
aggaatccaagtggtctacg

SEQ ID NO: 3749 - DNA, 20 bp, Artificial Sequence
  sgRNA
  mm23070_B3gnt2
tggggccgagaaaccaacgt

SEQ ID NO: 3750 - DNA, 20 bp, Artificial Sequence
  sgRNA
  mm23071_B3gnt2
acagggtggccaatcagaca

SEQ ID NO: 3751 - DNA, 20 bp, Artificial Sequence
  sgRNA
  mm23072_B3gnt2
caaacttaagcatgtccgaa

SEQ ID NO: 3752 - DNA, 20 bp, Artificial Sequence
  sgRNA
  mm23073_B3gnt2
ctttatcgccaatagtaaga

SEQ ID NO: 3753 - DNA, 20 bp, Artificial Sequence
  sgRNA
  mm23122_Rab11a
gagtgatttacgtcatctca

SEQ ID NO: 3754 - DNA, 20 bp, Artificial Sequence
  sgRNA
  mm23123_Rab11a
agatactatcgtggagcagt

SEQ ID NO: 3755 - DNA, 20 bp, Artificial Sequence
  sgRNA
  mm23124_Rab11a
tgttgcaaactctactccaa

SEQ ID NO: 3756 - DNA, 20 bp, Artificial Sequence
  sgRNA
  mm23125_Rab11a
ccacggcctcacctttaaag

SEQ ID NO: 3757 - DNA, 20 bp, Artificial Sequence
  sgRNA
  mm23126_Cntn6
tatcactataggttggatgg

SEQ ID NO: 3758 - DNA, 20 bp, Artificial Sequence
  sgRNA
  mm23127_Cntn6
tggtggggtcatgagacact

SEQ ID NO: 3759 - DNA, 20 bp, Artificial Sequence
  sgRNA
  mm23128_Cntn6
gtgcgcagcactaaaggcgt

SEQ ID NO: 3760 - DNA, 20 bp, Artificial Sequence
  sgRNA
  mm23129_Cntn6
aatccccaagttccaacaag

SEQ ID NO: 3761 - DNA, 20 bp, Artificial Sequence
  sgRNA
  mm23142_Slc5a3
cccctgaccggatgtaaatg

SEQ ID NO: 3762 - DNA, 20 bp, Artificial Sequence
  sgRNA
  mm23143_Slc5a3
ctgaccaagtcatcgtacag

SEQ ID NO: 3763 - DNA, 20 bp, Artificial Sequence
  sgRNA
  mm23144_Slc5a3
gaacactgcatgcaagtgtg

SEQ ID NO: 3764 - DNA, 20 bp, Artificial Sequence
  sgRNA
  mm23145_Slc5a3
ctgtgtagatcactgcaaca

SEQ ID NO: 3765 - DNA, 20 bp, Artificial Sequence
  sgRNA
  mm23146_Celsr2
gtacaccgttcggctcaacg

SEQ ID NO: 3766 - DNA, 20 bp, Artificial Sequence
  sgRNA
  mm23147_Celsr2
ctgacgtacagcttcgagcg

SEQ ID NO: 3767 - DNA, 20 bp, Artificial Sequence
  sgRNA
  mm23148_Celsr2
cgggcattgtgcgcacactg

SEQ ID NO: 3768 - DNA, 20 bp, Artificial Sequence
  sgRNA
  mm23149_Celsr2
cggcacaaacggagacacgg

SEQ ID NO: 3769 - DNA, 20 bp, Artificial Sequence
  sgRNA
  mm23218_Lpar2
tttctataataacagcggca

SEQ ID NO: 3770 - DNA, 20 bp, Artificial Sequence
  sgRNA
  mm23219_Lpar2
gtgggccagtatggaacatg

SEQ ID NO: 3771 - DNA, 20 bp, Artificial Sequence
  sgRNA
  mm23220_Lpar2
agtgtgaccacacggccccg

SEQ ID NO: 3772 - DNA, 20 bp, Artificial Sequence
  sgRNA
  mm23221_Lpar2
gtgtggccactgacgccgtg

SEQ ID NO: 3773 - DNA, 20 bp, Artificial Sequence
  sgRNA
  mm23330_Icos
tggtcttggtgagttcgcag

SEQ ID NO: 3774 - DNA, 20 bp, Artificial Sequence
  sgRNA
  mm23331_Icos
tatgcaaatatcctccacta

SEQ ID NO: 3775 - DNA, 20 bp, Artificial Sequence
  sgRNA
  mm23332_Icos
gcagaagtaatagcttccct

SEQ ID NO: 3776 - DNA, 20 bp, Artificial Sequence
  sgRNA
  mm23333_Icos
aaatgaaaacatcctatgat

SEQ ID NO: 3777 - DNA, 20 bp, Artificial Sequence
  sgRNA
  mm23414_Cd320
tggtctcagaacaggcctag

SEQ ID NO: 3778 - DNA, 20 bp, Artificial Sequence
  sgRNA
  mm23415_Cd320
gcaaccactgatgttgtcac

SEQ ID NO: 3779 - DNA, 20 bp, Artificial Sequence
  sgRNA
  mm23416_Cd320
ccatcacagcgccacgtgtg

SEQ ID NO: 3780 - DNA, 20 bp, Artificial Sequence
  sgRNA
  mm23417_Cd320
accttccagtgtcttaccag

SEQ ID NO: 3781 - DNA, 20 bp, Artificial Sequence
  sgRNA
  mm23430_Slc23a2
ctggcatccccgaatccaag

SEQ ID NO: 3782 - DNA, 20 bp, Artificial Sequence
  sgRNA
  mm23431_Slc23a2
gtgtttcagtggcacgatcg

SEQ ID NO: 3783 - DNA, 20 bp, Artificial Sequence
  sgRNA
  mm23432_Slc23a2
acaggcgtagtagtcaccga

SEQ ID NO: 3784 - DNA, 20 bp, Artificial Sequence
  sgRNA
  mm23433_Slc23a2
gcgtgcatagtagccatagt

SEQ ID NO: 3785 - DNA, 20 bp, Artificial Sequence
  sgRNA
  mm23474_Gp9
ggggcaagcctgagtatctg

SEQ ID NO: 3786 - DNA, 20 bp, Artificial Sequence
  sgRNA
  mm23475_Gp9
gcattagggcctcgggcatg

SEQ ID NO: 3787 - DNA, 20 bp, Artificial Sequence
  sgRNA
  mm23476_Gp9
tggatgtgacacacaacccc

SEQ ID NO: 3788 - DNA, 20 bp, Artificial Sequence
  sgRNA
  mm23477_Gp9
agcctgcgttcagtgccacc

SEQ ID NO: 3789 - DNA, 20 bp, Artificial Sequence
  sgRNA
  mm23482_Chst2
gtgtcgcaagtaccgcacgc

SEQ ID NO: 3790 - DNA, 20 bp, Artificial Sequence
  sgRNA
  mm23483_Chst2
aaataccttcatcccgagcg

SEQ ID NO: 3791 - DNA, 20 bp, Artificial Sequence
  sgRNA
  mm23484_Chst2
ggaaaaccgaaagatcgcag

SEQ ID NO: 3792 - DNA, 20 bp, Artificial Sequence
  sgRNA
  mm23485_Chst2
tccatgcgagagtgagcgcg

SEQ ID NO: 3793 - DNA, 20 bp, Artificial Sequence
  sgRNA
  mm23502_Cacng6
acttcaaattcttcaccacg

SEQ ID NO: 3794 - DNA, 20 bp, Artificial Sequence
  sgRNA
  mm23503_Cacng6
ggcttgactccggagcgaga

SEQ ID NO: 3795 - DNA, 20 bp, Artificial Sequence
  sgRNA
  mm23504_Cacng6
aggtgtgcatcaagcgactg

SEQ ID NO: 3796 - DNA, 20 bp, Artificial Sequence
  sgRNA
  mm23505_Cacng6
gctgttcttgggcacgacgc

SEQ ID NO: 3797 - DNA, 20 bp, Artificial Sequence
  sgRNA
  mm23522_Mtmr7
gctgccaataattatcaggg

SEQ ID NO: 3798 - DNA, 20 bp, Artificial Sequence
  sgRNA
  mm23523_Mtmr7
tcagagagatgtacacgtcg

SEQ ID NO: 3799 - DNA, 20 bp, Artificial Sequence
  sgRNA
  mm23524_Mtmr7
gccacggcacacatcatcgt

SEQ ID NO: 3800 - DNA, 20 bp, Artificial Sequence
  sgRNA
  mm23525_Mtmr7
aagtgacttcatttatgtcg

SEQ ID NO: 3801 - DNA, 20 bp, Artificial Sequence
  sgRNA
  mm23546_Gabbr1
acggcgtgcagtatacatcg

SEQ ID NO: 3802 - DNA, 20 bp, Artificial Sequence
  sgRNA
  mm23547_Gabbr1
aagagaaacttaccgaacgt

SEQ ID NO: 3803 - DNA, 20 bp, Artificial Sequence
  sgRNA
  mm23548_Gabbr1
ggatgtgtccgaaagaacgt

SEQ ID NO: 3804 - DNA, 20 bp, Artificial Sequence
  sgRNA
  mm23549_Gabbr1
gttcagcatgacaatctccg

SEQ ID NO: 3805 - DNA, 20 bp, Artificial Sequence
  sgRNA
  mm23582_Ramp2
gaatcaatctcatcccactg

SEQ ID NO: 3806 - DNA, 20 bp, Artificial Sequence
  sgRNA
  mm23583_Ramp2
ttggtgtgacccgcgcccag

SEQ ID NO: 3807 - DNA, 20 bp, Artificial Sequence
  sgRNA
  mm23584_Ramp2
accaagccgagatccacccg

SEQ ID NO: 3808 - DNA, 20 bp, Artificial Sequence
  sgRNA
  mm23585_Ramp2
ctccggaagagattggttca

SEQ ID NO: 3809 - DNA, 20 bp, Artificial Sequence
  sgRNA
  mm23586_Atp6ap1
gaggatttcacagcatacgg

SEQ ID NO: 3810 - DNA, 20 bp, Artificial Sequence
  sgRNA
  mm23587_Atp6ap1
gatatgaccctcatgtgtgt

SEQ ID NO: 3811 - DNA, 20 bp, Artificial Sequence
  sgRNA
  mm23588_Atp6ap1
tagctagatccacatgcaag

SEQ ID NO: 3812 - DNA, 20 bp, Artificial Sequence
  sgRNA
  mm23589_Atp6ap1
gtgtcattgtaactcacagg

SEQ ID NO: 3813 - DNA, 20 bp, Artificial Sequence
  sgRNA
  mm23622_Asah2
tcgggcctcaatattacaca

SEQ ID NO: 3814 - DNA, 20 bp, Artificial Sequence
  sgRNA
  mm23623_Asah2
gtatgatttcccaacgactg

SEQ ID NO: 3815 - DNA, 20 bp, Artificial Sequence
  sgRNA
  mm23624_Asah2
tagtgacaatatgggctatg

SEQ ID NO: 3816 - DNA, 20 bp, Artificial Sequence
  sgRNA
  mm23625_Asah2
gctcacacaaatcttaaacc

SEQ ID NO: 3817 - DNA, 20 bp, Artificial Sequence
  sgRNA
  mm23682_Nup210
gaagtccaacacacggacgt

SEQ ID NO: 3818 - DNA, 20 bp, Artificial Sequence
  sgRNA
  mm23683_Nup210
gtgctgctggtaattccggg

SEQ ID NO: 3819 - DNA, 20 bp, Artificial Sequence
  sgRNA
  mm23684_Nup210
ctcaagatagagctcacggg

SEQ ID NO: 3820 - DNA, 20 bp, Artificial Sequence
  sgRNA
  mm23685_Nup210
tgctaagaatgttcgccctg

SEQ ID NO: 3821 - DNA, 20 bp, Artificial Sequence
  sgRNA
  mm23686_Calcrl
tgtaacaatcatccacctca

SEQ ID NO: 3822 - DNA, 20 bp, Artificial Sequence
  sgRNA
  mm23687_Calcrl
atccggatagtaatagaaca

SEQ ID NO: 3823 - DNA, 20 bp, Artificial Sequence
  sgRNA
  mm23688_Calcrl
ttacctgcacacactcatcg

SEQ ID NO: 3824 - DNA, 20 bp, Artificial Sequence
  sgRNA
  mm23689_Calcrl
cactagaaacaagatcatga

SEQ ID NO: 3825 - DNA, 20 bp, Artificial Sequence
  sgRNA
  mm23734_Extl3
gcccaagcctcgcgtcacag

SEQ ID NO: 3826 - DNA, 20 bp, Artificial Sequence
  sgRNA
  mm23735_Extl3
tcagacatagcatggacaag

SEQ ID NO: 3827 - DNA, 20 bp, Artificial Sequence
  sgRNA
  mm23736_Extl3
ccacacagtgcccactcagt

SEQ ID NO: 3828 - DNA, 20 bp, Artificial Sequence
  sgRNA
  mm23737_Extl3
attgcggaggtatttaggtg

SEQ ID NO: 3829 - DNA, 20 bp, Artificial Sequence
  sgRNA
  mm23762_Pdgfc
agagccagatcgatggcagg

SEQ ID NO: 3830 - DNA, 20 bp, Artificial Sequence
  sgRNA
  mm23763_Pdgfc
ctggcatgataatactgtag

SEQ ID NO: 3831 - DNA, 20 bp, Artificial Sequence
  sgRNA
  mm23764_Pdgfc
atacccaagaaatatggtgc

SEQ ID NO: 3832 - DNA, 20 bp, Artificial Sequence
  sgRNA
  mm23765_Pdgfc
ccctggccggccaaagaacg

SEQ ID NO: 3833 - DNA, 20 bp, Artificial Sequence
  sgRNA
  mm23838_Plxnc1
aatatcaccatgatcctgcg

SEQ ID NO: 3834 - DNA, 20 bp, Artificial Sequence
  sgRNA
  mm23839_Plxnc1
cagatttacagggtaccgag

SEQ ID NO: 3835 - DNA, 20 bp, Artificial Sequence
  sgRNA
  mm23840_Plxnc1
tatccctacaactacacgag

SEQ ID NO: 3836 - DNA, 20 bp, Artificial Sequence
  sgRNA
  mm23841_Plxnc1
ggtgtggtgtaccgcgcgag

SEQ ID NO: 3837 - DNA, 20 bp, Artificial Sequence
  sgRNA
  mm23862_Cadm1
atatcgatcatcaagttacg

SEQ ID NO: 3838 - DNA, 20 bp, Artificial Sequence
  sgRNA
  mm23863_Cadm1
agccagcgacgaccatcagg

SEQ ID NO: 3839 - DNA, 20 bp, Artificial Sequence
  sgRNA
  mm23864_Cadm1
gccgcggcactgatccccac

SEQ ID NO: 3840 - DNA, 20 bp, Artificial Sequence
  sgRNA
  mm23865_Cadm1
actgacgaatgtctcaatct

SEQ ID NO: 3841 - DNA, 20 bp, Artificial Sequence
  sgRNA
  mm23938_Slc1a4
gtctgcaaccgattacacag

SEQ ID NO: 3842 - DNA, 20 bp, Artificial Sequence
  sgRNA
  mm23939_Slc1a4
tagagccactcctaacacca

SEQ ID NO: 3843 - DNA, 20 bp, Artificial Sequence
  sgRNA
  mm23940_Slc1a4
gatgccacccagacgcccga

SEQ ID NO: 3844 - DNA, 20 bp, Artificial Sequence
  sgRNA
  mm23941_Slc1a4
acccaccaacactcccgaca

SEQ ID NO: 3845 - DNA, 20 bp, Artificial Sequence
  sgRNA
  mm23990_Panx1
ccacttcaagtacccaatcg

SEQ ID NO: 3846 - DNA, 20 bp, Artificial Sequence
  sgRNA
  mm23991_Panx1
actcgtccgagagtgaagag

SEQ ID NO: 3847 - DNA, 20 bp, Artificial Sequence
  sgRNA
  mm23992_Panx1
gcttgcactggaagcgatcg

SEQ ID NO: 3848 - DNA, 20 bp, Artificial Sequence
  sgRNA
  mm23993_Panx1
gatggtcacatgtattgccg

SEQ ID NO: 3849 - DNA, 20 bp, Artificial Sequence
  sgRNA
  mm24030_Slc2a8
cctgcgcctcggagacaatg

SEQ ID NO: 3850 - DNA, 20 bp, Artificial Sequence
  sgRNA
  mm24031_Slc2a8
acagcaaagccagtcacgaa

SEQ ID NO: 3851 - DNA, 20 bp, Artificial Sequence
  sgRNA
  mm24032_Slc2a8
gattatgcccacagtgaccg

SEQ ID NO: 3852 - DNA, 20 bp, Artificial Sequence
  sgRNA
  mm24033_Slc2a8
ttgagtgaggagaaaacgtg

SEQ ID NO: 3853 - DNA, 20 bp, Artificial Sequence
  sgRNA
  mm24038_Tmem131
acagatcacaaccgactacg

SEQ ID NO: 3854 - DNA, 20 bp, Artificial Sequence
  sgRNA
  mm24039_Tmem131
gtatgggcctgcaattaccc

SEQ ID NO: 3855 - DNA, 20 bp, Artificial Sequence
  sgRNA
  mm24040_Tmem131
ctggatgtgaaacagcgtgg

SEQ ID NO: 3856 - DNA, 20 bp, Artificial Sequence
  sgRNA
  mm24041_Tmem131
gtcgtagagatgtactcgag

SEQ ID NO: 3857 - DNA, 20 bp, Artificial Sequence
  sgRNA
  mm24066_Rala
tcgacatcttagatacagcg

SEQ ID NO: 3858 - DNA, 20 bp, Artificial Sequence
  sgRNA
  mm24067_Rala
tctgcagttcatgtacgacg

SEQ ID NO: 3859 - DNA, 20 bp, Artificial Sequence
  sgRNA
  mm24068_Rala
cttacacaaagtcatcatgg

SEQ ID NO: 3860 - DNA, 20 bp, Artificial Sequence
  sgRNA
  mm24069_Rala
caactacttccgaagtgggg

SEQ ID NO: 3861 - DNA, 20 bp, Artificial Sequence
  sgRNA
  mm24078_Msln
tcctaggcacctcaccgacg

SEQ ID NO: 3862 - DNA, 20 bp, Artificial Sequence
  sgRNA
  mm24079_Msln
tggatagccccccatcgaag

SEQ ID NO: 3863 - DNA, 20 bp, Artificial Sequence
  sgRNA
  mm24080_Msln
catacacccaaggttccgac

SEQ ID NO: 3864 - DNA, 20 bp, Artificial Sequence
  sgRNA
  mm24081_Msln
ccaatgtggatgtactccca

SEQ ID NO: 3865 - DNA, 20 bp, Artificial Sequence
  sgRNA
  mm24122_Astn2
ggagccctcggagatcgttg

SEQ ID NO: 3866 - DNA, 20 bp, Artificial Sequence
  sgRNA
  mm24123_Astn2
gatgtcgctttcccgcagag

SEQ ID NO: 3867 - DNA, 20 bp, Artificial Sequence
  sgRNA
  mm24124_Astn2
gaggtggtatcatagggcaa

SEQ ID NO: 3868 - DNA, 20 bp, Artificial Sequence
  sgRNA
  mm24125_Astn2
tcaggtatgatgaggccatg

SEQ ID NO: 3869 - DNA, 20 bp, Artificial Sequence
  sgRNA
  mm24142_Ramp3
gcttcatcactggaatccac

SEQ ID NO: 3870 - DNA, 20 bp, Artificial Sequence
  sgRNA
  mm24143_Ramp3
gagatggagaccaacatcat

SEQ ID NO: 3871 - DNA, 20 bp, Artificial Sequence
  sgRNA
  mm24144_Ramp3
cttctgcatcatgtcagcga

SEQ ID NO: 3872 - DNA, 20 bp, Artificial Sequence
  sgRNA
  mm24145_Ramp3
ctggaagtggtgcaacctgt

SEQ ID NO: 3873 - DNA, 20 bp, Artificial Sequence
  sgRNA
  mm24182_Bace2
acacctactttgactcagag

SEQ ID NO: 3874 - DNA, 20 bp, Artificial Sequence
  sgRNA
  mm24183_Bace2
gtttcagtataacgcagaca

SEQ ID NO: 3875 - DNA, 20 bp, Artificial Sequence
  sgRNA
  mm24184_Bace2
agggccagaccatcggcccg

SEQ ID NO: 3876 - DNA, 20 bp, Artificial Sequence
  sgRNA
  mm24185_Bace2
taccaacggaggtagtcttg

SEQ ID NO: 3877 - DNA, 20 bp, Artificial Sequence
  sgRNA
  mm24190_Olfm1
acctggcccgtacctgacca

SEQ ID NO: 3878 - DNA, 20 bp, Artificial Sequence
  sgRNA
  mm24191_Olfm1
acttgtactcacggacgaag

SEQ ID NO: 3879 - DNA, 20 bp, Artificial Sequence
  sgRNA
  mm24192_Olfm1
ctgcaataccaatttggcat

SEQ ID NO: 3880 - DNA, 20 bp, Artificial Sequence
  sgRNA
  mm24193_Olfm1
gtattgaggcccaccagcga

SEQ ID NO: 3881 - DNA, 20 bp, Artificial Sequence
  sgRNA
  mm24330_Thsd1
gatgccggtgacggacctag

SEQ ID NO: 3882 - DNA, 20 bp, Artificial Sequence
  sgRNA
  mm24331_Thsd1
tcagggggctttgagatacg

SEQ ID NO: 3883 - DNA, 20 bp, Artificial Sequence
  sgRNA
  mm24332_Thsd1
acaacgtggtgaccgtcaca

SEQ ID NO: 3884 - DNA, 20 bp, Artificial Sequence
  sgRNA
  mm24333_Thsd1
agaagcccccaaacgcccgg

SEQ ID NO: 3885 - DNA, 20 bp, Artificial Sequence
  sgRNA
  mm24350_Cpxm1
ctgacctcaacacacaactg

SEQ ID NO: 3886 - DNA, 20 bp, Artificial Sequence
  sgRNA
  mm24351_Cpxm1
atagccatcaggattcatgg

SEQ ID NO: 3887 - DNA, 20 bp, Artificial Sequence
  sgRNA
  mm24352_Cpxm1
tcctaatgacctgttccctg

SEQ ID NO: 3888 - DNA, 20 bp, Artificial Sequence
  sgRNA
  mm24353_Cpxm1
ggaaatgtcagaccatcctg

SEQ ID NO: 3889 - DNA, 20 bp, Artificial Sequence
  sgRNA
  mm24778_Tspan3
tcctacagctatgatcacca

SEQ ID NO: 3890 - DNA, 20 bp, Artificial Sequence
  sgRNA
  mm24779_Tspan3
aattcataactattcagact

SEQ ID NO: 3891 - DNA, 20 bp, Artificial Sequence
  sgRNA
  mm24780_Tspan3
tctgcacatagtcaatagca

SEQ ID NO: 3892 - DNA, 20 bp, Artificial Sequence
  sgRNA
  mm24781_Tspan3
ttaccgtggcaagtccacag

SEQ ID NO: 3893 - DNA, 20 bp, Artificial Sequence
  sgRNA
  mm24838_Mbtps1
gaacgaaagactttccgctg

SEQ ID NO: 3894 - DNA, 20 bp, Artificial Sequence
  sgRNA
  mm24839_Mbtps1
atggcaaggtaacctgacca

SEQ ID NO: 3895 - DNA, 20 bp, Artificial Sequence
  sgRNA
  mm24840_Mbtps1
tgtttataggaattaccagg

SEQ ID NO: 3896 - DNA, 20 bp, Artificial Sequence
  sgRNA
  mm24841_Mbtps1
tgactgagtgtccctacatg

SEQ ID NO: 3897 - DNA, 20 bp, Artificial Sequence
  sgRNA
  mm24854_Clptm1
tggccagactctcattaatg

SEQ ID NO: 3898 - DNA, 20 bp, Artificial Sequence
  sgRNA
  mm24855_Clptm1
agtgcgagattacttctaca

SEQ ID NO: 3899 - DNA, 20 bp, Artificial Sequence
  sgRNA
  mm24856_Clptm1
ggtttcggctggcgacacgt

SEQ ID NO: 3900 - DNA, 20 bp, Artificial Sequence
  sgRNA
  mm24857_Clptm1
gatgtaaaggagaaccacaa

SEQ ID NO: 3901 - DNA, 20 bp, Artificial Sequence
  sgRNA
  mm24882_Ctsf
acaattacggccgtgctgcg

SEQ ID NO: 3902 - DNA, 20 bp, Artificial Sequence
  sgRNA
  mm24883_Ctsf
aaagacagtcaatcgccact

SEQ ID NO: 3903 - DNA, 20 bp, Artificial Sequence
  sgRNA
  mm24884_Ctsf
accaggggatcattgcaagg

SEQ ID NO: 3904 - DNA, 20 bp, Artificial Sequence
  sgRNA
  mm24885_Ctsf
cctgaatcccctcttacaga

SEQ ID NO: 3905 - DNA, 20 bp, Artificial Sequence
  sgRNA
  mm24950_Tspan6
tctgaaaacaaatccaacaa

SEQ ID NO: 3906 - DNA, 20 bp, Artificial Sequence
  sgRNA
  mm24951_Tspan6
aatgagcacaaaaggcacat

SEQ ID NO: 3907 - DNA, 20 bp, Artificial Sequence
  sgRNA
  mm24952_Tspan6
cccaaatgccaacggcaaga

SEQ ID NO: 3908 - DNA, 20 bp, Artificial Sequence
  sgRNA
  mm24953_Tspan6
ttcacttctatagtctcctg

SEQ ID NO: 3909 - DNA, 20 bp, Artificial Sequence
  sgRNA
  mm24990_Slc22a21
gggacatatatccaactacg

SEQ ID NO: 3910 - DNA, 20 bp, Artificial Sequence
  sgRNA
  mm24991_Slc22a21
acaacccagtaaagccattg

SEQ ID NO: 3911 - DNA, 20 bp, Artificial Sequence
  sgRNA
  mm24992_Slc22a21
ttcggaccagatcataaatg

SEQ ID NO: 3912 - DNA, 20 bp, Artificial Sequence
  sgRNA
  mm24993_Slc22a21
gaagctgaatccggtgtgca

SEQ ID NO: 3913 - DNA, 20 bp, Artificial Sequence
  sgRNA
  mm25018_Sept6
cttaagcgaatgtcctgtcg

SEQ ID NO: 3914 - DNA, 20 bp, Artificial Sequence
  sgRNA
  mm25019_Sept6
ccgctatgcagttgaaaacg

SEQ ID NO: 3915 - DNA, 20 bp, Artificial Sequence
  sgRNA
  mm25020_Sept6
aacaacagcaaacggcaggt

SEQ ID NO: 3916 - DNA, 20 bp, Artificial Sequence
  sgRNA
  mm25021_Sept6
ttcaaacttggtgttaaaca

SEQ ID NO: 3917 - DNA, 20 bp, Artificial Sequence
  sgRNA
  mm25090_Raet1d
agatgaagtgaagtgcttcg

SEQ ID NO: 3918 - DNA, 20 bp, Artificial Sequence
  sgRNA
  mm25091_Raet1d
gaactcaccatctagcccgt

SEQ ID NO: 3919 - DNA, 20 bp, Artificial Sequence
  sgRNA
  mm25092_Raet1d
tctacacagagattatgagc

SEQ ID NO: 3920 - DNA, 20 bp, Artificial Sequence
  sgRNA
  mm25093_Raet1d
cagcaaatgccactgaagtg

SEQ ID NO: 3921 - DNA, 20 bp, Artificial Sequence
  sgRNA
  mm25154_Slc15a1
ttgtccaatcgtgtagacga

SEQ ID NO: 3922 - DNA, 20 bp, Artificial Sequence
  sgRNA
  mm25155_Slc15a1
gaagtaaggcatatcccaag

SEQ ID NO: 3923 - DNA, 20 bp, Artificial Sequence
  sgRNA
  mm25156_Slc15a1
ccaccaaacgcagacacaca

SEQ ID NO: 3924 - DNA, 20 bp, Artificial Sequence
  sgRNA
  mm25157_Slc15a1
ctgggacgacaatctctcca

SEQ ID NO: 3925 - DNA, 20 bp, Artificial Sequence
  sgRNA
  mm25174_Crtap
cacgcgctcgaccagtacag

SEQ ID NO: 3926 - DNA, 20 bp, Artificial Sequence
  sgRNA
  mm25175_Crtap
cttggaaaccaagtcgtacg

SEQ ID NO: 3927 - DNA, 20 bp, Artificial Sequence
  sgRNA
  mm25176_Crtap
cgaagaggcgtagttcggcg

SEQ ID NO: 3928 - DNA, 20 bp, Artificial Sequence
  sgRNA
  mm25177_Crtap
gagaacgtccatttccgaca

SEQ ID NO: 3929 - DNA, 20 bp, Artificial Sequence
  sgRNA
  mm25286_Igdcc4
ctgtacgcttcggcccctgg

SEQ ID NO: 3930 - DNA, 20 bp, Artificial Sequence
  sgRNA
  mm25287_Igdcc4
cacgcgtgatttcgccactg

SEQ ID NO: 3931 - DNA, 20 bp, Artificial Sequence
  sgRNA
  mm25288_Igdcc4
acaagatagagtacggtttg

SEQ ID NO: 3932 - DNA, 20 bp, Artificial Sequence
  sgRNA
  mm25289_Igdcc4
actctgtccagacactaccg

SEQ ID NO: 3933 - DNA, 20 bp, Artificial Sequence
  sgRNA
  mm25306_Tex101
gctcttactggccaaaacga

SEQ ID NO: 3934 - DNA, 20 bp, Artificial Sequence
  sgRNA
  mm25307_Tex101
ttcttctaatcgcctcacgt

SEQ ID NO: 3935 - DNA, 20 bp, Artificial Sequence
  sgRNA
  mm25308_Tex101
tgagttgtgccattggcaca

SEQ ID NO: 3936 - DNA, 20 bp, Artificial Sequence
  sgRNA
  mm25309_Tex101
ccgccactgcccgacatgtg

SEQ ID NO: 3937 - DNA, 20 bp, Artificial Sequence
  sgRNA
  mm25310_Sez6l
ggtccgacgtgaactcaatg

SEQ ID NO: 3938 - DNA, 20 bp, Artificial Sequence
  sgRNA
  mm25311_Sez6l
agagtgtcaacctctccgag

SEQ ID NO: 3939 - DNA, 20 bp, Artificial Sequence
  sgRNA
  mm25312_Sez6l
agatgagcctcgtatacctg

SEQ ID NO: 3940 - DNA, 20 bp, Artificial Sequence
  sgRNA
  mm25313_Sez6l
agcaactcaactcggcccgg

SEQ ID NO: 3941 - DNA, 20 bp, Artificial Sequence
  sgRNA
  mm25322_Tacstd2
gggctcctcatagtgtaccg

SEQ ID NO: 3942 - DNA, 20 bp, Artificial Sequence
  sgRNA
  mm25323_Tacstd2
cgtcacactccgggtcgtag

SEQ ID NO: 3943 - DNA, 20 bp, Artificial Sequence
  sgRNA
  mm25324_Tacstd2
gtttacgcaccagcacaccg

SEQ ID NO: 3944 - DNA, 20 bp, Artificial Sequence
  sgRNA
  mm25325_Tacstd2
ctgacctagactccgagctg

SEQ ID NO: 3945 - DNA, 20 bp, Artificial Sequence
  sgRNA
  mm25330_Clec1b
cttcaggcgtaacctaacat

SEQ ID NO: 3946 - DNA, 20 bp, Artificial Sequence
  sgRNA
  mm25331_Clec1b
gccacgaagtggagatacca

SEQ ID NO: 3947 - DNA, 20 bp, Artificial Sequence
  sgRNA
  mm25332_Clec1b
acagcaaaagtatctactgg

SEQ ID NO: 3948 - DNA, 20 bp, Artificial Sequence
  sgRNA
  mm25333_Clec1b
catcacacgccaccaagaag

SEQ ID NO: 3949 - DNA, 20 bp, Artificial Sequence
  sgRNA
  mm25354_Tmem9b
gtggagcccatgcctgtacg

SEQ ID NO: 3950 - DNA, 20 bp, Artificial Sequence
  sgRNA
  mm25355_Tmem9b
ttcttattataaatgtgccc

SEQ ID NO: 3951 - DNA, 20 bp, Artificial Sequence
  sgRNA
  mm25356_Tmem9b
gagaagctctgtcacaatca

SEQ ID NO: 3952 - DNA, 20 bp, Artificial Sequence
  sgRNA
  mm25357_Tmem9b
cacgacatgaaggcaatcac

SEQ ID NO: 3953 - DNA, 20 bp, Artificial Sequence
  sgRNA
  mm25362_Scube2
tgtgacaacacactcaacgg

SEQ ID NO: 3954 - DNA, 20 bp, Artificial Sequence
  sgRNA
  mm25363_Scube2
atctgcaaggaggccccaag

SEQ ID NO: 3955 - DNA, 20 bp, Artificial Sequence
  sgRNA
  mm25364_Scube2
tcagcatgcaacctataccg

SEQ ID NO: 3956 - DNA, 20 bp, Artificial Sequence
  sgRNA
  mm25365_Scube2
acagacgagaagtcttgcca

SEQ ID NO: 3957 - DNA, 20 bp, Artificial Sequence
  sgRNA
  mm25394_Cacna2d2
gtaatagcgagtgactcccg

SEQ ID NO: 3958 - DNA, 20 bp, Artificial Sequence
  sgRNA
  mm25395_Cacna2d2
agtgattcggaactacacct

SEQ ID NO: 3959 - DNA, 20 bp, Artificial Sequence
  sgRNA
  mm25396_Cacna2d2
agcagttagtggaacgtgtg

SEQ ID NO: 3960 - DNA, 20 bp, Artificial Sequence
  sgRNA
  mm25397_Cacna2d2
gtgttcaaggaagctgtgca

SEQ ID NO: 3961 - DNA, 20 bp, Artificial Sequence
  sgRNA
  mm25490_Htr3b
tatcaagaggctcacaacgt

SEQ ID NO: 3962 - DNA, 20 bp, Artificial Sequence
  sgRNA
  mm25491_Htr3b
gcagaatgctattaaaggtg

SEQ ID NO: 3963 - DNA, 20 bp, Artificial Sequence
  sgRNA
  mm25492_Htr3b
ttaccacatccaatacagca

SEQ ID NO: 3964 - DNA, 20 bp, Artificial Sequence
  sgRNA
  mm25493_Htr3b
cttacaacagtaccacaagg

SEQ ID NO: 3965 - DNA, 20 bp, Artificial Sequence
  sgRNA
  mm25494_Pdxp
ctcgtcgtagcctacgagca

SEQ ID NO: 3966 - DNA, 20 bp, Artificial Sequence
  sgRNA
  mm25495_Pdxp
cgggtgccaagggtcgcgat

SEQ ID NO: 3967 - DNA, 20 bp, Artificial Sequence
  sgRNA
  mm25496_Pdxp
tgttcgtgagcaacaacagc

SEQ ID NO: 3968 - DNA, 20 bp, Artificial Sequence
  sgRNA
  mm25497_Pdxp
tcgactgcgacggagtgctg

SEQ ID NO: 3969 - DNA, 20 bp, Artificial Sequence
  sgRNA
  mm25502_Slc12a5
ccaaaggggtgattgtcgag

SEQ ID NO: 3970 - DNA, 20 bp, Artificial Sequence
  sgRNA
  mm25503_Slc12a5
agccatggcgagacagcgtg

SEQ ID NO: 3971 - DNA, 20 bp, Artificial Sequence
  sgRNA
  mm25504_Slc12a5
tggattacagagcctcacag

SEQ ID NO: 3972 - DNA, 20 bp, Artificial Sequence
  sgRNA
  mm25505_Slc12a5
gcaggatctcgatcgtgcca

SEQ ID NO: 3973 - DNA, 20 bp, Artificial Sequence
  sgRNA
  mm25562_Xpo4
aagtagtggcaatcccactg

SEQ ID NO: 3974 - DNA, 20 bp, Artificial Sequence
  sgRNA
  mm25563_Xpo4
gtgtgctagataatcaacct

SEQ ID NO: 3975 - DNA, 20 bp, Artificial Sequence
  sgRNA
  mm25564_Xpo4
gctgaacagtgtcattcgcg

SEQ ID NO: 3976 - DNA, 20 bp, Artificial Sequence
  sgRNA
  mm25565_Xpo4
ggaagcggttgtccgagagt

SEQ ID NO: 3977 - DNA, 20 bp, Artificial Sequence
  sgRNA
  mm25630_Bcam
cgagagtctacctcgtatgg

SEQ ID NO: 3978 - DNA, 20 bp, Artificial Sequence
  sgRNA
  mm25631_Bcam
accatgtgatccgaggcacg

SEQ ID NO: 3979 - DNA, 20 bp, Artificial Sequence
  sgRNA
  mm25632_Bcam
ggaggattacgatgccgacg

SEQ ID NO: 3980 - DNA, 20 bp, Artificial Sequence
  sgRNA
  mm25633_Bcam
gtccatcgcacagtaggagt

SEQ ID NO: 3981 - DNA, 20 bp, Artificial Sequence
  sgRNA
  mm25718_B4galt3
gaaactccgccaaagtactg

SEQ ID NO: 3982 - DNA, 20 bp, Artificial Sequence
  sgRNA
  mm25719_B4galt3
gggctaaaggatactgacac

SEQ ID NO: 3983 - DNA, 20 bp, Artificial Sequence
  sgRNA
  mm25720_B4galt3
tggaaatggaacgtttaaca

SEQ ID NO: 3984 - DNA, 20 bp, Artificial Sequence
  sgRNA
  mm25721_B4galt3
gaatagtcgaatgttgggcc

SEQ ID NO: 3985 - DNA, 20 bp, Artificial Sequence
  sgRNA
  mm25730_Mogs
tctaggtcattcttcccacg

SEQ ID NO: 3986 - DNA, 20 bp, Artificial Sequence
  sgRNA
  mm25731_Mogs
tcggcagcatatccacgatg

SEQ ID NO: 3987 - DNA, 20 bp, Artificial Sequence
  sgRNA
  mm25732_Mogs
tgccgaaatagacgtgtggg

SEQ ID NO: 3988 - DNA, 20 bp, Artificial Sequence
  sgRNA
  mm25733_Mogs
gaggtcctactaccagagat

SEQ ID NO: 3989 - DNA, 20 bp, Artificial Sequence
  sgRNA
  mm25742_Tmem27
gctttgcaacataacccaga

SEQ ID NO: 3990 - DNA, 20 bp, Artificial Sequence
  sgRNA
  mm25743_Tmem27
tcctgcagctgaagtacagt

SEQ ID NO: 3991 - DNA, 20 bp, Artificial Sequence
  sgRNA
  mm25744_Tmem27
ccgaatacaataatccagac

SEQ ID NO: 3992 - DNA, 20 bp, Artificial Sequence
  sgRNA
  mm25745_Tmem27
ttcaaggctacgtacctgga

SEQ ID NO: 3993 - DNA, 20 bp, Artificial Sequence
  sgRNA
  mm25818_Slc15a2
aggaggtatcaaaccctgtg

SEQ ID NO: 3994 - DNA, 20 bp, Artificial Sequence
  sgRNA
  mm25819_Slc15a2
acattccaaagcgacaacat

SEQ ID NO: 3995 - DNA, 20 bp, Artificial Sequence
  sgRNA
  mm25820_Slc15a2
tatcggctgatctccaagtg

SEQ ID NO: 3996 - DNA, 20 bp, Artificial Sequence
  sgRNA
  mm25821_Slc15a2
ctgatggactccaccaagag

SEQ ID NO: 3997 - DNA, 20 bp, Artificial Sequence
  sgRNA
  mm25902_Cd200r1
acatggataataaagctcag

SEQ ID NO: 3998 - DNA, 20 bp, Artificial Sequence
  sgRNA
  mm25903_Cd200r1
agttcatctcctctgacaca

SEQ ID NO: 3999 - DNA, 20 bp, Artificial Sequence
  sgRNA
  mm25904_Cd200r1
ggttacttcagggggcactg

SEQ ID NO: 4000 - DNA, 20 bp, Artificial Sequence
  sgRNA
  mm25905_Cd200r1
tgtcaggagcacatgccact

SEQ ID NO: 4001 - DNA, 20 bp, Artificial Sequence
  sgRNA
  mm25922_Rpl35a
aacaaaaccagagtgatctg

SEQ ID NO: 4002 - DNA, 20 bp, Artificial Sequence
  sgRNA
  mm25923_Rpl35a
ttgtcttaggctgtggtgca

SEQ ID NO: 4003 - DNA, 20 bp, Artificial Sequence
  sgRNA
  mm25924_Rpl35a
gatgaaacggagttctactt

SEQ ID NO: 4004 - DNA, 20 bp, Artificial Sequence
  sgRNA
  mm25925_Rpl35a
accagcaatacagtgactcc

SEQ ID NO: 4005 - DNA, 20 bp, Artificial Sequence
  sgRNA
  mm25926_Cdon
gaacagataaagattcatcg

SEQ ID NO: 4006 - DNA, 20 bp, Artificial Sequence
  sgRNA
  mm25927_Cdon
atcacaggtaaaatgtacgg

SEQ ID NO: 4007 - DNA, 20 bp, Artificial Sequence
  sgRNA
  mm25928_Cdon
ctatttcgtgaagtaccgaa

SEQ ID NO: 4008 - DNA, 20 bp, Artificial Sequence
  sgRNA
  mm25929_Cdon
ggctggttatcaatccatgg

SEQ ID NO: 4009 - DNA, 20 bp, Artificial Sequence
  sgRNA
  mm25962_Angptl4
cctgtggtaacgcttgtcag

SEQ ID NO: 4010 - DNA, 20 bp, Artificial Sequence
  sgRNA
  mm25963_Angptl4
tcgtcccaggatgcaaagcg

SEQ ID NO: 4011 - DNA, 20 bp, Artificial Sequence
  sgRNA
  mm25964_Angptl4
tccattgtctaggtgcgtgg

SEQ ID NO: 4012 - DNA, 20 bp, Artificial Sequence
  sgRNA
  mm25965_Angptl4
gcttcggagatccccaaggt

SEQ ID NO: 4013 - DNA, 20 bp, Artificial Sequence
  sgRNA
  mm25998_Crlf2
ggaagtcatagcagcgtacg

SEQ ID NO: 4014 - DNA, 20 bp, Artificial Sequence
  sgRNA
  mm25999_Crlf2
cccacaccactcacgccagg

SEQ ID NO: 4015 - DNA, 20 bp, Artificial Sequence
  sgRNA
  mm26000_Crlf2
gcgccggacaggaaatatcg

SEQ ID NO: 4016 - DNA, 20 bp, Artificial Sequence
  sgRNA
  mm26001_Crlf2
agcggtgacaaggctttccg

SEQ ID NO: 4017 - DNA, 20 bp, Artificial Sequence
  sgRNA
  mm26006_Tnfrsf13b
gtactacgaccatctcctgg

SEQ ID NO: 4018 - DNA, 20 bp, Artificial Sequence
  sgRNA
  mm26007_Tnfrsf13b
gaagtcaggtcagacaactc

SEQ ID NO: 4019 - DNA, 20 bp, Artificial Sequence
  sgRNA
  mm26008_Tnfrsf13b
gtggctctcctctacgcctg

SEQ ID NO: 4020 - DNA, 20 bp, Artificial Sequence
  sgRNA
  mm26009_Tnfrsf13b
atcagtactgggactcctca

SEQ ID NO: 4021 - DNA, 20 bp, Artificial Sequence
  sgRNA
  mm26030_Klrc3
tttgtgctgaagatagactg

SEQ ID NO: 4022 - DNA, 20 bp, Artificial Sequence
  sgRNA
  mm26031_Klrc3
actgaaacggagctgcgcct

SEQ ID NO: 4023 - DNA, 20 bp, Artificial Sequence
  sgRNA
  mm26032_Klrc3
caattgttattacattggca

SEQ ID NO: 4024 - DNA, 20 bp, Artificial Sequence
  sgRNA
  mm26033_Klrc3
aatcaataaggtaaaccaga

SEQ ID NO: 4025 - DNA, 20 bp, Artificial Sequence
  sgRNA
  mm26090_Pdcd1lg2
ccccgcagatgaccaggcaa

SEQ ID NO: 4026 - DNA, 20 bp, Artificial Sequence
  sgRNA
  mm26091_Pdcd1lg2
gatagacactaggatcctgg

SEQ ID NO: 4027 - DNA, 20 bp, Artificial Sequence
  sgRNA
  mm26092_Pdcd1lg2
ccagttcagtgcattctctg

SEQ ID NO: 4028 - DNA, 20 bp, Artificial Sequence
  sgRNA
  mm26093_Pdcd1lg2
ctaggggataacctctagcc

SEQ ID NO: 4029 - DNA, 20 bp, Artificial Sequence
  sgRNA
  mm26098_Slc43a3
tgaccgcttcaagactactg

SEQ ID NO: 4030 - DNA, 20 bp, Artificial Sequence
  sgRNA
  mm26099_Slc43a3
gattcatcttgcacgtggtg

SEQ ID NO: 4031 - DNA, 20 bp, Artificial Sequence
  sgRNA
  mm26100_Slc43a3
tgctccagagcaatgtaaca

SEQ ID NO: 4032 - DNA, 20 bp, Artificial Sequence
  sgRNA
  mm26101_Slc43a3
tacccatagctgtagttggg

SEQ ID NO: 4033 - DNA, 20 bp, Artificial Sequence
  sgRNA
  mm26162_Pvrl1
tccactcgtttctcgtaggg

SEQ ID NO: 4034 - DNA, 20 bp, Artificial Sequence
  sgRNA
  mm26163_Pvrl1
caggaaattcggaaccccaa

SEQ ID NO: 4035 - DNA, 20 bp, Artificial Sequence
  sgRNA
  mm26164_Pvrl1
tctgggcctctacacccttg

SEQ ID NO: 4036 - DNA, 20 bp, Artificial Sequence
  sgRNA
  mm26165_Pvrl1
ccgggtgccctcaatccagt

SEQ ID NO: 4037 - DNA, 20 bp, Artificial Sequence
  sgRNA
  mm26166_Nkain4
ataccggccacgctacatcg

SEQ ID NO: 4038 - DNA, 20 bp, Artificial Sequence
  sgRNA
  mm26167_Nkain4
tgggccaggctgtcttcacg

SEQ ID NO: 4039 - DNA, 20 bp, Artificial Sequence
  sgRNA
  mm26168_Nkain4
acgatgcccagagagattga

SEQ ID NO: 4040 - DNA, 20 bp, Artificial Sequence
  sgRNA
  mm26169_Nkain4
tgggtgcccactggtaaccc

SEQ ID NO: 4041 - DNA, 20 bp, Artificial Sequence
  sgRNA
  mm26206_Chst11
agccaacgaagcccacgtgt

SEQ ID NO: 4042 - DNA, 20 bp, Artificial Sequence
  sgRNA
  mm26207_Chst11
gcagacaccagcctctcgaa

SEQ ID NO: 4043 - DNA, 20 bp, Artificial Sequence
  sgRNA
  mm26208_Chst11
agcagatgtccacaccgaag

SEQ ID NO: 4044 - DNA, 20 bp, Artificial Sequence
  sgRNA
  mm26209_Chst11
acctccttccacaagcgcta

SEQ ID NO: 4045 - DNA, 20 bp, Artificial Sequence
  sgRNA
  mm26262_Slco1c1
gaagacataaacccacatgg

SEQ ID NO: 4046 - DNA, 20 bp, Artificial Sequence
  sgRNA
  mm26263_Slco1c1
ccatataacaatcaccccaa

SEQ ID NO: 4047 - DNA, 20 bp, Artificial Sequence
  sgRNA
  mm26264_Slco1c1
agctaacaaacgttatgacc

SEQ ID NO: 4048 - DNA, 20 bp, Artificial Sequence
  sgRNA
  mm26265_Slco1c1
gggatgtgaaaattctagtg

SEQ ID NO: 4049 - DNA, 20 bp, Artificial Sequence
  sgRNA
  mm26318_Sumf1
gcagccgcacgagcccgcaa

SEQ ID NO: 4050 - DNA, 20 bp, Artificial Sequence
  sgRNA
  mm26319_Sumf1
ctcgactggctatttgacag

SEQ ID NO: 4051 - DNA, 20 bp, Artificial Sequence
  sgRNA
  mm26320_Sumf1
agtgaaaacgcatatccacc

SEQ ID NO: 4052 - DNA, 20 bp, Artificial Sequence
  sgRNA
  mm26321_Sumf1
agctaattggagacacccag

SEQ ID NO: 4053 - DNA, 20 bp, Artificial Sequence
  sgRNA
  mm26338_Pvrl3
tttcccacaagatttgctcg

SEQ ID NO: 4054 - DNA, 20 bp, Artificial Sequence
  sgRNA
  mm26339_Pvrl3
aaagccgttacattcccact

SEQ ID NO: 4055 - DNA, 20 bp, Artificial Sequence
  sgRNA
  mm26340_Pvrl3
cttagctggatcaattattg

SEQ ID NO: 4056 - DNA, 20 bp, Artificial Sequence
  sgRNA
  mm26341_Pvrl3
gccagtcgcacagattgact

SEQ ID NO: 4057 - DNA, 20 bp, Artificial Sequence
  sgRNA
  mm26386_Moxd1
actacgataatcccgcacgg

SEQ ID NO: 4058 - DNA, 20 bp, Artificial Sequence
  sgRNA
  mm26387_Moxd1
ggtacgcacgaacggctacg

SEQ ID NO: 4059 - DNA, 20 bp, Artificial Sequence
  sgRNA
  mm26388_Moxd1
tcttccacacaattccccca

SEQ ID NO: 4060 - DNA, 20 bp, Artificial Sequence
  sgRNA
  mm26389_Moxd1
gaaactgtgattctcgcctg

SEQ ID NO: 4061 - DNA, 20 bp, Artificial Sequence
  sgRNA
  mm26422_Usp14
tatcagatggaattgccatg

SEQ ID NO: 4062 - DNA, 20 bp, Artificial Sequence
  sgRNA
  mm26423_Usp14
tcagcacagtatattactgc

SEQ ID NO: 4063 - DNA, 20 bp, Artificial Sequence
  sgRNA
  mm26424_Usp14
gaatactgatgaacctccaa

SEQ ID NO: 4064 - DNA, 20 bp, Artificial Sequence
  sgRNA
  mm26425_Usp14
ttgaaataggatgatgactg

SEQ ID NO: 4065 - DNA, 20 bp, Artificial Sequence
  sgRNA
  mm26446_Chst12
attgtatattgggacaacgt

SEQ ID NO: 4066 - DNA, 20 bp, Artificial Sequence
  sgRNA
  mm26447_Chst12
gatcatcactcgcttccagt

SEQ ID NO: 4067 - DNA, 20 bp, Artificial Sequence
  sgRNA
  mm26448_Chst12
agaacgtgagaggctacgac

SEQ ID NO: 4068 - DNA, 20 bp, Artificial Sequence
  sgRNA
  mm26449_Chst12
gacgggagaactttccgtag

SEQ ID NO: 4069 - DNA, 20 bp, Artificial Sequence
  sgRNA
  mm26514_Mettl9
ctgtacgtgaacatgactag

SEQ ID NO: 4070 - DNA, 20 bp, Artificial Sequence
  sgRNA
  mm26515_Mettl9
acagcattgagaaatctggc

SEQ ID NO: 4071 - DNA, 20 bp, Artificial Sequence
  sgRNA
  mm26516_Mettl9
gagtgcttggtataaatgaa

SEQ ID NO: 4072 - DNA, 20 bp, Artificial Sequence
  sgRNA
  mm26517_Mettl9
atctggtgagaacacaaaca

SEQ ID NO: 4073 - DNA, 20 bp, Artificial Sequence
  sgRNA
  mm26538_Tpm3
ctggatcctgcggttcaagg

SEQ ID NO: 4074 - DNA, 20 bp, Artificial Sequence
  sgRNA
  mm26539_Tpm3
aggagacttggaacgcacgg

SEQ ID NO: 4075 - DNA, 20 bp, Artificial Sequence
  sgRNA
  mm26540_Tpm3
acattgcagaagaggccgat

SEQ ID NO: 4076 - DNA, 20 bp, Artificial Sequence
  sgRNA
  mm26541_Tpm3
tgggctctggctccagctag

SEQ ID NO: 4077 - DNA, 20 bp, Artificial Sequence
  sgRNA
  mm26574_Ncstn
ccagcagaaccatgtaaggg

SEQ ID NO: 4078 - DNA, 20 bp, Artificial Sequence
  sgRNA
  mm26575_Ncstn
gtgctatcaagatcacaacc

SEQ ID NO: 4079 - DNA, 20 bp, Artificial Sequence
  sgRNA
  mm26576_Ncstn
agggacagaactcacccgtg

SEQ ID NO: 4080 - DNA, 20 bp, Artificial Sequence
  sgRNA
  mm26577_Ncstn
ggtgactcaccgattgtgga

SEQ ID NO: 4081 - DNA, 20 bp, Artificial Sequence
  sgRNA
  mm26586_Gpa33
tcttaccgtggaaactacac

SEQ ID NO: 4082 - DNA, 20 bp, Artificial Sequence
  sgRNA
  mm26587_Gpa33
cacctatgtttcagaccgag

SEQ ID NO: 4083 - DNA, 20 bp, Artificial Sequence
  sgRNA
  mm26588_Gpa33
cagtgacacggagcactcgt

SEQ ID NO: 4084 - DNA, 20 bp, Artificial Sequence
  sgRNA
  mm26589_Gpa33
gtagtaacccgctgtctccg

SEQ ID NO: 4085 - DNA, 20 bp, Artificial Sequence
  sgRNA
  mm26606_Chst7
gaaacccggatcgatccccc

SEQ ID NO: 4086 - DNA, 20 bp, Artificial Sequence
  sgRNA
  mm26607_Chst7
tgaccttgttggtccgccag

SEQ ID NO: 4087 - DNA, 20 bp, Artificial Sequence
  sgRNA
  mm26608_Chst7
cgtacaagtagaaaacgtcc

SEQ ID NO: 4088 - DNA, 20 bp, Artificial Sequence
  sgRNA
  mm26609_Chst7
cgagtgccgcaagtacccgg

SEQ ID NO: 4089 - DNA, 20 bp, Artificial Sequence
  sgRNA
  mm26662_Il21r
gcacgtgtaccatatatgtg

SEQ ID NO: 4090 - DNA, 20 bp, Artificial Sequence
  sgRNA
  mm26663_Il21r
aggacgctatgatatctcct

SEQ ID NO: 4091 - DNA, 20 bp, Artificial Sequence
  sgRNA
  mm26664_Il21r
gccacctcaccacagcatag

SEQ ID NO: 4092 - DNA, 20 bp, Artificial Sequence
  sgRNA
  mm26665_Il21r
gggctggaagaaactctcag

SEQ ID NO: 4093 - DNA, 20 bp, Artificial Sequence
  sgRNA
  mm26698_Cd274
tgctgcataatcagctacgg

SEQ ID NO: 4094 - DNA, 20 bp, Artificial Sequence
  sgRNA
  mm26699_Cd274
tccaaaggacttgtacgtgg

SEQ ID NO: 4095 - DNA, 20 bp, Artificial Sequence
  sgRNA
  mm26700_Cd274
ctcagcacagcaacttcagg

SEQ ID NO: 4096 - DNA, 20 bp, Artificial Sequence
  sgRNA
  mm26701_Cd274
gcttgcgttagtggtgtact

SEQ ID NO: 4097 - DNA, 20 bp, Artificial Sequence
  sgRNA
  mm26754_Trpv4
tcagcacatcatccgacgtg

SEQ ID NO: 4098 - DNA, 20 bp, Artificial Sequence
  sgRNA
  mm26755_Trpv4
ggtgtacaacagcaagatcg

SEQ ID NO: 4099 - DNA, 20 bp, Artificial Sequence
  sgRNA
  mm26756_Trpv4
ctcacaagaaagctgacatg

SEQ ID NO: 4100 - DNA, 20 bp, Artificial Sequence
  sgRNA
  mm26757_Trpv4
ctacccttaccggaccacag

SEQ ID NO: 4101 - DNA, 20 bp, Artificial Sequence
  sgRNA
  mm26778_Slc29a1
gctgatgcagaaacgagttg

SEQ ID NO: 4102 - DNA, 20 bp, Artificial Sequence
  sgRNA
  mm26779_Slc29a1
gcatgattgatcagtgtccg

SEQ ID NO: 4103 - DNA, 20 bp, Artificial Sequence
  sgRNA
  mm26780_Slc29a1
tacacagcccccatcatgag

SEQ ID NO: 4104 - DNA, 20 bp, Artificial Sequence
  sgRNA
  mm26781_Slc29a1
ggccaaaatgacaactgcac

SEQ ID NO: 4105 - DNA, 20 bp, Artificial Sequence
  sgRNA
  mm26814_Sv2a
gcggtaatagccgtccgcag

SEQ ID NO: 4106 - DNA, 20 bp, Artificial Sequence
  sgRNA
  mm26815_Sv2a
tgtggacactcacccgaccc

SEQ ID NO: 4107 - DNA, 20 bp, Artificial Sequence
  sgRNA
  mm26816_Sv2a
tgagaaagacatgtgcctgt

SEQ ID NO: 4108 - DNA, 20 bp, Artificial Sequence
  sgRNA
  mm26817_Sv2a
agccccgatggcaaacacag

SEQ ID NO: 4109 - DNA, 20 bp, Artificial Sequence
  sgRNA
  mm26830_Clstn2
gagctgcagactaattacat

SEQ ID NO: 4110 - DNA, 20 bp, Artificial Sequence
  sgRNA
  mm26831_Clstn2
atagccatgcaacttactgt

SEQ ID NO: 4111 - DNA, 20 bp, Artificial Sequence
  sgRNA
  mm26832_Clstn2
tggatcgagacatcgtatca

SEQ ID NO: 4112 - DNA, 20 bp, Artificial Sequence
  sgRNA
  mm26833_Clstn2
agggtgccaagatccctgat

SEQ ID NO: 4113 - DNA, 20 bp, Artificial Sequence
  sgRNA
  mm26854_Ctsz
ttgctaccatcccattcgcg

SEQ ID NO: 4114 - DNA, 20 bp, Artificial Sequence
  sgRNA
  mm26855_Ctsz
gggcatactcccacaccgga

SEQ ID NO: 4115 - DNA, 20 bp, Artificial Sequence
  sgRNA
  mm26856_Ctsz
tgagacctgcaacaactacc

SEQ ID NO: 4116 - DNA, 20 bp, Artificial Sequence
  sgRNA
  mm26857_Ctsz
cagaccgaatcaacatcaag

SEQ ID NO: 4117 - DNA, 20 bp, Artificial Sequence
  sgRNA
  mm26870_Sv2b
ttcttatcacgagagaaacg

SEQ ID NO: 4118 - DNA, 20 bp, Artificial Sequence
  sgRNA
  mm26871_Sv2b
atacaaacatgagagctaag

SEQ ID NO: 4119 - DNA, 20 bp, Artificial Sequence
  sgRNA
  mm26872_Sv2b
atagggctgatagtctacct

SEQ ID NO: 4120 - DNA, 20 bp, Artificial Sequence
  sgRNA
  mm26873_Sv2b
ttgcagttactacggcctga

SEQ ID NO: 4121 - DNA, 20 bp, Artificial Sequence
  sgRNA
  mm26922_Gprc5b
tcgcacagggacacgtactg

SEQ ID NO: 4122 - DNA, 20 bp, Artificial Sequence
  sgRNA
  mm26923_Gprc5b
tgtgtggcaagttcaaacgg

SEQ ID NO: 4123 - DNA, 20 bp, Artificial Sequence
  sgRNA
  mm26924_Gprc5b
tccatccgacgcttcctctg

SEQ ID NO: 4124 - DNA, 20 bp, Artificial Sequence
  sgRNA
  mm26925_Gprc5b
agcgccatcacaaaatccat

SEQ ID NO: 4125 - DNA, 20 bp, Artificial Sequence
  sgRNA
  mm26934_Fndc4
tgcagcgacagaatggcccg

SEQ ID NO: 4126 - DNA, 20 bp, Artificial Sequence
  sgRNA
  mm26935_Fndc4
gtcacattcacaggagaggg

SEQ ID NO: 4127 - DNA, 20 bp, Artificial Sequence
  sgRNA
  mm26936_Fndc4
cttcttaggtgatattacag

SEQ ID NO: 4128 - DNA, 20 bp, Artificial Sequence
  sgRNA
  mm26937_Fndc4
gtgtcctgggacgttccaga

SEQ ID NO: 4129 - DNA, 20 bp, Artificial Sequence
  sgRNA
  mm26990_Dip2a
aggcgtgtaggtctcaacgg

SEQ ID NO: 4130 - DNA, 20 bp, Artificial Sequence
  sgRNA
  mm26991_Dip2a
tgtgatccgagttgacactg

SEQ ID NO: 4131 - DNA, 20 bp, Artificial Sequence
  sgRNA
  mm26992_Dip2a
acatcaacacgttacatggg

SEQ ID NO: 4132 - DNA, 20 bp, Artificial Sequence
  sgRNA
  mm26993_Dip2a
catatctcgggactttacca

SEQ ID NO: 4133 - DNA, 20 bp, Artificial Sequence
  sgRNA
  mm27070_Scube1
tgagaatgactactacaacg

SEQ ID NO: 4134 - DNA, 20 bp, Artificial Sequence
  sgRNA
  mm27071_Scube1
gagtgcttgatgaataacgg

SEQ ID NO: 4135 - DNA, 20 bp, Artificial Sequence
  sgRNA
  mm27072_Scube1
accagaaggactgcacacgt

SEQ ID NO: 4136 - DNA, 20 bp, Artificial Sequence
  sgRNA
  mm27073_Scube1
ctctacgggacaacccactg

SEQ ID NO: 4137 - DNA, 20 bp, Artificial Sequence
  sgRNA
  mm27078_Svep1
atttcctgtcgggaatcacg

SEQ ID NO: 4138 - DNA, 20 bp, Artificial Sequence
  sgRNA
  mm27079_Svep1
agaaagcatagtgcccctcg

SEQ ID NO: 4139 - DNA, 20 bp, Artificial Sequence
  sgRNA
  mm27080_Svep1
aacatccaggaagtgatcgt

SEQ ID NO: 4140 - DNA, 20 bp, Artificial Sequence
  sgRNA
  mm27081_Svep1
caagggattctatatcaagg

SEQ ID NO: 4141 - DNA, 20 bp, Artificial Sequence
  sgRNA
  mm27134_Rtn4r
acactgcacctagaccgatg

SEQ ID NO: 4142 - DNA, 20 bp, Artificial Sequence
  sgRNA
  mm27135_Rtn4r
gccgaaatctcactatcctg

SEQ ID NO: 4143 - DNA, 20 bp, Artificial Sequence
  sgRNA
  mm27136_Rtn4r
tgtgtgctacaatgagccca

SEQ ID NO: 4144 - DNA, 20 bp, Artificial Sequence
  sgRNA
  mm27137_Rtn4r
cagaggtcctaatgcccctg

SEQ ID NO: 4145 - DNA, 20 bp, Artificial Sequence
  sgRNA
  mm27222_Clstn1
tccaagtgtgactctctacg

SEQ ID NO: 4146 - DNA, 20 bp, Artificial Sequence
  sgRNA
  mm27223_Clstn1
cccagacgtgccgttcactg

SEQ ID NO: 4147 - DNA, 20 bp, Artificial Sequence
  sgRNA
  mm27224_Clstn1
agtcaccgagaacgataaca

SEQ ID NO: 4148 - DNA, 20 bp, Artificial Sequence
  sgRNA
  mm27225_Clstn1
caacgaggcggcttgcatcg

SEQ ID NO: 4149 - DNA, 20 bp, Artificial Sequence
  sgRNA
  mm27246_Cubn
gtgtatctggaacattcgcg

SEQ ID NO: 4150 - DNA, 20 bp, Artificial Sequence
  sgRNA
  mm27247_Cubn
agttatcaacttcacccacg

SEQ ID NO: 4151 - DNA, 20 bp, Artificial Sequence
  sgRNA
  mm27248_Cubn
acagctccgaatgctactgg

SEQ ID NO: 4152 - DNA, 20 bp, Artificial Sequence
  sgRNA
  mm27249_Cubn
ccacctgtgtgaacactatg

SEQ ID NO: 4153 - DNA, 20 bp, Artificial Sequence
  sgRNA
  mm27250_Lima1
ggcaagcaagagcgacaatg

SEQ ID NO: 4154 - DNA, 20 bp, Artificial Sequence
  sgRNA
  mm27251_Lima1
atggaggtttctgagaggcg

SEQ ID NO: 4155 - DNA, 20 bp, Artificial Sequence
  sgRNA
  mm27252_Lima1
ctggacccaaagccgaaatg

SEQ ID NO: 4156 - DNA, 20 bp, Artificial Sequence
  sgRNA
  mm27253_Lima1
tacaactgagaatagtctag

SEQ ID NO: 4157 - DNA, 20 bp, Artificial Sequence
  sgRNA
  mm27274_Sostdc1
tccaccaaatacatttcgga

SEQ ID NO: 4158 - DNA, 20 bp, Artificial Sequence
  sgRNA
  mm27275_Sostdc1
atgtgaataaaggatttctg

SEQ ID NO: 4159 - DNA, 20 bp, Artificial Sequence
  sgRNA
  mm27276_Sostdc1
acagcaccctgaatcaagcc

SEQ ID NO: 4160 - DNA, 20 bp, Artificial Sequence
  sgRNA
  mm27277_Sostdc1
cttcccaactggatcggagg

SEQ ID NO: 4161 - DNA, 20 bp, Artificial Sequence
  sgRNA
  mm27470_Tspan13
agctccaattagccccacca

SEQ ID NO: 4162 - DNA, 20 bp, Artificial Sequence
  sgRNA
  mm27471_Tspan13
ggctactcacggtatacagc

SEQ ID NO: 4163 - DNA, 20 bp, Artificial Sequence
  sgRNA
  mm27472_Tspan13
caatgaccacacccaccact

SEQ ID NO: 4164 - DNA, 20 bp, Artificial Sequence
  sgRNA
  mm27473_Tspan13
actggacaataaatacaagt

SEQ ID NO: 4165 - DNA, 20 bp, Artificial Sequence
  sgRNA
  mm27558_Ifitm3
ctgacagaagccgatccgtg

SEQ ID NO: 4166 - DNA, 20 bp, Artificial Sequence
  sgRNA
  mm27559_Ifitm3
ttgattctttcgtagtttgg

SEQ ID NO: 4167 - DNA, 20 bp, Artificial Sequence
  sgRNA
  mm27560_Ifitm3
aatcaaggaagaatatgagg

SEQ ID NO: 4168 - DNA, 20 bp, Artificial Sequence
  sgRNA
  mm27561_Ifitm3
tctagggatcggaagatggt

SEQ ID NO: 4169 - DNA, 20 bp, Artificial Sequence
  sgRNA
  mm27566_Eef1e1
ccagttctacagacaaacaa

SEQ ID NO: 4170 - DNA, 20 bp, Artificial Sequence
  sgRNA
  mm27567_Eef1e1
ggcctgcttgactagatggg

SEQ ID NO: 4171 - DNA, 20 bp, Artificial Sequence
  sgRNA
  mm27568_Eef1e1
tgagcactgtacttattccc

SEQ ID NO: 4172 - DNA, 20 bp, Artificial Sequence
  sgRNA
  mm27569_Eef1e1
tgcaggacataacatcaccc

SEQ ID NO: 4173 - DNA, 20 bp, Artificial Sequence
  sgRNA
  mm27758_Cd302
gaggacctagttgatacctg

SEQ ID NO: 4174 - DNA, 20 bp, Artificial Sequence
  sgRNA
  mm27759_Cd302
aaatatgacattcgacaagt

SEQ ID NO: 4175 - DNA, 20 bp, Artificial Sequence
  sgRNA
  mm27760_Cd302
acagtgcactgaccacggta

SEQ ID NO: 4176 - DNA, 20 bp, Artificial Sequence
  sgRNA
  mm27761_Cd302
actttgcaaaagcgatggaa

SEQ ID NO: 4177 - DNA, 20 bp, Artificial Sequence
  sgRNA
  mm27846_Tmem9
ggcagtaggcttccacatcg

SEQ ID NO: 4178 - DNA, 20 bp, Artificial Sequence
  sgRNA
  mm27847_Tmem9
gctctgcgagtgtaggtacg

SEQ ID NO: 4179 - DNA, 20 bp, Artificial Sequence
  sgRNA
  mm27848_Tmem9
caaccagaatgtgtctcaga

SEQ ID NO: 4180 - DNA, 20 bp, Artificial Sequence
  sgRNA
  mm27849_Tmem9
ccgctgatgtttctgtaagg

SEQ ID NO: 4181 - DNA, 20 bp, Artificial Sequence
  sgRNA
  mm27886_Ssr2
acaatgccgaagtcttctgg

SEQ ID NO: 4182 - DNA, 20 bp, Artificial Sequence
  sgRNA
  mm27887_Ssr2
agccagctttgagaggacgc

SEQ ID NO: 4183 - DNA, 20 bp, Artificial Sequence
  sgRNA
  mm27888_Ssr2
cagtataacatctacaacgt

SEQ ID NO: 4184 - DNA, 20 bp, Artificial Sequence
  sgRNA
  mm27889_Ssr2
ctgggccaggtaagtaatcg

SEQ ID NO: 4185 - DNA, 20 bp, Artificial Sequence
  sgRNA
  mm28082_Aqp11
cccccgaaatgggtgccgtg

SEQ ID NO: 4186 - DNA, 20 bp, Artificial Sequence
  sgRNA
  mm28083_Aqp11
ggcacagctagcaacccgtg

SEQ ID NO: 4187 - DNA, 20 bp, Artificial Sequence
  sgRNA
  mm28084_Aqp11
gatgatcgctttggacatgt

SEQ ID NO: 4188 - DNA, 20 bp, Artificial Sequence
  sgRNA
  mm28085_Aqp11
ctgttgccgggcgatcacgc

SEQ ID NO: 4189 - DNA, 20 bp, Artificial Sequence
  sgRNA
  mm28462_Rps23
catgccacttctggtcccgt

SEQ ID NO: 4190 - DNA, 20 bp, Artificial Sequence
  sgRNA
  mm28463_Rps23
gcatgagaggcacccccaaa

SEQ ID NO: 4191 - DNA, 20 bp, Artificial Sequence
  sgRNA
  mm28464_Rps23
ttgatattgcagaggggttg

SEQ ID NO: 4192 - DNA, 20 bp, Artificial Sequence
  sgRNA
  mm28465_Rps23
aagtcacctcaatgaagttc

SEQ ID NO: 4193 - DNA, 20 bp, Artificial Sequence
  sgRNA
  mm28494_Rpl35
cgggtcgccaaagtgacagg

SEQ ID NO: 4194 - DNA, 20 bp, Artificial Sequence
  sgRNA
  mm28495_Rpl35
attaaggctcgggacctgcg

SEQ ID NO: 4195 - DNA, 20 bp, Artificial Sequence
  sgRNA
  mm28496_Rpl35
gaaacaactggacgatctga

SEQ ID NO: 4196 - DNA, 20 bp, Artificial Sequence
  sgRNA
  mm28497_Rpl35
ctcaaggcccacttacatct

SEQ ID NO: 4197 - DNA, 20 bp, Artificial Sequence
  sgRNA
  mm28634_Sppl2a
ttgattcataggatgccatg

SEQ ID NO: 4198 - DNA, 20 bp, Artificial Sequence
  sgRNA
  mm28635_Sppl2a
tgtaattgctgtgttcactg

SEQ ID NO: 4199 - DNA, 20 bp, Artificial Sequence
  sgRNA
  mm28636_Sppl2a
tggcataaggaacaaggcag

SEQ ID NO: 4200 - DNA, 20 bp, Artificial Sequence
  sgRNA
  mm28637_Sppl2a
gtgggctgtatttcgaaatg

SEQ ID NO: 4201 - DNA, 20 bp, Artificial Sequence
  sgRNA
  mm28914_Sorcs3
tcacaccaagggttcgcgag

SEQ ID NO: 4202 - DNA, 20 bp, Artificial Sequence
  sgRNA
  mm28915_Sorcs3
ccagtccagacaccgacctg

SEQ ID NO: 4203 - DNA, 20 bp, Artificial Sequence
  sgRNA
  mm28916_Sorcs3
cttcagtccgtatctccccg

SEQ ID NO: 4204 - DNA, 20 bp, Artificial Sequence
  sgRNA
  mm28917_Sorcs3
acgtgggatctactttaccc

SEQ ID NO: 4205 - DNA, 20 bp, Artificial Sequence
  sgRNA
  mm28946_Dcbld1
tgacatctaagaattatcca

SEQ ID NO: 4206 - DNA, 20 bp, Artificial Sequence
  sgRNA
  mm28947_Dcbld1
ttaataacctgtttggaacg

SEQ ID NO: 4207 - DNA, 20 bp, Artificial Sequence
  sgRNA
  mm28948_Dcbld1
aggaatgaatattacaactg

SEQ ID NO: 4208 - DNA, 20 bp, Artificial Sequence
  sgRNA
  mm28949_Dcbld1
gcaaagctgccatccacgca

SEQ ID NO: 4209 - DNA, 20 bp, Artificial Sequence
  sgRNA
  mm28970_Aspn
gaacaacgggatagaaccag

SEQ ID NO: 4210 - DNA, 20 bp, Artificial Sequence
  sgRNA
  mm28971_Aspn
gctccagcaaagttggtggt

SEQ ID NO: 4211 - DNA, 20 bp, Artificial Sequence
  sgRNA
  mm28972_Aspn
atacaaaaggacacgttcaa

SEQ ID NO: 4212 - DNA, 20 bp, Artificial Sequence
  sgRNA
  mm28973_Aspn
gaacaactcgagagtaacat

SEQ ID NO: 4213 - DNA, 20 bp, Artificial Sequence
  sgRNA
  mm29178_Cntnap2
atttatacgaagtagcacac

SEQ ID NO: 4214 - DNA, 20 bp, Artificial Sequence
  sgRNA
  mm29179_Cntnap2
atggaaagcatcaactacaa

SEQ ID NO: 4215 - DNA, 20 bp, Artificial Sequence
  sgRNA
  mm29180_Cntnap2
ggcactaatctggtccatgg

SEQ ID NO: 4216 - DNA, 20 bp, Artificial Sequence
  sgRNA
  mm29181_Cntnap2
cagatgtgtggccatagatg

SEQ ID NO: 4217 - DNA, 20 bp, Artificial Sequence
  sgRNA
  mm29190_Tspan1
tggtgtacaccacattggtg

SEQ ID NO: 4218 - DNA, 20 bp, Artificial Sequence
  sgRNA
  mm29191_Tspan1
caggaaagatgtcccatcga

SEQ ID NO: 4219 - DNA, 20 bp, Artificial Sequence
  sgRNA
  mm29192_Tspan1
gccatgcagtttgtcaacgt

SEQ ID NO: 4220 - DNA, 20 bp, Artificial Sequence
  sgRNA
  mm29193_Tspan1
gaacaagtgtgtgctcatga

SEQ ID NO: 4221 - DNA, 20 bp, Artificial Sequence
  sgRNA
  mm29330_Clec14a
aagaacagctaaccctcgag

SEQ ID NO: 4222 - DNA, 20 bp, Artificial Sequence
  sgRNA
  mm29331_Clec14a
cctgactgtctagatcactt

SEQ ID NO: 4223 - DNA, 20 bp, Artificial Sequence
  sgRNA
  mm29332_Clec14a
ttggaaactcaaattagagg

SEQ ID NO: 4224 - DNA, 20 bp, Artificial Sequence
  sgRNA
  mm29333_Clec14a
agaggacagcccactaccgt

SEQ ID NO: 4225 - DNA, 20 bp, Artificial Sequence
  sgRNA
  mm29386_Pcyox1
cctaccgatcctgttcggcg

SEQ ID NO: 4226 - DNA, 20 bp, Artificial Sequence
  sgRNA
  mm29387_Pcyox1
ggtgcaaggtcatgactacg

SEQ ID NO: 4227 - DNA, 20 bp, Artificial Sequence
  sgRNA
  mm29388_Pcyox1
catctcgttgagaaacgtct

SEQ ID NO: 4228 - DNA, 20 bp, Artificial Sequence
  sgRNA
  mm29389_Pcyox1
gtaataaaattgtttgctcg

SEQ ID NO: 4229 - DNA, 20 bp, Artificial Sequence
  sgRNA
  mm29410_Lman2
gcaaatgtagaaatgtcgtg

SEQ ID NO: 4230 - DNA, 20 bp, Artificial Sequence
  sgRNA
  mm29411_Lman2
atctcggtgatggtgaacaa

SEQ ID NO: 4231 - DNA, 20 bp, Artificial Sequence
  sgRNA
  mm29412_Lman2
cccgggaatagcgtacagct

SEQ ID NO: 4232 - DNA, 20 bp, Artificial Sequence
  sgRNA
  mm29413_Lman2
acttcaaagtccatggcaca

SEQ ID NO: 4233 - DNA, 20 bp, Artificial Sequence
  sgRNA
  mm29562_Tmem206
gaggtggaataacctcatag

SEQ ID NO: 4234 - DNA, 20 bp, Artificial Sequence
  sgRNA
  mm29563_Tmem206
tccgggagttcatgcaaagg

SEQ ID NO: 4235 - DNA, 20 bp, Artificial Sequence
  sgRNA
  mm29564_Tmem206
catgtccgtgtcttacaagg

SEQ ID NO: 4236 - DNA, 20 bp, Artificial Sequence
  sgRNA
  mm29565_Tmem206
tcgcctgaaccagagcaatg

SEQ ID NO: 4237 - DNA, 20 bp, Artificial Sequence
  sgRNA
  mm29606_Edem3
gtggataagagctgtccgag

SEQ ID NO: 4238 - DNA, 20 bp, Artificial Sequence
  sgRNA
  mm29607_Edem3
gtccgcccaaaagaccccta

SEQ ID NO: 4239 - DNA, 20 bp, Artificial Sequence
  sgRNA
  mm29608_Edem3
actggagactgggtacgcaa

SEQ ID NO: 4240 - DNA, 20 bp, Artificial Sequence
  sgRNA
  mm29609_Edem3
aaggcatgagctcatcagct

SEQ ID NO: 4241 - DNA, 20 bp, Artificial Sequence
  sgRNA
  mm29722_Rbm7
atgctggggatatgacacac

SEQ ID NO: 4242 - DNA, 20 bp, Artificial Sequence
  sgRNA
  mm29723_Rbm7
aatcccaactgatccgcatg

SEQ ID NO: 4243 - DNA, 20 bp, Artificial Sequence
  sgRNA
  mm29724_Rbm7
cttctccagaagattatcag

SEQ ID NO: 4244 - DNA, 20 bp, Artificial Sequence
  sgRNA
  mm29725_Rbm7
gtacctgttaggagatgtgg

SEQ ID NO: 4245 - DNA, 20 bp, Artificial Sequence
  sgRNA
  mm29990_Fgf22
cactcaccgacccatagagg

SEQ ID NO: 4246 - DNA, 20 bp, Artificial Sequence
  sgRNA
  mm29991_Fgf22
gagatccgttctgtccgtgt

SEQ ID NO: 4247 - DNA, 20 bp, Artificial Sequence
  sgRNA
  mm29992_Fgf22
tcccctgcacccgaccacca

SEQ ID NO: 4248 - DNA, 20 bp, Artificial Sequence
  sgRNA
  mm29993_Fgf22
gtgatcaaagctgtgtactc

SEQ ID NO: 4249 - DNA, 20 bp, Artificial Sequence
  sgRNA
  mm30018_Mastl
aacatacagaattagaactg

SEQ ID NO: 4250 - DNA, 20 bp, Artificial Sequence
  sgRNA
  mm30019_Mastl
tgactccacactggatacga

SEQ ID NO: 4251 - DNA, 20 bp, Artificial Sequence
  sgRNA
  mm30020_Mastl
gcattcgggaaagtgtacct

SEQ ID NO: 4252 - DNA, 20 bp, Artificial Sequence
  sgRNA
  mm30021_Mastl
gagaacatgaccattgacaa

SEQ ID NO: 4253 - DNA, 20 bp, Artificial Sequence
  sgRNA
  mm30030_Tspan31
tgcgctgtgcgctctcaacg

SEQ ID NO: 4254 - DNA, 20 bp, Artificial Sequence
  sgRNA
  mm30031_Tspan31
ccagtcctgccaccgcgatg

SEQ ID NO: 4255 - DNA, 20 bp, Artificial Sequence
  sgRNA
  mm30032_Tspan31
ggctattaacagaaacacac

SEQ ID NO: 4256 - DNA, 20 bp, Artificial Sequence
  sgRNA
  mm30033_Tspan31
gaatgctagacaccacaccg

SEQ ID NO: 4257 - DNA, 20 bp, Artificial Sequence
  sgRNA
  mm30058_Nop56
cagcctgtcagccttaattg

SEQ ID NO: 4258 - DNA, 20 bp, Artificial Sequence
  sgRNA
  mm30059_Nop56
taaatttaatgtgaaccgag

SEQ ID NO: 4259 - DNA, 20 bp, Artificial Sequence
  sgRNA
  mm30060_Nop56
gaggaatgtgtgcttaacct

SEQ ID NO: 4260 - DNA, 20 bp, Artificial Sequence
  sgRNA
  mm30061_Nop56
gggtacaactgccagactgg

SEQ ID NO: 4261 - DNA, 20 bp, Artificial Sequence
  sgRNA
  mm30146_Lpar6
ttcagtcgacccactctcag

SEQ ID NO: 4262 - DNA, 20 bp, Artificial Sequence
  sgRNA
  mm30147_Lpar6
tacaacgtacatgattaacc

SEQ ID NO: 4263 - DNA, 20 bp, Artificial Sequence
  sgRNA
  mm30148_Lpar6
caagttacgttcaaaatgag

SEQ ID NO: 4264 - DNA, 20 bp, Artificial Sequence
  sgRNA
  mm30149_Lpar6
agatcgtttgcattgctgtg

SEQ ID NO: 4265 - DNA, 20 bp, Artificial Sequence
  sgRNA
  mm30182_Rplp2
aagaaaatactagacagcgt

SEQ ID NO: 4266 - DNA, 20 bp, Artificial Sequence
  sgRNA
  mm30183_Rplp2
ttcagctcactgatgacctg

SEQ ID NO: 4267 - DNA, 20 bp, Artificial Sequence
  sgRNA
  mm30184_Rplp2
taggagaggagttgcccccg

SEQ ID NO: 4268 - DNA, 20 bp, Artificial Sequence
  sgRNA
  mm30185_Rplp2
gctgaatggaaagaacattg

SEQ ID NO: 4269 - DNA, 20 bp, Artificial Sequence
  sgRNA
  mm30218_Eif2s2
gaaatactagaaaaagacga

SEQ ID NO: 4270 - DNA, 20 bp, Artificial Sequence
  sgRNA
  mm30219_Eif2s2
cctactcggacgacctgtgg

SEQ ID NO: 4271 - DNA, 20 bp, Artificial Sequence
  sgRNA
  mm30220_Eif2s2
aagagactacacatatgagg

SEQ ID NO: 4272 - DNA, 20 bp, Artificial Sequence
  sgRNA
  mm30221_Eif2s2
gatgaccttgacattatgct

SEQ ID NO: 4273 - DNA, 20 bp, Artificial Sequence
  sgRNA
  mm30454_Cltc
aagcaacacaagccagatgg

SEQ ID NO: 4274 - DNA, 20 bp, Artificial Sequence
  sgRNA
  mm30455_Cltc
gatgttcacccactatgacc

SEQ ID NO: 4275 - DNA, 20 bp, Artificial Sequence
  sgRNA
  mm30456_Cltc
gctgtgcggaacaacttagc

SEQ ID NO: 4276 - DNA, 20 bp, Artificial Sequence
  sgRNA
  mm30457_Cltc
ataaccacaggaagtcgact

SEQ ID NO: 4277 - DNA, 20 bp, Artificial Sequence
  sgRNA
  mm30586_Jam2
tgaaatctatcatctcagca

SEQ ID NO: 4278 - DNA, 20 bp, Artificial Sequence
  sgRNA
  mm30587_Jam2
tctttaaaccagatgtactc

SEQ ID NO: 4279 - DNA, 20 bp, Artificial Sequence
  sgRNA
  mm30588_Jam2
gtcacagtaatagagttcca

SEQ ID NO: 4280 - DNA, 20 bp, Artificial Sequence
  sgRNA
  mm30589_Jam2
cttccagtcataacagaagt

SEQ ID NO: 4281 - DNA, 20 bp, Artificial Sequence
  sgRNA
  mm30646_Erp29
ggcagcggcctacacacgaa

SEQ ID NO: 4282 - DNA, 20 bp, Artificial Sequence
  sgRNA
  mm30647_Erp29
gaaccctgtgctgtacaatg

SEQ ID NO: 4283 - DNA, 20 bp, Artificial Sequence
  sgRNA
  mm30648_Erp29
gctgagtgagaagtacaagc

SEQ ID NO: 4284 - DNA, 20 bp, Artificial Sequence
  sgRNA
  mm30649_Erp29
tcccaaaagcaagttcgtct

SEQ ID NO: 4285 - DNA, 20 bp, Artificial Sequence
  sgRNA
  mm30682_Armcx2
tcattatctcaatatcgacg

SEQ ID NO: 4286 - DNA, 20 bp, Artificial Sequence
  sgRNA
  mm30683_Armcx2
agagattggactgccatggg

SEQ ID NO: 4287 - DNA, 20 bp, Artificial Sequence
  sgRNA
  mm30684_Armcx2
tgtggcagcccaatctactg

SEQ ID NO: 4288 - DNA, 20 bp, Artificial Sequence
  sgRNA
  mm30685_Armcx2
ggaaacaagaaccggagtgg

SEQ ID NO: 4289 - DNA, 20 bp, Artificial Sequence
  sgRNA
  mm30770_Plxdc2
ccggttccagttcgcccacg

SEQ ID NO: 4290 - DNA, 20 bp, Artificial Sequence
  sgRNA
  mm30771_Plxdc2
actctcaagcatacaaccac

SEQ ID NO: 4291 - DNA, 20 bp, Artificial Sequence
  sgRNA
  mm30772_Plxdc2
gcagttgaaaccaatctgcg

SEQ ID NO: 4292 - DNA, 20 bp, Artificial Sequence
  sgRNA
  mm30773_Plxdc2
acaacccgactttcactgga

SEQ ID NO: 4293 - DNA, 20 bp, Artificial Sequence
  sgRNA
  mm30794_Ergic2
gccaaatgtgcatgccctcg

SEQ ID NO: 4294 - DNA, 20 bp, Artificial Sequence
  sgRNA
  mm30795_Ergic2
tctatgtcaataaagtagca

SEQ ID NO: 4295 - DNA, 20 bp, Artificial Sequence
  sgRNA
  mm30796_Ergic2
actggatttagcagagacca

SEQ ID NO: 4296 - DNA, 20 bp, Artificial Sequence
  sgRNA
  mm30797_Ergic2
ttctgtcacagagaactgat

SEQ ID NO: 4297 - DNA, 20 bp, Artificial Sequence
  sgRNA
  mm30862_Ero1lb
tgtgcaaactaccttctgga

SEQ ID NO: 4298 - DNA, 20 bp, Artificial Sequence
  sgRNA
  mm30863_Ero1lb
cagacttgagaggaagctca

SEQ ID NO: 4299 - DNA, 20 bp, Artificial Sequence
  sgRNA
  mm30864_Ero1lb
caaagaagcgttcattgact

SEQ ID NO: 4300 - DNA, 20 bp, Artificial Sequence
  sgRNA
  mm30865_Ero1lb
actcaccttatttgaacgcc

SEQ ID NO: 4301 - DNA, 20 bp, Artificial Sequence
  sgRNA
  mm30942_Tmed9
agcgcgctgtatttccacat

SEQ ID NO: 4302 - DNA, 20 bp, Artificial Sequence
  sgRNA
  mm30943_Tmed9
gctgtatgacaaacagcggg

SEQ ID NO: 4303 - DNA, 20 bp, Artificial Sequence
  sgRNA
  mm30944_Tmed9
tgggcttggcatgttcgtag

SEQ ID NO: 4304 - DNA, 20 bp, Artificial Sequence
  sgRNA
  mm30945_Tmed9
cgcccccgcaccgatgacca

SEQ ID NO: 4305 - DNA, 20 bp, Artificial Sequence
  sgRNA
  mm30994_Zswim3
tcctgtaagatcgctcggtg

SEQ ID NO: 4306 - DNA, 20 bp, Artificial Sequence
  sgRNA
  mm30995_Zswim3
tggtacatacatgtgaggaa

SEQ ID NO: 4307 - DNA, 20 bp, Artificial Sequence
  sgRNA
  mm30996_Zswim3
ctatgtaatccacaaagtga

SEQ ID NO: 4308 - DNA, 20 bp, Artificial Sequence
  sgRNA
  mm30997_Zswim3
caaggagcgagagagtcgag

SEQ ID NO: 4309 - DNA, 20 bp, Artificial Sequence
  sgRNA
  mm31010_Slc39a8
tcagctgctgtaagatcgcg

SEQ ID NO: 4310 - DNA, 20 bp, Artificial Sequence
  sgRNA
  mm31011_Slc39a8
agggggttaaaatcaatccc

SEQ ID NO: 4311 - DNA, 20 bp, Artificial Sequence
  sgRNA
  mm31012_Slc39a8
cgttaggctcagtgacagcg

SEQ ID NO: 4312 - DNA, 20 bp, Artificial Sequence
  sgRNA
  mm31013_Slc39a8
cggcgccaaccggagcctgt

SEQ ID NO: 4313 - DNA, 20 bp, Artificial Sequence
  sgRNA
  mm31098_Tctn3
accctatagaatagtactgg

SEQ ID NO: 4314 - DNA, 20 bp, Artificial Sequence
  sgRNA
  mm31099_Tctn3
gcagctcaccttacactacc

SEQ ID NO: 4315 - DNA, 20 bp, Artificial Sequence
  sgRNA
  mm31100_Tctn3
gtctacgagatagagaccaa

SEQ ID NO: 4316 - DNA, 20 bp, Artificial Sequence
  sgRNA
  mm31101_Tctn3
ctaagagtggcttcccagtg

SEQ ID NO: 4317 - DNA, 20 bp, Artificial Sequence
  sgRNA
  mm31278_Sdhb
tgcgccatgaacatcaacgg

SEQ ID NO: 4318 - DNA, 20 bp, Artificial Sequence
  sgRNA
  mm31279_Sdhb
acagtatctgcagtccatcg

SEQ ID NO: 4319 - DNA, 20 bp, Artificial Sequence
  sgRNA
  mm31280_Sdhb
acctcgaatgcagacgtacg

SEQ ID NO: 4320 - DNA, 20 bp, Artificial Sequence
  sgRNA
  mm31281_Sdhb
tagaagttactcaaatcctg

SEQ ID NO: 4321 - DNA, 20 bp, Artificial Sequence
  sgRNA
  mm31330_Kirrel3
acctcgtttcatccacacga

SEQ ID NO: 4322 - DNA, 20 bp, Artificial Sequence
  sgRNA
  mm31331_Kirrel3
ggagctgtataggaccacgg

SEQ ID NO: 4323 - DNA, 20 bp, Artificial Sequence
  sgRNA
  mm31332_Kirrel3
gacatcagggcgctacacag

SEQ ID NO: 4324 - DNA, 20 bp, Artificial Sequence
  sgRNA
  mm31333_Kirrel3
accgcttgtcaacttgtccg

SEQ ID NO: 4325 - DNA, 20 bp, Artificial Sequence
  sgRNA
  mm31478_Slc38a2
ccaccaaagcagcttccacg

SEQ ID NO: 4326 - DNA, 20 bp, Artificial Sequence
  sgRNA
  mm31479_Slc38a2
ctcaagactgccaacgaagg

SEQ ID NO: 4327 - DNA, 20 bp, Artificial Sequence
  sgRNA
  mm31480_Slc38a2
gcagtgacaatggaagaatg

SEQ ID NO: 4328 - DNA, 20 bp, Artificial Sequence
  sgRNA
  mm31481_Slc38a2
gagttgaagatgaaatagcg

SEQ ID NO: 4329 - DNA, 20 bp, Artificial Sequence
  sgRNA
  mm31518_Rtp4
ccacgacacacgcaattgtg

SEQ ID NO: 4330 - DNA, 20 bp, Artificial Sequence
  sgRNA
  mm31519_Rtp4
cctgcgatttcaaagtgtcc

SEQ ID NO: 4331 - DNA, 20 bp, Artificial Sequence
  sgRNA
  mm31520_Rtp4
tgcagagatactatggacac

SEQ ID NO: 4332 - DNA, 20 bp, Artificial Sequence
  sgRNA
  mm31521_Rtp4
atccaaatgcaggctccact

SEQ ID NO: 4333 - DNA, 20 bp, Artificial Sequence
  sgRNA
  mm31622_Rer1
gaaaaatctgtacaccaccg

SEQ ID NO: 4334 - DNA, 20 bp, Artificial Sequence
  sgRNA
  mm31623_Rer1
cagtgtcacaacccaccgga

SEQ ID NO: 4335 - DNA, 20 bp, Artificial Sequence
  sgRNA
  mm31624_Rer1
aggtcacaatgtaccaaccc

SEQ ID NO: 4336 - DNA, 20 bp, Artificial Sequence
  sgRNA
  mm31625_Rer1
acgcaatgaaaaggtttagg

SEQ ID NO: 4337 - DNA, 20 bp, Artificial Sequence
  sgRNA
  mm31814_Rpl4
gcaaaatgagaaaccgacgg

SEQ ID NO: 4338 - DNA, 20 bp, Artificial Sequence
  sgRNA
  mm31815_Rpl4
agaaaacagatgtgtcgtgg

SEQ ID NO: 4339 - DNA, 20 bp, Artificial Sequence
  sgRNA
  mm31816_Rpl4
gctgtatggcacttggcgga

SEQ ID NO: 4340 - DNA, 20 bp, Artificial Sequence
  sgRNA
  mm31817_Rpl4
gttaggtcatcgtattgagg

SEQ ID NO: 4341 - DNA, 20 bp, Artificial Sequence
  sgRNA
  mm31834_Ccdc80
tggccatcaggacccaaatg

SEQ ID NO: 4342 - DNA, 20 bp, Artificial Sequence
  sgRNA
  mm31835_Ccdc80
gggtgagctaatctcaacac

SEQ ID NO: 4343 - DNA, 20 bp, Artificial Sequence
  sgRNA
  mm31836_Ccdc80
tacggaggatcaccaatgaa

SEQ ID NO: 4344 - DNA, 20 bp, Artificial Sequence
  sgRNA
  mm31837_Ccdc80
gctataccctctacctcgga

SEQ ID NO: 4345 - DNA, 20 bp, Artificial Sequence
  sgRNA
  mm31882_Ppap2b
cattgcagtaaaaccctcga

SEQ ID NO: 4346 - DNA, 20 bp, Artificial Sequence
  sgRNA
  mm31883_Ppap2b
gcagctctctataagcaagt

SEQ ID NO: 4347 - DNA, 20 bp, Artificial Sequence
  sgRNA
  mm31884_Ppap2b
gtccctgagagtaagaacgg

SEQ ID NO: 4348 - DNA, 20 bp, Artificial Sequence
  sgRNA
  mm31885_Ppap2b
cagtcagatcaattgctccg

SEQ ID NO: 4349 - DNA, 20 bp, Artificial Sequence
  sgRNA
  mm31938_Myl12b
gctaaacggcactgaccccg

SEQ ID NO: 4350 - DNA, 20 bp, Artificial Sequence
  sgRNA
  mm31939_Myl12b
gcgtccaggtaggcatcagt

SEQ ID NO: 4351 - DNA, 20 bp, Artificial Sequence
  sgRNA
  mm31940_Myl12b
gtttagcttctccccaaaca

SEQ ID NO: 4352 - DNA, 20 bp, Artificial Sequence
  sgRNA
  mm31941_Myl12b
ccagatccaggagttcaaag

SEQ ID NO: 4353 - DNA, 20 bp, Artificial Sequence
  sgRNA
  mm31978_Tubb6
agctaagaagtacgtaccca

SEQ ID NO: 4354 - DNA, 20 bp, Artificial Sequence
  sgRNA
  mm31979_Tubb6
gaccaggccggaggctacgt

SEQ ID NO: 4355 - DNA, 20 bp, Artificial Sequence
  sgRNA
  mm31980_Tubb6
gccagggaaacgcagtgatg

SEQ ID NO: 4356 - DNA, 20 bp, Artificial Sequence
  sgRNA
  mm31981_Tubb6
ctgggccaagggtcactaca

SEQ ID NO: 4357 - DNA, 20 bp, Artificial Sequence
  sgRNA
  mm32058_Tmx3
gacttggcatataattaccg

SEQ ID NO: 4358 - DNA, 20 bp, Artificial Sequence
  sgRNA
  mm32059_Tmx3
tgttcgaccatgtacggaag

SEQ ID NO: 4359 - DNA, 20 bp, Artificial Sequence
  sgRNA
  mm32060_Tmx3
aagatggcgatctgtcctca

SEQ ID NO: 4360 - DNA, 20 bp, Artificial Sequence
  sgRNA
  mm32061_Tmx3
gtgtggccattgtaaaaagt

SEQ ID NO: 4361 - DNA, 20 bp, Artificial Sequence
  sgRNA
  mm32110_Trap1
ttgtagtgcaaagtgaagcg

SEQ ID NO: 4362 - DNA, 20 bp, Artificial Sequence
  sgRNA
  mm32111_Trap1
cagagagcccaggttaccag

SEQ ID NO: 4363 - DNA, 20 bp, Artificial Sequence
  sgRNA
  mm32112_Trap1
aggacagttatacagcacac

SEQ ID NO: 4364 - DNA, 20 bp, Artificial Sequence
  sgRNA
  mm32113_Trap1
ttggcacaattgccagatcg

SEQ ID NO: 4365 - DNA, 20 bp, Artificial Sequence
  sgRNA
  mm32418_Spire1
aggaaacacctacgaacgtg

SEQ ID NO: 4366 - DNA, 20 bp, Artificial Sequence
  sgRNA
  mm32419_Spire1
ctacgtactggatttaaagg

SEQ ID NO: 4367 - DNA, 20 bp, Artificial Sequence
  sgRNA
  mm32420_Spire1
gtgcctccgactcagttggg

SEQ ID NO: 4368 - DNA, 20 bp, Artificial Sequence
  sgRNA
  mm32421_Spire1
gatgagggatttgcgaaatg

SEQ ID NO: 4369 - DNA, 20 bp, Artificial Sequence
  sgRNA
  mm32666_Stt3b
agggtacatatctcggtcag

SEQ ID NO: 4370 - DNA, 20 bp, Artificial Sequence
  sgRNA
  mm32667_Stt3b
cgacagcatgcagacgaccg

SEQ ID NO: 4371 - DNA, 20 bp, Artificial Sequence
  sgRNA
  mm32668_Stt3b
gtcatctatctgacatacac

SEQ ID NO: 4372 - DNA, 20 bp, Artificial Sequence
  sgRNA
  mm32669_Stt3b
tacagcaagagagtctacat

SEQ ID NO: 4373 - DNA, 20 bp, Artificial Sequence
  sgRNA
  mm32830_Lmbrd1
ttacaaacagcaacgcaacg

SEQ ID NO: 4374 - DNA, 20 bp, Artificial Sequence
  sgRNA
  mm32831_Lmbrd1
aaggcacgtctatccctcgc

SEQ ID NO: 4375 - DNA, 20 bp, Artificial Sequence
  sgRNA
  mm32832_Lmbrd1
catcatctgtttcaggcgta

SEQ ID NO: 4376 - DNA, 20 bp, Artificial Sequence
  sgRNA
  mm32833_Lmbrd1
aacggtattctcaatctgta

SEQ ID NO: 4377 - DNA, 20 bp, Artificial Sequence
  sgRNA
  mm32850_Rpl34
ttctacaggttcgtgctgtg

SEQ ID NO: 4378 - DNA, 20 bp, Artificial Sequence
  sgRNA
  mm32851_Rpl34
aaagcacctaaatctgcatg

SEQ ID NO: 4379 - DNA, 20 bp, Artificial Sequence
  sgRNA
  mm32852_Rpl34
agcgtttgacataccgccgt

SEQ ID NO: 4380 - DNA, 20 bp, Artificial Sequence
  sgRNA
  mm32853_Rpl34
cttcctaggtctcgaacccc

SEQ ID NO: 4381 - DNA, 20 bp, Artificial Sequence
  sgRNA
  mm32866_Gpihbp1
gcaggtatcagtacaccaca

SEQ ID NO: 4382 - DNA, 20 bp, Artificial Sequence
  sgRNA
  mm32867_Gpihbp1
cactgtgcaatattccaccc

SEQ ID NO: 4383 - DNA, 20 bp, Artificial Sequence
  sgRNA
  mm32868_Gpihbp1
ctgtcaagtgcttcacagcg

SEQ ID NO: 4384 - DNA, 20 bp, Artificial Sequence
  sgRNA
  mm32869_Gpihbp1
cctgcttccagggatcatgt

SEQ ID NO: 4385 - DNA, 20 bp, Artificial Sequence
  sgRNA
  mm32886_Ly6g6c
gtgacatcgagtatcagctg

SEQ ID NO: 4386 - DNA, 20 bp, Artificial Sequence
  sgRNA
  mm32887_Ly6g6c
tcgttgaagacctcccgaca

SEQ ID NO: 4387 - DNA, 20 bp, Artificial Sequence
  sgRNA
  mm32888_Ly6g6c
cctgcctctagggaagatgt

SEQ ID NO: 4388 - DNA, 20 bp, Artificial Sequence
  sgRNA
  mm32889_Ly6g6c
cgtttgttgtcaggcatttg

SEQ ID NO: 4389 - DNA, 20 bp, Artificial Sequence
  sgRNA
  mm32914_Mpzl1
ggatgcggtccttaccgaca

SEQ ID NO: 4390 - DNA, 20 bp, Artificial Sequence
  sgRNA
  mm32915_Mpzl1
tggacacattaggctccacg

SEQ ID NO: 4391 - DNA, 20 bp, Artificial Sequence
  sgRNA
  mm32916_Mpzl1
cacaactggatggttgacca

SEQ ID NO: 4392 - DNA, 20 bp, Artificial Sequence
  sgRNA
  mm32917_Mpzl1
gtgactcggtctttaaatgg

SEQ ID NO: 4393 - DNA, 20 bp, Artificial Sequence
  sgRNA
  mm33002_Evc2
cctttccctcaatgaccaag

SEQ ID NO: 4394 - DNA, 20 bp, Artificial Sequence
  sgRNA
  mm33003_Evc2
gatatttcaagagaagcccg

SEQ ID NO: 4395 - DNA, 20 bp, Artificial Sequence
  sgRNA
  mm33004_Evc2
accagagattaataaccagg

SEQ ID NO: 4396 - DNA, 20 bp, Artificial Sequence
  sgRNA
  mm33005_Evc2
ccttactctggaccaagccg

SEQ ID NO: 4397 - DNA, 20 bp, Artificial Sequence
  sgRNA
  mm33174_Tm2d3
aactacaatacttacgacac

SEQ ID NO: 4398 - DNA, 20 bp, Artificial Sequence
  sgRNA
  mm33175_Tm2d3
ggacaggaaaagcagcacgc

SEQ ID NO: 4399 - DNA, 20 bp, Artificial Sequence
  sgRNA
  mm33176_Tm2d3
gcgctgccgagggcaagcca

SEQ ID NO: 4400 - DNA, 20 bp, Artificial Sequence
  sgRNA
  mm33177_Tm2d3
gacacttcgtcatgtaagga

SEQ ID NO: 4401 - DNA, 20 bp, Artificial Sequence
  sgRNA
  mm33186_Abhd14a
acaggtgcagaatactgtgt

SEQ ID NO: 4402 - DNA, 20 bp, Artificial Sequence
  sgRNA
  mm33187_Abhd14a
aaagattcgagagttgcctc

SEQ ID NO: 4403 - DNA, 20 bp, Artificial Sequence
  sgRNA
  mm33188_Abhd14a
agcatttaattcccacacat

SEQ ID NO: 4404 - DNA, 20 bp, Artificial Sequence
  sgRNA
  mm33189_Abhd14a
cagacttcgcgactctggag

SEQ ID NO: 4405 - DNA, 20 bp, Artificial Sequence
  sgRNA
  mm33246_Slc44a2
atcaacaaccttgtacacgg

SEQ ID NO: 4406 - DNA, 20 bp, Artificial Sequence
  sgRNA
  mm33247_Slc44a2
gaacattacagatctagtgg

SEQ ID NO: 4407 - DNA, 20 bp, Artificial Sequence
  sgRNA
  mm33248_Slc44a2
ggtgaaacgcattacctgag

SEQ ID NO: 4408 - DNA, 20 bp, Artificial Sequence
  sgRNA
  mm33249_Slc44a2
tcaagtgcaggtacactcgg

SEQ ID NO: 4409 - DNA, 20 bp, Artificial Sequence
  sgRNA
  mm33426_Srpx2
atggtggttatgaacgccag

SEQ ID NO: 4410 - DNA, 20 bp, Artificial Sequence
  sgRNA
  mm33427_Srpx2
ttcaatgtgtaacaccatcg

SEQ ID NO: 4411 - DNA, 20 bp, Artificial Sequence
  sgRNA
  mm33428_Srpx2
tagaacagctatagtcacaa

SEQ ID NO: 4412 - DNA, 20 bp, Artificial Sequence
  sgRNA
  mm33429_Srpx2
cagaatctttcactaagggt

SEQ ID NO: 4413 - DNA, 20 bp, Artificial Sequence
  sgRNA
  mm33522_Lrrn4cl
ggcaacggtcatagtcgcaa

SEQ ID NO: 4414 - DNA, 20 bp, Artificial Sequence
  sgRNA
  mm33523_Lrrn4cl
caaaggacataagcaacccc

SEQ ID NO: 4415 - DNA, 20 bp, Artificial Sequence
  sgRNA
  mm33524_Lrrn4cl
ccagggtcaagatctgaggt

SEQ ID NO: 4416 - DNA, 20 bp, Artificial Sequence
  sgRNA
  mm33525_Lrrn4cl
tctgctttgggaaagcaacg

SEQ ID NO: 4417 - DNA, 20 bp, Artificial Sequence
  sgRNA
  mm33590_Disp1
gagggaccacgataggacag

SEQ ID NO: 4418 - DNA, 20 bp, Artificial Sequence
  sgRNA
  mm33591_Disp1
actcgaagttaaagacgact

SEQ ID NO: 4419 - DNA, 20 bp, Artificial Sequence
  sgRNA
  mm33592_Disp1
gacgtaattcaccaatatgg

SEQ ID NO: 4420 - DNA, 20 bp, Artificial Sequence
  sgRNA
  mm33593_Disp1
ggcgtagtcagccgtctttg

SEQ ID NO: 4421 - DNA, 20 bp, Artificial Sequence
  sgRNA
  mm34030_Cd209b
ccaaaaccccaaataccgag

SEQ ID NO: 4422 - DNA, 20 bp, Artificial Sequence
  sgRNA
  mm34031_Cd209b
tgggactggacattcctcct

SEQ ID NO: 4423 - DNA, 20 bp, Artificial Sequence
  sgRNA
  mm34032_Cd209b
gcttagaatcatcctttacc

SEQ ID NO: 4424 - DNA, 20 bp, Artificial Sequence
  sgRNA
  mm34033_Cd209b
agggaagaatgagtccatgc

SEQ ID NO: 4425 - DNA, 20 bp, Artificial Sequence
  sgRNA
  mm34050_Tmem110
gagggcgcactgtcctaccc

SEQ ID NO: 4426 - DNA, 20 bp, Artificial Sequence
  sgRNA
  mm34051_Tmem110
ggcatgctgctcatttatgt

SEQ ID NO: 4427 - DNA, 20 bp, Artificial Sequence
  sgRNA
  mm34052_Tmem110
catgatctttgaaaagtccg

SEQ ID NO: 4428 - DNA, 20 bp, Artificial Sequence
  sgRNA
  mm34053_Tmem110
gagaaccaaagcatgaaaga

SEQ ID NO: 4429 - DNA, 20 bp, Artificial Sequence
  sgRNA
  mm34122_Carkd
taggccaggtcccacgacaa

SEQ ID NO: 4430 - DNA, 20 bp, Artificial Sequence
  sgRNA
  mm34123_Carkd
ctgacgtcgaagaagcacaa

SEQ ID NO: 4431 - DNA, 20 bp, Artificial Sequence
  sgRNA
  mm34124_Carkd
cattctcacccccaaccacg

SEQ ID NO: 4432 - DNA, 20 bp, Artificial Sequence
  sgRNA
  mm34125_Carkd
ccatacagcacatgcgacaa

SEQ ID NO: 4433 - DNA, 20 bp, Artificial Sequence
  sgRNA
  mm34526_Esam
acctactgctcagtaccagt

SEQ ID NO: 4434 - DNA, 20 bp, Artificial Sequence
  sgRNA
  mm34527_Esam
tctgcacattgacagaacag

SEQ ID NO: 4435 - DNA, 20 bp, Artificial Sequence
  sgRNA
  mm34528_Esam
ggagtcatgacaaataaacc

SEQ ID NO: 4436 - DNA, 20 bp, Artificial Sequence
  sgRNA
  mm34529_Esam
gtcgtggtcccacccccggg

SEQ ID NO: 4437 - DNA, 20 bp, Artificial Sequence
  sgRNA
  mm34554_Dnase1l1
gaagcaccatgatatcacat

SEQ ID NO: 4438 - DNA, 20 bp, Artificial Sequence
  sgRNA
  mm34555_Dnase1l1
tgagcaggggagccataaca

SEQ ID NO: 4439 - DNA, 20 bp, Artificial Sequence
  sgRNA
  mm34556_Dnase1l1
tcctaaacagctcattgctg

SEQ ID NO: 4440 - DNA, 20 bp, Artificial Sequence
  sgRNA
  mm34557_Dnase1l1
agagtgaaatgggccacaaa

SEQ ID NO: 4441 - DNA, 20 bp, Artificial Sequence
  sgRNA
  mm34558_Antxr1
acatgcacgaaggattcgag

SEQ ID NO: 4442 - DNA, 20 bp, Artificial Sequence
  sgRNA
  mm34559_Antxr1
tgaaccatccaccatctgcg

SEQ ID NO: 4443 - DNA, 20 bp, Artificial Sequence
  sgRNA
  mm34560_Antxr1
tgaaggacatccttagctgt

SEQ ID NO: 4444 - DNA, 20 bp, Artificial Sequence
  sgRNA
  mm34561_Antxr1
ctgctcatcccatagtcaga

SEQ ID NO: 4445 - DNA, 20 bp, Artificial Sequence
  sgRNA
  mm34598_Bst2
cgccgtcacagcgaacagcg

SEQ ID NO: 4446 - DNA, 20 bp, Artificial Sequence
  sgRNA
  mm34599_Bst2
ccgtgcccatggatgagatg

SEQ ID NO: 4447 - DNA, 20 bp, Artificial Sequence
  sgRNA
  mm34600_Bst2
aaactcctgcaacctgaccg

SEQ ID NO: 4448 - DNA, 20 bp, Artificial Sequence
  sgRNA
  mm34601_Bst2
ctggcgctgcaacaggtgcg

SEQ ID NO: 4449 - DNA, 20 bp, Artificial Sequence
  sgRNA
  mm34634_Hilpda
acatgatgcccagcacatag

SEQ ID NO: 4450 - DNA, 20 bp, Artificial Sequence
  sgRNA
  mm34635_Hilpda
gttagagtgatggagtctct

SEQ ID NO: 4451 - DNA, 20 bp, Artificial Sequence
  sgRNA
  mm34636_Hilpda
gggagctcctggatcacgag

SEQ ID NO: 4452 - DNA, 20 bp, Artificial Sequence
  sgRNA
  mm34637_Hilpda
ctccatcactctaacaaaga

SEQ ID NO: 4453 - DNA, 20 bp, Artificial Sequence
  sgRNA
  mm34658_Tnfsf13
tcaaccaaagagcaaccgaa

SEQ ID NO: 4454 - DNA, 20 bp, Artificial Sequence
  sgRNA
  mm34659_Tnfsf13
ggcaaccagtacttaggcgt

SEQ ID NO: 4455 - DNA, 20 bp, Artificial Sequence
  sgRNA
  mm34660_Tnfsf13
atggggcgaaatctcggaga

SEQ ID NO: 4456 - DNA, 20 bp, Artificial Sequence
  sgRNA
  mm34661_Tnfsf13
gctgcaaagcctaaggcggg

SEQ ID NO: 4457 - DNA, 20 bp, Artificial Sequence
  sgRNA
  mm34662_Hfe2
ggctcaccggacacgccgcg

SEQ ID NO: 4458 - DNA, 20 bp, Artificial Sequence
  sgRNA
  mm34663_Hfe2
gttggctcccgacgaaaccg

SEQ ID NO: 4459 - DNA, 20 bp, Artificial Sequence
  sgRNA
  mm34664_Hfe2
ctatgccatgcaccgcagag

SEQ ID NO: 4460 - DNA, 20 bp, Artificial Sequence
  sgRNA
  mm34665_Hfe2
acaaactcgagcccccaggt

SEQ ID NO: 4461 - DNA, 20 bp, Artificial Sequence
  sgRNA
  mm34758_Cd164l2
cgtttggcctactacccaag

SEQ ID NO: 4462 - DNA, 20 bp, Artificial Sequence
  sgRNA
  mm34759_Cd164l2
attaccagctagaaccagct

SEQ ID NO: 4463 - DNA, 20 bp, Artificial Sequence
  sgRNA
  mm34760_Cd164l2
tctcccaccaggacactgtg

SEQ ID NO: 4464 - DNA, 20 bp, Artificial Sequence
  sgRNA
  mm34761_Cd164l2
gggacactgtgaacactgtg

SEQ ID NO: 4465 - DNA, 20 bp, Artificial Sequence
  sgRNA
  mm34802_Txndc15
accaccatgggatctccgcg

SEQ ID NO: 4466 - DNA, 20 bp, Artificial Sequence
  sgRNA
  mm34803_Txndc15
ccaagtgttggaaacgcccg

SEQ ID NO: 4467 - DNA, 20 bp, Artificial Sequence
  sgRNA
  mm34804_Txndc15
ttgggtttaggaaatccatg

SEQ ID NO: 4468 - DNA, 20 bp, Artificial Sequence
  sgRNA
  mm34805_Txndc15
tgtgtatctgcatgaagagg

SEQ ID NO: 4469 - DNA, 20 bp, Artificial Sequence
  sgRNA
  mm34810_Pxdn
cagaagtataggacgcacga

SEQ ID NO: 4470 - DNA, 20 bp, Artificial Sequence
  sgRNA
  mm34811_Pxdn
tgatggtcaagaatccttcg

SEQ ID NO: 4471 - DNA, 20 bp, Artificial Sequence
  sgRNA
  mm34812_Pxdn
ccactgtgtatggatcccgt

SEQ ID NO: 4472 - DNA, 20 bp, Artificial Sequence
  sgRNA
  mm34813_Pxdn
gaatcagagagatccaaccc

SEQ ID NO: 4473 - DNA, 20 bp, Artificial Sequence
  sgRNA
  mm35242_Tmem30a
gacagaccaattgcgccatg

SEQ ID NO: 4474 - DNA, 20 bp, Artificial Sequence
  sgRNA
  mm35243_Tmem30a
caacaacatccgtgagatcg

SEQ ID NO: 4475 - DNA, 20 bp, Artificial Sequence
  sgRNA
  mm35244_Tmem30a
tacttacaagcaaagcacta

SEQ ID NO: 4476 - DNA, 20 bp, Artificial Sequence
  sgRNA
  mm35245_Tmem30a
caagcacaagatgtcacatt

SEQ ID NO: 4477 - DNA, 20 bp, Artificial Sequence
  sgRNA
  mm35266_Ace2
tgtagaacgtaccttcgcag

SEQ ID NO: 4478 - DNA, 20 bp, Artificial Sequence
  sgRNA
  mm35267_Ace2
acttgtacagatattacaca

SEQ ID NO: 4479 - DNA, 20 bp, Artificial Sequence
  sgRNA
  mm35268_Ace2
aatggatttcagatgcttgg

SEQ ID NO: 4480 - DNA, 20 bp, Artificial Sequence
  sgRNA
  mm35269_Ace2
gatgtgtcccatctcgtgat

SEQ ID NO: 4481 - DNA, 20 bp, Artificial Sequence
  sgRNA
  mm35418_Slc44a4
tgggcacgaggaattcaacg

SEQ ID NO: 4482 - DNA, 20 bp, Artificial Sequence
  sgRNA
  mm35419_Slc44a4
gatgtcgaagtatagaacgt

SEQ ID NO: 4483 - DNA, 20 bp, Artificial Sequence
  sgRNA
  mm35420_Slc44a4
tctccatccccagatagtgg

SEQ ID NO: 4484 - DNA, 20 bp, Artificial Sequence
  sgRNA
  mm35421_Slc44a4
agttggtagtgaagcccagt

SEQ ID NO: 4485 - DNA, 20 bp, Artificial Sequence
  sgRNA
  mm35618_Copb1
tcttgtcctaggatttaccg

SEQ ID NO: 4486 - DNA, 20 bp, Artificial Sequence
  sgRNA
  mm35619_Copb1
tagtaagagttacacaccac

SEQ ID NO: 4487 - DNA, 20 bp, Artificial Sequence
  sgRNA
  mm35620_Copb1
gatcattatgattctgaatg

SEQ ID NO: 4488 - DNA, 20 bp, Artificial Sequence
  sgRNA
  mm35621_Copb1
ctccgtaaccaatttctgaa

SEQ ID NO: 4489 - DNA, 20 bp, Artificial Sequence
  sgRNA
  mm35738_Megf10
gcgatgtccataaaaaccgg

SEQ ID NO: 4490 - DNA, 20 bp, Artificial Sequence
  sgRNA
  mm35739_Megf10
ccggacagcctaccgccacg

SEQ ID NO: 4491 - DNA, 20 bp, Artificial Sequence
  sgRNA
  mm35740_Megf10
tttatcccgtagcgtcccag

SEQ ID NO: 4492 - DNA, 20 bp, Artificial Sequence
  sgRNA
  mm35741_Megf10
tctttccaaagcgaccctca

SEQ ID NO: 4493 - DNA, 20 bp, Artificial Sequence
  sgRNA
  mm35754_Tspan15
ctgaacgacaacatccggag

SEQ ID NO: 4494 - DNA, 20 bp, Artificial Sequence
  sgRNA
  mm35755_Tspan15
atcactcacccagaacacgg

SEQ ID NO: 4495 - DNA, 20 bp, Artificial Sequence
  sgRNA
  mm35756_Tspan15
gtcagtggggatctacgcag

SEQ ID NO: 4496 - DNA, 20 bp, Artificial Sequence
  sgRNA
  mm35757_Tspan15
ctggtcatggagcttattgg

SEQ ID NO: 4497 - DNA, 20 bp, Artificial Sequence
  sgRNA
  mm35842_Atp6ap2
ttagcatattaagatcgcca

SEQ ID NO: 4498 - DNA, 20 bp, Artificial Sequence
  sgRNA
  mm35843_Atp6ap2
tgaacttgggaagcgttatg

SEQ ID NO: 4499 - DNA, 20 bp, Artificial Sequence
  sgRNA
  mm35844_Atp6ap2
ccggtggaataggttaccca

SEQ ID NO: 4500 - DNA, 20 bp, Artificial Sequence
  sgRNA
  mm35845_Atp6ap2
tggacagtgcagctacgtct

SEQ ID NO: 4501 - DNA, 20 bp, Artificial Sequence
  sgRNA
  mm35866_Stambp
gattacggggcaccacgatg

SEQ ID NO: 4502 - DNA, 20 bp, Artificial Sequence
  sgRNA
  mm35867_Stambp
ttacagtctggagtctgcgt

SEQ ID NO: 4503 - DNA, 20 bp, Artificial Sequence
  sgRNA
  mm35868_Stambp
tgagcagtataaagagcgaa

SEQ ID NO: 4504 - DNA, 20 bp, Artificial Sequence
  sgRNA
  mm35869_Stambp
gagcgtcgctttccctaaag

SEQ ID NO: 4505 - DNA, 20 bp, Artificial Sequence
  sgRNA
  mm35870_Lrfn2
tggaacctgtgatgtccgaa

SEQ ID NO: 4506 - DNA, 20 bp, Artificial Sequence
  sgRNA
  mm35871_Lrfn2
gcgacccttgagacttccgg

SEQ ID NO: 4507 - DNA, 20 bp, Artificial Sequence
  sgRNA
  mm35872_Lrfn2
gtcctccggtcaatgtcagg

SEQ ID NO: 4508 - DNA, 20 bp, Artificial Sequence
  sgRNA
  mm35873_Lrfn2
caaccggctacctagccttg

SEQ ID NO: 4509 - DNA, 20 bp, Artificial Sequence
  sgRNA
  mm35894_Tmtc4
atggacagcaaacagcaacg

SEQ ID NO: 4510 - DNA, 20 bp, Artificial Sequence
  sgRNA
  mm35895_Tmtc4
attaactactacctgtccgg

SEQ ID NO: 4511 - DNA, 20 bp, Artificial Sequence
  sgRNA
  mm35896_Tmtc4
ccagtcagacacgccccttg

SEQ ID NO: 4512 - DNA, 20 bp, Artificial Sequence
  sgRNA
  mm35897_Tmtc4
caaggtaccttagcattgag

SEQ ID NO: 4513 - DNA, 20 bp, Artificial Sequence
  sgRNA
  mm35934_Cpm
gttgtcccgaagcttaaccc

SEQ ID NO: 4514 - DNA, 20 bp, Artificial Sequence
  sgRNA
  mm35935_Cpm
ggacggcttcgaatccatcg

SEQ ID NO: 4515 - DNA, 20 bp, Artificial Sequence
  sgRNA
  mm35936_Cpm
gtagccgttgataatcccgt

SEQ ID NO: 4516 - DNA, 20 bp, Artificial Sequence
  sgRNA
  mm35937_Cpm
aaatacgtggcgaatatgca

SEQ ID NO: 4517 - DNA, 20 bp, Artificial Sequence
  sgRNA
  mm36062_Adgra2
aacatcaccaccattcagtg

SEQ ID NO: 4518 - DNA, 20 bp, Artificial Sequence
  sgRNA
  mm36063_Adgra2
tgtggcaagcaacatcatgt

SEQ ID NO: 4519 - DNA, 20 bp, Artificial Sequence
  sgRNA
  mm36064_Adgra2
gtcatgttcagacgaaacgt

SEQ ID NO: 4520 - DNA, 20 bp, Artificial Sequence
  sgRNA
  mm36065_Adgra2
aatgagctggagcttataga

SEQ ID NO: 4521 - DNA, 20 bp, Artificial Sequence
  sgRNA
  mm36110_Tspan2
cacacactgtgactcacgca

SEQ ID NO: 4522 - DNA, 20 bp, Artificial Sequence
  sgRNA
  mm36111_Tspan2
tgtacagagcatgtatgagg

SEQ ID NO: 4523 - DNA, 20 bp, Artificial Sequence
  sgRNA
  mm36112_Tspan2
tcgatttggaggtaccatga

SEQ ID NO: 4524 - DNA, 20 bp, Artificial Sequence
  sgRNA
  mm36113_Tspan2
taccttaaagacagggcaag

SEQ ID NO: 4525 - DNA, 20 bp, Artificial Sequence
  sgRNA
  mm36226_P2ry12
atatcagtatatcgttcctg

SEQ ID NO: 4526 - DNA, 20 bp, Artificial Sequence
  sgRNA
  mm36227_P2ry12
tggcacaccaaggttctcag

SEQ ID NO: 4527 - DNA, 20 bp, Artificial Sequence
  sgRNA
  mm36228_P2ry12
cttgtagtctctgacgcaca

SEQ ID NO: 4528 - DNA, 20 bp, Artificial Sequence
  sgRNA
  mm36229_P2ry12
tcattaccaaagaactctat

SEQ ID NO: 4529 - DNA, 20 bp, Artificial Sequence
  sgRNA
  mm36346_Mmrn1
agtgtccagtatcactgtcg

SEQ ID NO: 4530 - DNA, 20 bp, Artificial Sequence
  sgRNA
  mm36347_Mmrn1
gaatgatttgacatatgaca

SEQ ID NO: 4531 - DNA, 20 bp, Artificial Sequence
  sgRNA
  mm36348_Mmrn1
agtcacaccgctgttgacca

SEQ ID NO: 4532 - DNA, 20 bp, Artificial Sequence
  sgRNA
  mm36349_Mmrn1
tgcaagaaaatcagcccacg

SEQ ID NO: 4533 - DNA, 20 bp, Artificial Sequence
  sgRNA
  mm36522_Gpr39
gtaaacgtacccactcacaa

SEQ ID NO: 4534 - DNA, 20 bp, Artificial Sequence
  sgRNA
  mm36523_Gpr39
ttacaggacagagcatagct

SEQ ID NO: 4535 - DNA, 20 bp, Artificial Sequence
  sgRNA
  mm36524_Gpr39
cgtcaccatcagggttacgc

SEQ ID NO: 4536 - DNA, 20 bp, Artificial Sequence
  sgRNA
  mm36525_Gpr39
agacctcccaacggttggag

SEQ ID NO: 4537 - DNA, 20 bp, Artificial Sequence
  sgRNA
  mm36546_Scara5
taggtccatgtcacaaacgg

SEQ ID NO: 4538 - DNA, 20 bp, Artificial Sequence
  sgRNA
  mm36547_Scara5
ctggtagagttccagctgtg

SEQ ID NO: 4539 - DNA, 20 bp, Artificial Sequence
  sgRNA
  mm36548_Scara5
cagcgccttcaagtcatctg

SEQ ID NO: 4540 - DNA, 20 bp, Artificial Sequence
  sgRNA
  mm36549_Scara5
gggaacactccatcgccttg

SEQ ID NO: 4541 - DNA, 20 bp, Artificial Sequence
  sgRNA
  mm36598_Clec12b
aagtcaaattaccagaagcg

SEQ ID NO: 4542 - DNA, 20 bp, Artificial Sequence
  sgRNA
  mm36599_Clec12b
gctgtcaatcttcaccagag

SEQ ID NO: 4543 - DNA, 20 bp, Artificial Sequence
  sgRNA
  mm36600_Clec12b
ggcagcgcctcgccaaagtg

SEQ ID NO: 4544 - DNA, 20 bp, Artificial Sequence
  sgRNA
  mm36601_Clec12b
aggactctgcaagagtgagg

SEQ ID NO: 4545 - DNA, 20 bp, Artificial Sequence
  sgRNA
  mm36682_Mfap3l
catgggcgtgtactatatgg

SEQ ID NO: 4546 - DNA, 20 bp, Artificial Sequence
  sgRNA
  mm36683_Mfap3l
ggtgactgctcatcatacac

SEQ ID NO: 4547 - DNA, 20 bp, Artificial Sequence
  sgRNA
  mm36684_Mfap3l
gaactgcaggacgatcatgg

SEQ ID NO: 4548 - DNA, 20 bp, Artificial Sequence
  sgRNA
  mm36685_Mfap3l
gaagcatccgagtcagcggt

SEQ ID NO: 4549 - DNA, 20 bp, Artificial Sequence
  sgRNA
  mm36702_Treml1
acctggtggaagaaccaaca

SEQ ID NO: 4550 - DNA, 20 bp, Artificial Sequence
  sgRNA
  mm36703_Treml1
tcacgccgtctgaactcgtg

SEQ ID NO: 4551 - DNA, 20 bp, Artificial Sequence
  sgRNA
  mm36704_Treml1
cccactagtgacctcagcgg

SEQ ID NO: 4552 - DNA, 20 bp, Artificial Sequence
  sgRNA
  mm36705_Treml1
ctcagctgacagtcatcccg

SEQ ID NO: 4553 - DNA, 20 bp, Artificial Sequence
  sgRNA
  mm36722_Ano9
tcccggaagtaccatgaaca

SEQ ID NO: 4554 - DNA, 20 bp, Artificial Sequence
  sgRNA
  mm36723_Ano9
agccactcagaaagacgatg

SEQ ID NO: 4555 - DNA, 20 bp, Artificial Sequence
  sgRNA
  mm36724_Ano9
tgaagaatatatgggctcgg

SEQ ID NO: 4556 - DNA, 20 bp, Artificial Sequence
  sgRNA
  mm36725_Ano9
ccaggcgcgtggatttccca

SEQ ID NO: 4557 - DNA, 20 bp, Artificial Sequence
  sgRNA
  mm36838_Ptk7
gagcgtacaactgtgtacca

SEQ ID NO: 4558 - DNA, 20 bp, Artificial Sequence
  sgRNA
  mm36839_Ptk7
tgttgttgtagcaaggaacg

SEQ ID NO: 4559 - DNA, 20 bp, Artificial Sequence
  sgRNA
  mm36840_Ptk7
cttgcgcatcaatagtgtgg

SEQ ID NO: 4560 - DNA, 20 bp, Artificial Sequence
  sgRNA
  mm36841_Ptk7
tgtctgtcacccattcaggg

SEQ ID NO: 4561 - DNA, 20 bp, Artificial Sequence
  sgRNA
  mm36914_Clmp
tgtctacaataacttgaccg

SEQ ID NO: 4562 - DNA, 20 bp, Artificial Sequence
  sgRNA
  mm36915_Clmp
cctacagattacaacaaccc

SEQ ID NO: 4563 - DNA, 20 bp, Artificial Sequence
  sgRNA
  mm36916_Clmp
ccagtgcacagcaggcaacg

SEQ ID NO: 4564 - DNA, 20 bp, Artificial Sequence
  sgRNA
  mm36917_Clmp
tgtgcagagcattggcatgg

SEQ ID NO: 4565 - DNA, 20 bp, Artificial Sequence
  sgRNA
  mm37026_Atp5h
tacagcatactgacctggcg

SEQ ID NO: 4566 - DNA, 20 bp, Artificial Sequence
  sgRNA
  mm37027_Atp5h
cctgaagattcctgtgcctg

SEQ ID NO: 4567 - DNA, 20 bp, Artificial Sequence
  sgRNA
  mm37028_Atp5h
cacagccctggtggaccagg

SEQ ID NO: 4568 - DNA, 20 bp, Artificial Sequence
  sgRNA
  mm37029_Atp5h
ggcttactacagggccaatg

SEQ ID NO: 4569 - DNA, 20 bp, Artificial Sequence
  sgRNA
  mm37150_Susd2
ggccggcgcttcatataacg

SEQ ID NO: 4570 - DNA, 20 bp, Artificial Sequence
  sgRNA
  mm37151_Susd2
ctgcccggaagtcgtcaccc

SEQ ID NO: 4571 - DNA, 20 bp, Artificial Sequence
  sgRNA
  mm37152_Susd2
agtgccgtagtattgccaat

SEQ ID NO: 4572 - DNA, 20 bp, Artificial Sequence
  sgRNA
  mm37153_Susd2
aagtgaagaagccggtattg

SEQ ID NO: 4573 - DNA, 20 bp, Artificial Sequence
  sgRNA
  mm37286_Anxa9
tgtggactatgataccattg

SEQ ID NO: 4574 - DNA, 20 bp, Artificial Sequence
  sgRNA
  mm37287_Anxa9
gaaactcaagaacgtcctga

SEQ ID NO: 4575 - DNA, 20 bp, Artificial Sequence
  sgRNA
  mm37288_Anxa9
tggcaatctggagaaaatcg

SEQ ID NO: 4576 - DNA, 20 bp, Artificial Sequence
  sgRNA
  mm37289_Anxa9
tgagaccaatggtatcctgc

SEQ ID NO: 4577 - DNA, 20 bp, Artificial Sequence
  sgRNA
  mm37498_Apmap
gaaactctgaggatctatgg

SEQ ID NO: 4578 - DNA, 20 bp, Artificial Sequence
  sgRNA
  mm37499_Apmap
gagaaatagagaccatcgct

SEQ ID NO: 4579 - DNA, 20 bp, Artificial Sequence
  sgRNA
  mm37500_Apmap
gaatccatagtaaatattgg

SEQ ID NO: 4580 - DNA, 20 bp, Artificial Sequence
  sgRNA
  mm37501_Apmap
agttgtaacatacgtttctg

SEQ ID NO: 4581 - DNA, 20 bp, Artificial Sequence
  sgRNA
  mm37546_Tmem106b
ttcagcgtcgtagctgacat

SEQ ID NO: 4582 - DNA, 20 bp, Artificial Sequence
  sgRNA
  mm37547_Tmem106b
aaaacacagccaatccagac

SEQ ID NO: 4583 - DNA, 20 bp, Artificial Sequence
  sgRNA
  mm37548_Tmem106b
agtgaagtgcacaacgaaga

SEQ ID NO: 4584 - DNA, 20 bp, Artificial Sequence
  sgRNA
  mm37549_Tmem106b
ttcaaaaaccgtgattggaa

SEQ ID NO: 4585 - DNA, 20 bp, Artificial Sequence
  sgRNA
  mm37594_Antxr2
gtcacgtcgatcagtcacga

SEQ ID NO: 4586 - DNA, 20 bp, Artificial Sequence
  sgRNA
  mm37595_Antxr2
cagtacgaagtacaaatcga

SEQ ID NO: 4587 - DNA, 20 bp, Artificial Sequence
  sgRNA
  mm37596_Antxr2
ttgacggacggtaagctgga

SEQ ID NO: 4588 - DNA, 20 bp, Artificial Sequence
  sgRNA
  mm37597_Antxr2
caaaattggcaaaggactgg

SEQ ID NO: 4589 - DNA, 20 bp, Artificial Sequence
  sgRNA
  mm37622_Itfg1
caaccgcagatactgctagg

SEQ ID NO: 4590 - DNA, 20 bp, Artificial Sequence
  sgRNA
  mm37623_Itfg1
gagtgcgttggtaacaagtg

SEQ ID NO: 4591 - DNA, 20 bp, Artificial Sequence
  sgRNA
  mm37624_Itfg1
aaaacctaaaaatctggtgg

SEQ ID NO: 4592 - DNA, 20 bp, Artificial Sequence
  sgRNA
  mm37625_Itfg1
cctcaactccgacaaacaga

SEQ ID NO: 4593 - DNA, 20 bp, Artificial Sequence
  sgRNA
  mm37626_Tmem123
gaggcagtaggcgtcacatg

SEQ ID NO: 4594 - DNA, 20 bp, Artificial Sequence
  sgRNA
  mm37627_Tmem123
caggacccgaccgacgctca

SEQ ID NO: 4595 - DNA, 20 bp, Artificial Sequence
  sgRNA
  mm37628_Tmem123
caataaactactgtgggctg

SEQ ID NO: 4596 - DNA, 20 bp, Artificial Sequence
  sgRNA
  mm37629_Tmem123
taccaaccagaccatgagtg

SEQ ID NO: 4597 - DNA, 20 bp, Artificial Sequence
  sgRNA
  mm37802_Synpr
aagtaccgcgaaaacaaccg

SEQ ID NO: 4598 - DNA, 20 bp, Artificial Sequence
  sgRNA
  mm37803_Synpr
ggtgacaaagaattctgctg

SEQ ID NO: 4599 - DNA, 20 bp, Artificial Sequence
  sgRNA
  mm37804_Synpr
gcagccttccaacaagtgca

SEQ ID NO: 4600 - DNA, 20 bp, Artificial Sequence
  sgRNA
  mm37805_Synpr
ctcacaggtgggcacttcaa

SEQ ID NO: 4601 - DNA, 20 bp, Artificial Sequence
  sgRNA
  mm37810_Zfyve19
agtgccacacaatcctgacc

SEQ ID NO: 4602 - DNA, 20 bp, Artificial Sequence
  sgRNA
  mm37811_Zfyve19
ctggacttcatccttcagtg

SEQ ID NO: 4603 - DNA, 20 bp, Artificial Sequence
  sgRNA
  mm37812_Zfyve19
agttacctgaggctcttggt

SEQ ID NO: 4604 - DNA, 20 bp, Artificial Sequence
  sgRNA
  mm37813_Zfyve19
ccacacactcaccggtctca

SEQ ID NO: 4605 - DNA, 20 bp, Artificial Sequence
  sgRNA
  mm37814_Btbd17
cttggcgtaatgcaacggcg

SEQ ID NO: 4606 - DNA, 20 bp, Artificial Sequence
  sgRNA
  mm37815_Btbd17
gcagctcagagagccgatgt

SEQ ID NO: 4607 - DNA, 20 bp, Artificial Sequence
  sgRNA
  mm37816_Btbd17
ccccggtgctaacagcgtag

SEQ ID NO: 4608 - DNA, 20 bp, Artificial Sequence
  sgRNA
  mm37817_Btbd17
cgagtagcatccttgcagcg

SEQ ID NO: 4609 - DNA, 20 bp, Artificial Sequence
  sgRNA
  mm37846_Slc39a4
ggtcctgaatacggatagtg

SEQ ID NO: 4610 - DNA, 20 bp, Artificial Sequence
  sgRNA
  mm37847_Slc39a4
cagttggggaagatctacac

SEQ ID NO: 4611 - DNA, 20 bp, Artificial Sequence
  sgRNA
  mm37848_Slc39a4
catgcagcgtgatattggga

SEQ ID NO: 4612 - DNA, 20 bp, Artificial Sequence
  sgRNA
  mm37849_Slc39a4
tggagagggtcacacccatg

SEQ ID NO: 4613 - DNA, 20 bp, Artificial Sequence
  sgRNA
  mm37870_Sulf2
gacggtgagatataccacgt

SEQ ID NO: 4614 - DNA, 20 bp, Artificial Sequence
  sgRNA
  mm37871_Sulf2
acaaatgtaaaggccccatg

SEQ ID NO: 4615 - DNA, 20 bp, Artificial Sequence
  sgRNA
  mm37872_Sulf2
acatggctcagactactcca

SEQ ID NO: 4616 - DNA, 20 bp, Artificial Sequence
  sgRNA
  mm37873_Sulf2
gcacattggtgtagtcacga

SEQ ID NO: 4617 - DNA, 20 bp, Artificial Sequence
  sgRNA
  mm37886_Tnfrsf13c
cagactcactagacccacca

SEQ ID NO: 4618 - DNA, 20 bp, Artificial Sequence
  sgRNA
  mm37887_Tnfrsf13c
gacacgcagtttctcaccag

SEQ ID NO: 4619 - DNA, 20 bp, Artificial Sequence
  sgRNA
  mm37888_Tnfrsf13c
ctccgcgctgagacccgacg

SEQ ID NO: 4620 - DNA, 20 bp, Artificial Sequence
  sgRNA
  mm37889_Tnfrsf13c
gcactcggtctgattgcact

SEQ ID NO: 4621 - DNA, 20 bp, Artificial Sequence
  sgRNA
  mm37890_Kdelc1
acccgggctaaaagcacacg

SEQ ID NO: 4622 - DNA, 20 bp, Artificial Sequence
  sgRNA
  mm37891_Kdelc1
agatagaggttaaacaccat

SEQ ID NO: 4623 - DNA, 20 bp, Artificial Sequence
  sgRNA
  mm37892_Kdelc1
tgtcggtgcaagctaacaca

SEQ ID NO: 4624 - DNA, 20 bp, Artificial Sequence
  sgRNA
  mm37893_Kdelc1
gatgagcagttcacgagagt

SEQ ID NO: 4625 - DNA, 20 bp, Artificial Sequence
  sgRNA
  mm37914_Igsf5
aacagtcctaaaggactcag

SEQ ID NO: 4626 - DNA, 20 bp, Artificial Sequence
  sgRNA
  mm37915_Igsf5
gtggactcttaaccaaatgg

SEQ ID NO: 4627 - DNA, 20 bp, Artificial Sequence
  sgRNA
  mm37916_Igsf5
agtgctgttgtaactggcat

SEQ ID NO: 4628 - DNA, 20 bp, Artificial Sequence
  sgRNA
  mm37917_Igsf5
tcttgtagacagtattggag

SEQ ID NO: 4629 - DNA, 20 bp, Artificial Sequence
  sgRNA
  mm38114_Dhx36
agggtcgcgagatcggcctg

SEQ ID NO: 4630 - DNA, 20 bp, Artificial Sequence
  sgRNA
  mm38115_Dhx36
cagcgtatataaaggaactg

SEQ ID NO: 4631 - DNA, 20 bp, Artificial Sequence
  sgRNA
  mm38116_Dhx36
tgtccaatgatacatatacc

SEQ ID NO: 4632 - DNA, 20 bp, Artificial Sequence
  sgRNA
  mm38117_Dhx36
gcctaccgtcaaccagacac

SEQ ID NO: 4633 - DNA, 20 bp, Artificial Sequence
  sgRNA
  mm38134_Mfsd8
agcaatgtatgatcggacaa

SEQ ID NO: 4634 - DNA, 20 bp, Artificial Sequence
  sgRNA
  mm38135_Mfsd8
tggaccgagaataaagccca

SEQ ID NO: 4635 - DNA, 20 bp, Artificial Sequence
  sgRNA
  mm38136_Mfsd8
ggatatgtacgcctggaccc

SEQ ID NO: 4636 - DNA, 20 bp, Artificial Sequence
  sgRNA
  mm38137_Mfsd8
gagcatcgtgtggatgactt

SEQ ID NO: 4637 - DNA, 20 bp, Artificial Sequence
  sgRNA
  mm38346_Plxdc1
attgtcaaagtaagcaaccg

SEQ ID NO: 4638 - DNA, 20 bp, Artificial Sequence
  sgRNA
  mm38347_Plxdc1
actctgcatggactgccaag

SEQ ID NO: 4639 - DNA, 20 bp, Artificial Sequence
  sgRNA
  mm38348_Plxdc1
ggttagattcgaggacacgc

SEQ ID NO: 4640 - DNA, 20 bp, Artificial Sequence
  sgRNA
  mm38349_Plxdc1
tgtggatcttcacatgactc

SEQ ID NO: 4641 - DNA, 20 bp, Artificial Sequence
  sgRNA
  mm38410_Psca
gataactgtcacgagtccaa

SEQ ID NO: 4642 - DNA, 20 bp, Artificial Sequence
  sgRNA
  mm38411_Psca
gcgatgtaaagcaactgtgc

SEQ ID NO: 4643 - DNA, 20 bp, Artificial Sequence
  sgRNA
  mm38412_Psca
ctcgtgacagttatcagtaa

SEQ ID NO: 4644 - DNA, 20 bp, Artificial Sequence
  sgRNA
  mm38413_Psca
acctacttagccctgcatcc

SEQ ID NO: 4645 - DNA, 20 bp, Artificial Sequence
  sgRNA
  mm38446_Slc43a1
ggatatccctggtacctcag

SEQ ID NO: 4646 - DNA, 20 bp, Artificial Sequence
  sgRNA
  mm38447_Slc43a1
ctgacccacaatggttacat

SEQ ID NO: 4647 - DNA, 20 bp, Artificial Sequence
  sgRNA
  mm38448_Slc43a1
cttaacgtttacctcactca

SEQ ID NO: 4648 - DNA, 20 bp, Artificial Sequence
  sgRNA
  mm38449_Slc43a1
cggtccatgagaattcccag

SEQ ID NO: 4649 - DNA, 20 bp, Artificial Sequence
  sgRNA
  mm38526_Tmem87b
gcagatactcacattcaatg

SEQ ID NO: 4650 - DNA, 20 bp, Artificial Sequence
  sgRNA
  mm38527_Tmem87b
caatgattaccctgatctgg

SEQ ID NO: 4651 - DNA, 20 bp, Artificial Sequence
  sgRNA
  mm38528_Tmem87b
gatgcagagatgtacccatg

SEQ ID NO: 4652 - DNA, 20 bp, Artificial Sequence
  sgRNA
  mm38529_Tmem87b
tgcatcactgttcctaagcg

SEQ ID NO: 4653 - DNA, 20 bp, Artificial Sequence
  sgRNA
  mm38566_Rps6kb1
acttcgggtacttggtaaag

SEQ ID NO: 4654 - DNA, 20 bp, Artificial Sequence
  sgRNA
  mm38567_Rps6kb1
tattcatggaagacacagcg

SEQ ID NO: 4655 - DNA, 20 bp, Artificial Sequence
  sgRNA
  mm38568_Rps6kb1
ctcttagcctccattcactg

SEQ ID NO: 4656 - DNA, 20 bp, Artificial Sequence
  sgRNA
  mm38569_Rps6kb1
aatgatagtgaggaatgcta

SEQ ID NO: 4657 - DNA, 20 bp, Artificial Sequence
  sgRNA
  mm38626_Naalad2
agagaacatcgtaatgaacc

SEQ ID NO: 4658 - DNA, 20 bp, Artificial Sequence
  sgRNA
  mm38627_Naalad2
gagggattgaccctaccact

SEQ ID NO: 4659 - DNA, 20 bp, Artificial Sequence
  sgRNA
  mm38628_Naalad2
tgtcaactacgctcgtactg

SEQ ID NO: 4660 - DNA, 20 bp, Artificial Sequence
  sgRNA
  mm38629_Naalad2
caaaaatgccatgctagctg

SEQ ID NO: 4661 - DNA, 20 bp, Artificial Sequence
  sgRNA
  mm38774_Calhm2
tccatacaggtagttccggg

SEQ ID NO: 4662 - DNA, 20 bp, Artificial Sequence
  sgRNA
  mm38775_Calhm2
caacctatcgagcttccgag

SEQ ID NO: 4663 - DNA, 20 bp, Artificial Sequence
  sgRNA
  mm38776_Calhm2
ccccccagcccatgctacgg

SEQ ID NO: 4664 - DNA, 20 bp, Artificial Sequence
  sgRNA
  mm38777_Calhm2
tagtcgccgagtgccagtac

SEQ ID NO: 4665 - DNA, 20 bp, Artificial Sequence
  sgRNA
  mm38814_B3gat3
ggactcgcggtgtctcagtg

SEQ ID NO: 4666 - DNA, 20 bp, Artificial Sequence
  sgRNA
  mm38815_B3gat3
tctacactggctgctagtgg

SEQ ID NO: 4667 - DNA, 20 bp, Artificial Sequence
  sgRNA
  mm38816_B3gat3
aatgacatagatagtaggca

SEQ ID NO: 4668 - DNA, 20 bp, Artificial Sequence
  sgRNA
  mm38817_B3gat3
acggagatcagcttgcaact

SEQ ID NO: 4669 - DNA, 20 bp, Artificial Sequence
  sgRNA
  mm38902_Scn2b
ctgacacgtcgtacttactg

SEQ ID NO: 4670 - DNA, 20 bp, Artificial Sequence
  sgRNA
  mm38903_Scn2b
agttaagagagaactgcttg

SEQ ID NO: 4671 - DNA, 20 bp, Artificial Sequence
  sgRNA
  mm38904_Scn2b
ggagtgtaacaattgcacag

SEQ ID NO: 4672 - DNA, 20 bp, Artificial Sequence
  sgRNA
  mm38905_Scn2b
ttgaggacactaagagtggt

SEQ ID NO: 4673 - DNA, 20 bp, Artificial Sequence
  sgRNA
  mm38982_Hepacam
cactgacgacaccttcaccg

SEQ ID NO: 4674 - DNA, 20 bp, Artificial Sequence
  sgRNA
  mm38983_Hepacam
gcaccaagcctagctacacg

SEQ ID NO: 4675 - DNA, 20 bp, Artificial Sequence
  sgRNA
  mm38984_Hepacam
ggtgcagtctataggcacag

SEQ ID NO: 4676 - DNA, 20 bp, Artificial Sequence
  sgRNA
  mm38985_Hepacam
ctcactgagctccagcacag

SEQ ID NO: 4677 - DNA, 20 bp, Artificial Sequence
  sgRNA
  mm39026_Slc17a7
tggcgatgatgtagcgacga

SEQ ID NO: 4678 - DNA, 20 bp, Artificial Sequence
  sgRNA
  mm39027_Slc17a7
ggaggagcgcaaatacattg

SEQ ID NO: 4679 - DNA, 20 bp, Artificial Sequence
  sgRNA
  mm39028_Slc17a7
gacacagccatagtgaacgc

SEQ ID NO: 4680 - DNA, 20 bp, Artificial Sequence
  sgRNA
  mm39029_Slc17a7
tccatcctgaatactgcaca

SEQ ID NO: 4681 - DNA, 20 bp, Artificial Sequence
  sgRNA
  mm39122_Slc22a23
gcccgatttctggtgccgcg

SEQ ID NO: 4682 - DNA, 20 bp, Artificial Sequence
  sgRNA
  mm39123_Slc22a23
tcgagaaagagctttcacgg

SEQ ID NO: 4683 - DNA, 20 bp, Artificial Sequence
  sgRNA
  mm39124_Slc22a23
aaattgcgactgccacgcgt

SEQ ID NO: 4684 - DNA, 20 bp, Artificial Sequence
  sgRNA
  mm39125_Slc22a23
aaaacggttcataattacca

SEQ ID NO: 4685 - DNA, 20 bp, Artificial Sequence
  sgRNA
  mm39230_Sppl2b
gccagtgatggactacaaca

SEQ ID NO: 4686 - DNA, 20 bp, Artificial Sequence
  sgRNA
  mm39231_Sppl2b
tccaatgatcacgtagactg

SEQ ID NO: 4687 - DNA, 20 bp, Artificial Sequence
  sgRNA
  mm39232_Sppl2b
cttcaccaaccaaatcgcac

SEQ ID NO: 4688 - DNA, 20 bp, Artificial Sequence
  sgRNA
  mm39233_Sppl2b
catcacccccttcctgacca

SEQ ID NO: 4689 - DNA, 20 bp, Artificial Sequence
  sgRNA
  mm39358_Nptxr
agaccgcatcgagcgcatcg

SEQ ID NO: 4690 - DNA, 20 bp, Artificial Sequence
  sgRNA
  mm39359_Nptxr
ggatggtgtcccggtctgcg

SEQ ID NO: 4691 - DNA, 20 bp, Artificial Sequence
  sgRNA
  mm39360_Nptxr
cagaggaagcgactgagcag

SEQ ID NO: 4692 - DNA, 20 bp, Artificial Sequence
  sgRNA
  mm39361_Nptxr
tcggccatggtgtcgcggcg

SEQ ID NO: 4693 - DNA, 20 bp, Artificial Sequence
  sgRNA
  mm39398_Dcbld2
gctgcagatagaccttaaca

SEQ ID NO: 4694 - DNA, 20 bp, Artificial Sequence
  sgRNA
  mm39399_Dcbld2
tggattccagccatacacaa

SEQ ID NO: 4695 - DNA, 20 bp, Artificial Sequence
  sgRNA
  mm39400_Dcbld2
aggttattgccgttccgagg

SEQ ID NO: 4696 - DNA, 20 bp, Artificial Sequence
  sgRNA
  mm39401_Dcbld2
gtcacagtgctgttcatgag

SEQ ID NO: 4697 - DNA, 20 bp, Artificial Sequence
  sgRNA
  mm39610_Defb30
agagcacgagggtcaactgt

SEQ ID NO: 4698 - DNA, 20 bp, Artificial Sequence
  sgRNA
  mm39611_Defb30
agagcaagacaaagagcacg

SEQ ID NO: 4699 - DNA, 20 bp, Artificial Sequence
  sgRNA
  mm39612_Defb30
aacggatttacgacacatgc

SEQ ID NO: 4700 - DNA, 20 bp, Artificial Sequence
  sgRNA
  mm39613_Defb30
ttgctctcctatgttccacc

SEQ ID NO: 4701 - DNA, 20 bp, Artificial Sequence
  sgRNA
  mm39674_Gucy2g
aagaaccaggaacgtcaccg

SEQ ID NO: 4702 - DNA, 20 bp, Artificial Sequence
  sgRNA
  mm39675_Gucy2g
aacatgtcgtatgtcgccag

SEQ ID NO: 4703 - DNA, 20 bp, Artificial Sequence
  sgRNA
  mm39676_Gucy2g
gggtggcacaagtgtcacgc

SEQ ID NO: 4704 - DNA, 20 bp, Artificial Sequence
  sgRNA
  mm39677_Gucy2g
agcaagtctcccaagaactg

SEQ ID NO: 4705 - DNA, 20 bp, Artificial Sequence
  sgRNA
  mm39722_Psd
gaagcaggtaggccattcag

SEQ ID NO: 4706 - DNA, 20 bp, Artificial Sequence
  sgRNA
  mm39723_Psd
gccagaatcaggttcaagag

SEQ ID NO: 4707 - DNA, 20 bp, Artificial Sequence
  sgRNA
  mm39724_Psd
attacactggaaatatcgct

SEQ ID NO: 4708 - DNA, 20 bp, Artificial Sequence
  sgRNA
  mm39725_Psd
ccttcctgaagccatcgagt

SEQ ID NO: 4709 - DNA, 20 bp, Artificial Sequence
  sgRNA
  mm39914_Psd2
gagggctcgagatagccccg

SEQ ID NO: 4710 - DNA, 20 bp, Artificial Sequence
  sgRNA
  mm39915_Psd2
ggcgaaccagatgtacgtga

SEQ ID NO: 4711 - DNA, 20 bp, Artificial Sequence
  sgRNA
  mm39916_Psd2
ccaggccattggtcaaagag

SEQ ID NO: 4712 - DNA, 20 bp, Artificial Sequence
  sgRNA
  mm39917_Psd2
aacttggaccagctgaacga

SEQ ID NO: 4713 - DNA, 20 bp, Artificial Sequence
  sgRNA
  mm39982_Nfam1
caggcaaacacatcagccac

SEQ ID NO: 4714 - DNA, 20 bp, Artificial Sequence
  sgRNA
  mm39983_Nfam1
gaggaaacatatcagagcga

SEQ ID NO: 4715 - DNA, 20 bp, Artificial Sequence
  sgRNA
  mm39984_Nfam1
ttcatacggatatccatggc

SEQ ID NO: 4716 - DNA, 20 bp, Artificial Sequence
  sgRNA
  mm39985_Nfam1
ccccaatgttcagtcaaaga

SEQ ID NO: 4717 - DNA, 20 bp, Artificial Sequence
  sgRNA
  mm40078_Slc35a5
attgaactataatcagaacg

SEQ ID NO: 4718 - DNA, 20 bp, Artificial Sequence
  sgRNA
  mm40079_Slc35a5
aagagacaattgtacatcga

SEQ ID NO: 4719 - DNA, 20 bp, Artificial Sequence
  sgRNA
  mm40080_Slc35a5
gattctgttcttgtctatcg

SEQ ID NO: 4720 - DNA, 20 bp, Artificial Sequence
  sgRNA
  mm40081_Slc35a5
ctctgagcacacgttcacag

SEQ ID NO: 4721 - DNA, 20 bp, Artificial Sequence
  sgRNA
  mm40182_Tm9sf1
tatttgccaatgtttcggtg

SEQ ID NO: 4722 - DNA, 20 bp, Artificial Sequence
  sgRNA
  mm40183_Tm9sf1
ccatgtagcccacaaaacca

SEQ ID NO: 4723 - DNA, 20 bp, Artificial Sequence
  sgRNA
  mm40184_Tm9sf1
ggacaaccaatggatttcca

SEQ ID NO: 4724 - DNA, 20 bp, Artificial Sequence
  sgRNA
  mm40185_Tm9sf1
gttcaacgtgcaccgtcacg

SEQ ID NO: 4725 - DNA, 20 bp, Artificial Sequence
  sgRNA
  mm40194_Robo4
gactatctgagctagcccag

SEQ ID NO: 4726 - DNA, 20 bp, Artificial Sequence
  sgRNA
  mm40195_Robo4
cagagggccgatgtaacagg

SEQ ID NO: 4727 - DNA, 20 bp, Artificial Sequence
  sgRNA
  mm40196_Robo4
gagcagagaagaatgactcg

SEQ ID NO: 4728 - DNA, 20 bp, Artificial Sequence
  sgRNA
  mm40197_Robo4
ttcacccactacggtccagt

SEQ ID NO: 4729 - DNA, 20 bp, Artificial Sequence
  sgRNA
  mm40822_Hyal5
tacatgccaatagacaatgt

SEQ ID NO: 4730 - DNA, 20 bp, Artificial Sequence
  sgRNA
  mm40823_Hyal5
tgtgaaacaagactcagttg

SEQ ID NO: 4731 - DNA, 20 bp, Artificial Sequence
  sgRNA
  mm40824_Hyal5
cttcggccaaatcacttatg

SEQ ID NO: 4732 - DNA, 20 bp, Artificial Sequence
  sgRNA
  mm40825_Hyal5
tttgactttagacactcgaa

SEQ ID NO: 4733 - DNA, 20 bp, Artificial Sequence
  sgRNA
  mm41010_Cd200r3
gtgatgtgcagggaccctag

SEQ ID NO: 4734 - DNA, 20 bp, Artificial Sequence
  sgRNA
  mm41011_Cd200r3
aaaggaaatgaatcatccgg

SEQ ID NO: 4735 - DNA, 20 bp, Artificial Sequence
  sgRNA
  mm41012_Cd200r3
gtcggatagaaacaacagat

SEQ ID NO: 4736 - DNA, 20 bp, Artificial Sequence
  sgRNA
  mm41013_Cd200r3
ctgtagggtagtctgcagga

SEQ ID NO: 4737 - DNA, 20 bp, Artificial Sequence
  sgRNA
  mm41022_Scpep1
aaactccatacttacccacg

SEQ ID NO: 4738 - DNA, 20 bp, Artificial Sequence
  sgRNA
  mm41023_Scpep1
ggattatgtgactgtccgaa

SEQ ID NO: 4739 - DNA, 20 bp, Artificial Sequence
  sgRNA
  mm41024_Scpep1
cacaacagatgcctacgcaa

SEQ ID NO: 4740 - DNA, 20 bp, Artificial Sequence
  sgRNA
  mm41025_Scpep1
caagcctcgaaatactacct

SEQ ID NO: 4741 - DNA, 20 bp, Artificial Sequence
  sgRNA
  mm41170_Mxra8
tcactgacacgcgatcacgc

SEQ ID NO: 4742 - DNA, 20 bp, Artificial Sequence
  sgRNA
  mm41171_Mxra8
tgtgcgcctcgaggttacag

SEQ ID NO: 4743 - DNA, 20 bp, Artificial Sequence
  sgRNA
  mm41172_Mxra8
gactgaccgccatttagagg

SEQ ID NO: 4744 - DNA, 20 bp, Artificial Sequence
  sgRNA
  mm41173_Mxra8
cttgtggatatgtattcggc

SEQ ID NO: 4745 - DNA, 20 bp, Artificial Sequence
  sgRNA
  mm41174_Mdga1
cttcaacgtacgaccccggg

SEQ ID NO: 4746 - DNA, 20 bp, Artificial Sequence
  sgRNA
  mm41175_Mdga1
cagacagtgagcgatgtccg

SEQ ID NO: 4747 - DNA, 20 bp, Artificial Sequence
  sgRNA
  mm41176_Mdga1
gtgtccgtgcgcaatgtgtg

SEQ ID NO: 4748 - DNA, 20 bp, Artificial Sequence
  sgRNA
  mm41177_Mdga1
gctttctttgatcatgtcgg

SEQ ID NO: 4749 - DNA, 20 bp, Artificial Sequence
  sgRNA
  mm41450_Sv2c
atcccgaatttggtatgcat

SEQ ID NO: 4750 - DNA, 20 bp, Artificial Sequence
  sgRNA
  mm41451_Sv2c
gaagtcaccttaccgtagtg

SEQ ID NO: 4751 - DNA, 20 bp, Artificial Sequence
  sgRNA
  mm41452_Sv2c
tggcgaaacctacagtgggg

SEQ ID NO: 4752 - DNA, 20 bp, Artificial Sequence
  sgRNA
  mm41453_Sv2c
gacaccaacatgagagcccg

SEQ ID NO: 4753 - DNA, 20 bp, Artificial Sequence
  sgRNA
  mm41566_Slamf7
acatgtcagattgattacgc

SEQ ID NO: 4754 - DNA, 20 bp, Artificial Sequence
  sgRNA
  mm41567_Slamf7
cctgagtgaagttagatccg

SEQ ID NO: 4755 - DNA, 20 bp, Artificial Sequence
  sgRNA
  mm41568_Slamf7
gaatgtcacagatccatcaa

SEQ ID NO: 4756 - DNA, 20 bp, Artificial Sequence
  sgRNA
  mm41569_Slamf7
agaccaggccttaacatgca

SEQ ID NO: 4757 - DNA, 20 bp, Artificial Sequence
  sgRNA
  mm41594_Defb29
agagagactcgagttacctg

SEQ ID NO: 4758 - DNA, 20 bp, Artificial Sequence
  sgRNA
  mm41595_Defb29
gtcatacttcatgactgtgg

SEQ ID NO: 4759 - DNA, 20 bp, Artificial Sequence
  sgRNA
  mm41596_Defb29
taaagctcacacgcaatcca

SEQ ID NO: 4760 - DNA, 20 bp, Artificial Sequence
  sgRNA
  mm41597_Defb29
attgcgtgtgagctttacca

SEQ ID NO: 4761 - DNA, 20 bp, Artificial Sequence
  sgRNA
  mm41926_Gns
ccaaagtgttgttaacgacg

SEQ ID NO: 4762 - DNA, 20 bp, Artificial Sequence
  sgRNA
  mm41927_Gns
tgctgggaagtatttaaacg

SEQ ID NO: 4763 - DNA, 20 bp, Artificial Sequence
  sgRNA
  mm41928_Gns
tcagacaacggctaccacac

SEQ ID NO: 4764 - DNA, 20 bp, Artificial Sequence
  sgRNA
  mm41929_Gns
cagaggaacctaccgtcccg

SEQ ID NO: 4765 - DNA, 20 bp, Artificial Sequence
  sgRNA
  mm42162_Dcstamp
aagcgttcctaccttcacgg

SEQ ID NO: 4766 - DNA, 20 bp, Artificial Sequence
  sgRNA
  mm42163_Dcstamp
gctcatatgaatgacactag

SEQ ID NO: 4767 - DNA, 20 bp, Artificial Sequence
  sgRNA
  mm42164_Dcstamp
aaggccgtaaatccactgga

SEQ ID NO: 4768 - DNA, 20 bp, Artificial Sequence
  sgRNA
  mm42165_Dcstamp
cccacatgtagagataggtc

SEQ ID NO: 4769 - DNA, 20 bp, Artificial Sequence
  sgRNA
  mm42166_Rab11fip1
caaggagaagtacgccacgt

SEQ ID NO: 4770 - DNA, 20 bp, Artificial Sequence
  sgRNA
  mm42167_Rab11fip1
cgggaactcaccatccgagg

SEQ ID NO: 4771 - DNA, 20 bp, Artificial Sequence
  sgRNA
  mm42168_Rab11fip1
gagcaacgcgcggtgcagga

SEQ ID NO: 4772 - DNA, 20 bp, Artificial Sequence
  sgRNA
  mm42169_Rab11fip1
cgttgatacagacggtagag

SEQ ID NO: 4773 - DNA, 20 bp, Artificial Sequence
  sgRNA
  mm42366_Cant1
ggagtgggataaagaccacg

SEQ ID NO: 4774 - DNA, 20 bp, Artificial Sequence
  sgRNA
  mm42367_Cant1
cagcacccacaaaggacgtg

SEQ ID NO: 4775 - DNA, 20 bp, Artificial Sequence
  sgRNA
  mm42368_Cant1
ccatcagaaaggatcaccca

SEQ ID NO: 4776 - DNA, 20 bp, Artificial Sequence
  sgRNA
  mm42369_Cant1
ggagtggaccaccacgacag

SEQ ID NO: 4777 - DNA, 20 bp, Artificial Sequence
  sgRNA
  mm42542_Slc38a3
agctgtcgcatcagtgctag

SEQ ID NO: 4778 - DNA, 20 bp, Artificial Sequence
  sgRNA
  mm42543_Slc38a3
catgacatacatgacagcaa

SEQ ID NO: 4779 - DNA, 20 bp, Artificial Sequence
  sgRNA
  mm42544_Slc38a3
gatgtataggtagctggaca

SEQ ID NO: 4780 - DNA, 20 bp, Artificial Sequence
  sgRNA
  mm42545_Slc38a3
acctgctcctcaagtcttcg

SEQ ID NO: 4781 - DNA, 20 bp, Artificial Sequence
  sgRNA
  mm42578_Mfap4
cttctgcgacatgacaactg

SEQ ID NO: 4782 - DNA, 20 bp, Artificial Sequence
  sgRNA
  mm42579_Mfap4
tgtgatgatatctacgccca

SEQ ID NO: 4783 - DNA, 20 bp, Artificial Sequence
  sgRNA
  mm42580_Mfap4
gaagtcaatgtacttggcat

SEQ ID NO: 4784 - DNA, 20 bp, Artificial Sequence
  sgRNA
  mm42581_Mfap4
cctcgaagccagccacgtag

SEQ ID NO: 4785 - DNA, 20 bp, Artificial Sequence
  sgRNA
  mm42590_Erp44
tgtaatctacaaaccacccg

SEQ ID NO: 4786 - DNA, 20 bp, Artificial Sequence
  sgRNA
  mm42591_Erp44
aatgttatttctcggacaag

SEQ ID NO: 4787 - DNA, 20 bp, Artificial Sequence
  sgRNA
  mm42592_Erp44
gtgctgatcacaatcaactc

SEQ ID NO: 4788 - DNA, 20 bp, Artificial Sequence
  sgRNA
  mm42593_Erp44
catctagactctgaatctcg

SEQ ID NO: 4789 - DNA, 20 bp, Artificial Sequence
  sgRNA
  mm42740_Prss23
tgagtccctacaccgttccg

SEQ ID NO: 4790 - DNA, 20 bp, Artificial Sequence
  sgRNA
  mm42741_Prss23
aagggcaatgccaatgacat

SEQ ID NO: 4791 - DNA, 20 bp, Artificial Sequence
  sgRNA
  mm42742_Prss23
gtgacactgaggtccacatg

SEQ ID NO: 4792 - DNA, 20 bp, Artificial Sequence
  sgRNA
  mm42743_Prss23
ctgcccactgcatacacgat

SEQ ID NO: 4793 - DNA, 20 bp, Artificial Sequence
  sgRNA
  mm42792_Glt8d1
aacaatgtaaaacatcacat

SEQ ID NO: 4794 - DNA, 20 bp, Artificial Sequence
  sgRNA
  mm42793_Glt8d1
taaagcaggatcctgaccag

SEQ ID NO: 4795 - DNA, 20 bp, Artificial Sequence
  sgRNA
  mm42794_Glt8d1
tccccggatgatgactttag

SEQ ID NO: 4796 - DNA, 20 bp, Artificial Sequence
  sgRNA
  mm42795_Glt8d1
gcactggcgacaaagtctat

SEQ ID NO: 4797 - DNA, 20 bp, Artificial Sequence
  sgRNA
  mm42796_Ly6k
tgtcgaaacagtgcacccga

SEQ ID NO: 4798 - DNA, 20 bp, Artificial Sequence
  sgRNA
  mm42797_Ly6k
gatggtggattagtgctagg

SEQ ID NO: 4799 - DNA, 20 bp, Artificial Sequence
  sgRNA
  mm42798_Ly6k
tgttctgcgcctcacacaca

SEQ ID NO: 4800 - DNA, 20 bp, Artificial Sequence
  sgRNA
  mm42799_Ly6k
ttataaaataggaagggcat

SEQ ID NO: 4801 - DNA, 20 bp, Artificial Sequence
  sgRNA
  mm42832_Plet1
cactgactgaatcgttcacg

SEQ ID NO: 4802 - DNA, 20 bp, Artificial Sequence
  sgRNA
  mm42833_Plet1
gatgttatcaaggaccacgc

SEQ ID NO: 4803 - DNA, 20 bp, Artificial Sequence
  sgRNA
  mm42834_Plet1
cttgacatcccaaagccagt

SEQ ID NO: 4804 - DNA, 20 bp, Artificial Sequence
  sgRNA
  mm42835_Plet1
tcatccgtgaaaatggaaca

SEQ ID NO: 4805 - DNA, 20 bp, Artificial Sequence
  sgRNA
  mm42900_Mfsd2a
tcagggacggaaagttcaca

SEQ ID NO: 4806 - DNA, 20 bp, Artificial Sequence
  sgRNA
  mm42901_Mfsd2a
gcagccggtcaactggtacg

SEQ ID NO: 4807 - DNA, 20 bp, Artificial Sequence
  sgRNA
  mm42902_Mfsd2a
gagggacttactgtatgccg

SEQ ID NO: 4808 - DNA, 20 bp, Artificial Sequence
  sgRNA
  mm42903_Mfsd2a
tctctacttaccagggcatg

SEQ ID NO: 4809 - DNA, 20 bp, Artificial Sequence
  sgRNA
  mm43032_Arpc2
agttgttaaagagagtgtat

SEQ ID NO: 4810 - DNA, 20 bp, Artificial Sequence
  sgRNA
  mm43033_Arpc2
tcttagattccacatacctg

SEQ ID NO: 4811 - DNA, 20 bp, Artificial Sequence
  sgRNA
  mm43034_Arpc2
gaagtatttctcaaacacag

SEQ ID NO: 4812 - DNA, 20 bp, Artificial Sequence
  sgRNA
  mm43035_Arpc2
catcggaaaggtgttcatgc

SEQ ID NO: 4813 - DNA, 20 bp, Artificial Sequence
  sgRNA
  mm43072_Alpi
aaactaaggtattacccatg

SEQ ID NO: 4814 - DNA, 20 bp, Artificial Sequence
  sgRNA
  mm43073_Alpi
aaggccaactacaagaccat

SEQ ID NO: 4815 - DNA, 20 bp, Artificial Sequence
  sgRNA
  mm43074_Alpi
agccggcacctacgcacaca

SEQ ID NO: 4816 - DNA, 20 bp, Artificial Sequence
  sgRNA
  mm43075_Alpi
acagtaaccagtctggaacc

SEQ ID NO: 4817 - DNA, 20 bp, Artificial Sequence
  sgRNA
  mm43148_Calcoco2
gatgaagatggtttagtccg

SEQ ID NO: 4818 - DNA, 20 bp, Artificial Sequence
  sgRNA
  mm43149_Calcoco2
agcgctccacatccttggga

SEQ ID NO: 4819 - DNA, 20 bp, Artificial Sequence
  sgRNA
  mm43150_Calcoco2
ccaatccagtccttgcgtcg

SEQ ID NO: 4820 - DNA, 20 bp, Artificial Sequence
  sgRNA
  mm43151_Calcoco2
gagaagttctatgctcctag

SEQ ID NO: 4821 - DNA, 20 bp, Artificial Sequence
  sgRNA
  mm43308_Hnrnpm
attggcatgggattaggacc

SEQ ID NO: 4822 - DNA, 20 bp, Artificial Sequence
  sgRNA
  mm43309_Hnrnpm
aggtgatggctacgactggt

SEQ ID NO: 4823 - DNA, 20 bp, Artificial Sequence
  sgRNA
  mm43310_Hnrnpm
gcccatgcgctcaatactgg

SEQ ID NO: 4824 - DNA, 20 bp, Artificial Sequence
  sgRNA
  mm43311_Hnrnpm
ctaagtaatgcactgaagag

SEQ ID NO: 4825 - DNA, 20 bp, Artificial Sequence
  sgRNA
  mm43436_Hyal4
tgatattgaatattcagcca

SEQ ID NO: 4826 - DNA, 20 bp, Artificial Sequence
  sgRNA
  mm43437_Hyal4
ttcgggtgcgtgaatcactg

SEQ ID NO: 4827 - DNA, 20 bp, Artificial Sequence
  sgRNA
  mm43438_Hyal4
gatataaataataaccccaa

SEQ ID NO: 4828 - DNA, 20 bp, Artificial Sequence
  sgRNA
  mm43439_Hyal4
tgctgttccagagccaagag

SEQ ID NO: 4829 - DNA, 20 bp, Artificial Sequence
  sgRNA
  mm43656_Myh10
tctgcatcatccactacgcg

SEQ ID NO: 4830 - DNA, 20 bp, Artificial Sequence
  sgRNA
  mm43657_Myh10
agataagtcctgaatagtag

SEQ ID NO: 4831 - DNA, 20 bp, Artificial Sequence
  sgRNA
  mm43658_Myh10
gaatgtgatggagttcactc

SEQ ID NO: 4832 - DNA, 20 bp, Artificial Sequence
  sgRNA
  mm43659_Myh10
tgtaactggctatattgttg

SEQ ID NO: 4833 - DNA, 20 bp, Artificial Sequence
  sgRNA
  mm43748_Defb12
gaagaatctcccctcaaaca

SEQ ID NO: 4834 - DNA, 20 bp, Artificial Sequence
  sgRNA
  mm43749_Defb12
tttacctcctggaaatgact

SEQ ID NO: 4835 - DNA, 20 bp, Artificial Sequence
  sgRNA
  mm43750_Defb12
ggaatactcaagtcctgccc

SEQ ID NO: 4836 - DNA, 20 bp, Artificial Sequence
  sgRNA
  mm43751_Defb12
attgtagttgaactgccatc

SEQ ID NO: 4837 - DNA, 20 bp, Artificial Sequence
  sgRNA
  mm43756_Bsph2
tggcggtactgtacagcaca

SEQ ID NO: 4838 - DNA, 20 bp, Artificial Sequence
  sgRNA
  mm43757_Bsph2
aacaccaatcatagtcactg

SEQ ID NO: 4839 - DNA, 20 bp, Artificial Sequence
  sgRNA
  mm43758_Bsph2
gatgagccatcttgtgcact

SEQ ID NO: 4840 - DNA, 20 bp, Artificial Sequence
  sgRNA
  mm43759_Bsph2
ggagggagatacaactgtag

SEQ ID NO: 4841 - DNA, 20 bp, Artificial Sequence
  sgRNA
  mm43812_Ulbp1
gaagtttatagaaatgtgca

SEQ ID NO: 4842 - DNA, 20 bp, Artificial Sequence
  sgRNA
  mm43813_Ulbp1
ttccgtgttgacacaagcac

SEQ ID NO: 4843 - DNA, 20 bp, Artificial Sequence
  sgRNA
  mm43814_Ulbp1
cacgcatagaataatcatca

SEQ ID NO: 4844 - DNA, 20 bp, Artificial Sequence
  sgRNA
  mm43815_Ulbp1
gtgcaggagactaacacaac

SEQ ID NO: 4845 - DNA, 20 bp, Artificial Sequence
  sgRNA
  mm43984_Lpar4
ctgatggtacgcgatcggaa

SEQ ID NO: 4846 - DNA, 20 bp, Artificial Sequence
  sgRNA
  mm43985_Lpar4
gcagttgcatttcccaacct

SEQ ID NO: 4847 - DNA, 20 bp, Artificial Sequence
  sgRNA
  mm43986_Lpar4
gcggaagcagaagacaaaca

SEQ ID NO: 4848 - DNA, 20 bp, Artificial Sequence
  sgRNA
  mm43987_Lpar4
gaagccttcaaagcaagtgg

SEQ ID NO: 4849 - DNA, 20 bp, Artificial Sequence
  sgRNA
  mm44128_Ttyh3
ggaaatgcaagatgttgtcg

SEQ ID NO: 4850 - DNA, 20 bp, Artificial Sequence
  sgRNA
  mm44129_Ttyh3
gagcactcagtactgagtgg

SEQ ID NO: 4851 - DNA, 20 bp, Artificial Sequence
  sgRNA
  mm44130_Ttyh3
gaaccccggagtatcgctgg

SEQ ID NO: 4852 - DNA, 20 bp, Artificial Sequence
  sgRNA
  mm44131_Ttyh3
acgccatgccaaccgcacag

SEQ ID NO: 4853 - DNA, 20 bp, Artificial Sequence
  sgRNA
  mm44244_Adgra3
gctgcgagtgtataccgcag

SEQ ID NO: 4854 - DNA, 20 bp, Artificial Sequence
  sgRNA
  mm44245_Adgra3
gagcgggtgaccaacaaccg

SEQ ID NO: 4855 - DNA, 20 bp, Artificial Sequence
  sgRNA
  mm44246_Adgra3
tctccataggagccccattg

SEQ ID NO: 4856 - DNA, 20 bp, Artificial Sequence
  sgRNA
  mm44247_Adgra3
gctgaatgcattcccgcggg

SEQ ID NO: 4857 - DNA, 20 bp, Artificial Sequence
  sgRNA
  mm44464_P2ry10
tgatcttgggtacaaacaga

SEQ ID NO: 4858 - DNA, 20 bp, Artificial Sequence
  sgRNA
  mm44465_P2ry10
tggaagcgtaggtacgatgt

SEQ ID NO: 4859 - DNA, 20 bp, Artificial Sequence
  sgRNA
  mm44466_P2ry10
tttccaggtacaacatgcaa

SEQ ID NO: 4860 - DNA, 20 bp, Artificial Sequence
  sgRNA
  mm44467_P2ry10
gtaaggacaggatatgagca

SEQ ID NO: 4861 - DNA, 20 bp, Artificial Sequence
  sgRNA
  mm44532_Igsf3
cgagtacgggacctacgccg

SEQ ID NO: 4862 - DNA, 20 bp, Artificial Sequence
  sgRNA
  mm44533_Igsf3
agtacagatcgttagcacgg

SEQ ID NO: 4863 - DNA, 20 bp, Artificial Sequence
  sgRNA
  mm44534_Igsf3
ccagcagcgaatatgcccag

SEQ ID NO: 4864 - DNA, 20 bp, Artificial Sequence
  sgRNA
  mm44535_Igsf3
agtgccaagatgaacctagt

SEQ ID NO: 4865 - DNA, 20 bp, Artificial Sequence
  sgRNA
  mm44576_Pigt
gatccgaatcccaacgcgtg

SEQ ID NO: 4866 - DNA, 20 bp, Artificial Sequence
  sgRNA
  mm44577_Pigt
aaacaagtcatagacggcat

SEQ ID NO: 4867 - DNA, 20 bp, Artificial Sequence
  sgRNA
  mm44578_Pigt
ggtaactggtgtggaacaag

SEQ ID NO: 4868 - DNA, 20 bp, Artificial Sequence
  sgRNA
  mm44579_Pigt
tgagagtccgggagaacatg

SEQ ID NO: 4869 - DNA, 20 bp, Artificial Sequence
  sgRNA
  mm44620_Tnfrsf23
gtcacccaggaacattcaca

SEQ ID NO: 4870 - DNA, 20 bp, Artificial Sequence
  sgRNA
  mm44621_Tnfrsf23
attagactggtattcaccat

SEQ ID NO: 4871 - DNA, 20 bp, Artificial Sequence
  sgRNA
  mm44622_Tnfrsf23
gattgcagaccagaatatgg

SEQ ID NO: 4872 - DNA, 20 bp, Artificial Sequence
  sgRNA
  mm44623_Tnfrsf23
tgttgcaagacctgtccctc

SEQ ID NO: 4873 - DNA, 20 bp, Artificial Sequence
  sgRNA
  mm44624_Tnfrsf22
agcaaagtatacaagcatcc

SEQ ID NO: 4874 - DNA, 20 bp, Artificial Sequence
  sgRNA
  mm44625_Tnfrsf22
tttagaccagtattcaccag

SEQ ID NO: 4875 - DNA, 20 bp, Artificial Sequence
  sgRNA
  mm44626_Tnfrsf22
tgagtatgggggatttcgca

SEQ ID NO: 4876 - DNA, 20 bp, Artificial Sequence
  sgRNA
  mm44627_Tnfrsf22
gattgcagatcaggaaatgg

SEQ ID NO: 4877 - DNA, 20 bp, Artificial Sequence
  sgRNA
  mm44736_Pofut2
actgctcatactctataacg

SEQ ID NO: 4878 - DNA, 20 bp, Artificial Sequence
  sgRNA
  mm44737_Pofut2
cgtcctacaaggttacgccg

SEQ ID NO: 4879 - DNA, 20 bp, Artificial Sequence
  sgRNA
  mm44738_Pofut2
tttggggctacgaagaaaca

SEQ ID NO: 4880 - DNA, 20 bp, Artificial Sequence
  sgRNA
  mm44739_Pofut2
ctccggggccatcttatcag

SEQ ID NO: 4881 - DNA, 20 bp, Artificial Sequence
  sgRNA
  mm44812_Lrfn1
acacacacaaatcataggcg

SEQ ID NO: 4882 - DNA, 20 bp, Artificial Sequence
  sgRNA
  mm44813_Lrfn1
ccgggatggaccagaaatag

SEQ ID NO: 4883 - DNA, 20 bp, Artificial Sequence
  sgRNA
  mm44814_Lrfn1
tgttgccgaggatcaagtgg

SEQ ID NO: 4884 - DNA, 20 bp, Artificial Sequence
  sgRNA
  mm44815_Lrfn1
ctacataaattgccccccga

SEQ ID NO: 4885 - DNA, 20 bp, Artificial Sequence
  sgRNA
  mm44828_Klrb1b
atcagtacaaaaaatctgcg

SEQ ID NO: 4886 - DNA, 20 bp, Artificial Sequence
  sgRNA
  mm44829_Klrb1b
caatcacgaccagcacaaga

SEQ ID NO: 4887 - DNA, 20 bp, Artificial Sequence
  sgRNA
  mm44830_Klrb1b
agagccaaccgatgccagcg

SEQ ID NO: 4888 - DNA, 20 bp, Artificial Sequence
  sgRNA
  mm44831_Klrb1b
atgcagatttaaacctagcc

SEQ ID NO: 4889 - DNA, 20 bp, Artificial Sequence
  sgRNA
  mm44852_Hist1h1a
cctggtgaataaaggcacac

SEQ ID NO: 4890 - DNA, 20 bp, Artificial Sequence
  sgRNA
  mm44853_Hist1h1a
tccgacaccgaaggtcccgc

SEQ ID NO: 4891 - DNA, 20 bp, Artificial Sequence
  sgRNA
  mm44854_Hist1h1a
agccagcgacttcttgagcg

SEQ ID NO: 4892 - DNA, 20 bp, Artificial Sequence
  sgRNA
  mm44855_Hist1h1a
gaaacctaagaagactgctg

SEQ ID NO: 4893 - DNA, 20 bp, Artificial Sequence
  sgRNA
  mm45080_Sil1
cctacagactggagtaaacg

SEQ ID NO: 4894 - DNA, 20 bp, Artificial Sequence
  sgRNA
  mm45081_Sil1
tgttccacccaactcaagag

SEQ ID NO: 4895 - DNA, 20 bp, Artificial Sequence
  sgRNA
  mm45082_Sil1
agcagcatactccttcacca

SEQ ID NO: 4896 - DNA, 20 bp, Artificial Sequence
  sgRNA
  mm45083_Sil1
caaggaaaaacaatacctga

SEQ ID NO: 4897 - DNA, 20 bp, Artificial Sequence
  sgRNA
  mm45116_Sorcs2
gggaatagcgaaccccacgc

SEQ ID NO: 4898 - DNA, 20 bp, Artificial Sequence
  sgRNA
  mm45117_Sorcs2
gtaccgtgcctgacacatag

SEQ ID NO: 4899 - DNA, 20 bp, Artificial Sequence
  sgRNA
  mm45118_Sorcs2
gtaggttgtcccaaaatctg

SEQ ID NO: 4900 - DNA, 20 bp, Artificial Sequence
  sgRNA
  mm45119_Sorcs2
caacccatccacgaacactg

SEQ ID NO: 4901 - DNA, 20 bp, Artificial Sequence
  sgRNA
  mm45140_Cacng7
gccgcagaaccagaccaccg

SEQ ID NO: 4902 - DNA, 20 bp, Artificial Sequence
  sgRNA
  mm45141_Cacng7
actttcactatcgctacggg

SEQ ID NO: 4903 - DNA, 20 bp, Artificial Sequence
  sgRNA
  mm45142_Cacng7
tcggccacatccgacctcag

SEQ ID NO: 4904 - DNA, 20 bp, Artificial Sequence
  sgRNA
  mm45143_Cacng7
catctccagcatcaacgacg

SEQ ID NO: 4905 - DNA, 20 bp, Artificial Sequence
  sgRNA
  mm45144_Cacng8
gatgacggaccaccccatcg

SEQ ID NO: 4906 - DNA, 20 bp, Artificial Sequence
  sgRNA
  mm45145_Cacng8
gtgtacatatcggccaacgc

SEQ ID NO: 4907 - DNA, 20 bp, Artificial Sequence
  sgRNA
  mm45146_Cacng8
agccgcgaaggcgccgatgg

SEQ ID NO: 4908 - DNA, 20 bp, Artificial Sequence
  sgRNA
  mm45147_Cacng8
ggactacgaccacgacagcg

SEQ ID NO: 4909 - DNA, 20 bp, Artificial Sequence
  sgRNA
  mm45152_Tmem108
gaagagaagtagcccccgag

SEQ ID NO: 4910 - DNA, 20 bp, Artificial Sequence
  sgRNA
  mm45153_Tmem108
actctcacacccgtaccggg

SEQ ID NO: 4911 - DNA, 20 bp, Artificial Sequence
  sgRNA
  mm45154_Tmem108
ggctttatcagatccaacca

SEQ ID NO: 4912 - DNA, 20 bp, Artificial Sequence
  sgRNA
  mm45155_Tmem108
agggtctgtagagattccct

SEQ ID NO: 4913 - DNA, 20 bp, Artificial Sequence
  sgRNA
  mm45172_Siglece
gaccagcttaggttcgcagg

SEQ ID NO: 4914 - DNA, 20 bp, Artificial Sequence
  sgRNA
  mm45173_Siglece
catgtgggacaagatgactc

SEQ ID NO: 4915 - DNA, 20 bp, Artificial Sequence
  sgRNA
  mm45174_Siglece
tgtaccagaatccatgaact

SEQ ID NO: 4916 - DNA, 20 bp, Artificial Sequence
  sgRNA
  mm45175_Siglece
cctcacatgacacgttgaga

SEQ ID NO: 4917 - DNA, 20 bp, Artificial Sequence
  sgRNA
  mm45212_Ctns
aggcatcattactgtcgacg

SEQ ID NO: 4918 - DNA, 20 bp, Artificial Sequence
  sgRNA
  mm45213_Ctns
tggagggccatgacacacgc

SEQ ID NO: 4919 - DNA, 20 bp, Artificial Sequence
  sgRNA
  mm45214_Ctns
taacaggttatagtgcctcg

SEQ ID NO: 4920 - DNA, 20 bp, Artificial Sequence
  sgRNA
  mm45215_Ctns
cccaagggtgatgtcgacgt

SEQ ID NO: 4921 - DNA, 20 bp, Artificial Sequence
  sgRNA
  mm45224_Trem2
tatgacgccttgaagcactg

SEQ ID NO: 4922 - DNA, 20 bp, Artificial Sequence
  sgRNA
  mm45225_Trem2
cgaaactcgatgactcctcg

SEQ ID NO: 4923 - DNA, 20 bp, Artificial Sequence
  sgRNA
  mm45226_Trem2
taccagtgtcagagtctccg

SEQ ID NO: 4924 - DNA, 20 bp, Artificial Sequence
  sgRNA
  mm45227_Trem2
actctgaagaacctccaagc

SEQ ID NO: 4925 - DNA, 20 bp, Artificial Sequence
  sgRNA
  mm45240_Chrdl1
tgtttggtggaggatcgtag

SEQ ID NO: 4926 - DNA, 20 bp, Artificial Sequence
  sgRNA
  mm45241_Chrdl1
caggggatgcagaattatcg

SEQ ID NO: 4927 - DNA, 20 bp, Artificial Sequence
  sgRNA
  mm45242_Chrdl1
tcaagacaagaagtatagag

SEQ ID NO: 4928 - DNA, 20 bp, Artificial Sequence
  sgRNA
  mm45243_Chrdl1
agcaagtcatgcgaatacaa

SEQ ID NO: 4929 - DNA, 20 bp, Artificial Sequence
  sgRNA
  mm45328_Elovl4
ttcatgggatcatacaacgc

SEQ ID NO: 4930 - DNA, 20 bp, Artificial Sequence
  sgRNA
  mm45329_Elovl4
acaccgtggagttctatcgc

SEQ ID NO: 4931 - DNA, 20 bp, Artificial Sequence
  sgRNA
  mm45330_Elovl4
tgcagtggtggtacacgtga

SEQ ID NO: 4932 - DNA, 20 bp, Artificial Sequence
  sgRNA
  mm45331_Elovl4
cgatacaaaataccaccaca

SEQ ID NO: 4933 - DNA, 20 bp, Artificial Sequence
  sgRNA
  mm45372_Slc12a9
tagatgccgatcaacacgag

SEQ ID NO: 4934 - DNA, 20 bp, Artificial Sequence
  sgRNA
  mm45373_Slc12a9
gccatgccggtgtggcacgg

SEQ ID NO: 4935 - DNA, 20 bp, Artificial Sequence
  sgRNA
  mm45374_Slc12a9
gctcttctcaccgcacgagg

SEQ ID NO: 4936 - DNA, 20 bp, Artificial Sequence
  sgRNA
  mm45375_Slc12a9
aaacacgactatgctaaaca

SEQ ID NO: 4937 - DNA, 20 bp, Artificial Sequence
  sgRNA
  mm45424_Tmem2
accattggcttcgacacact

SEQ ID NO: 4938 - DNA, 20 bp, Artificial Sequence
  sgRNA
  mm45425_Tmem2
ttgtcgctttggatctatag

SEQ ID NO: 4939 - DNA, 20 bp, Artificial Sequence
  sgRNA
  mm45426_Tmem2
ggaagctggagaccgaattg

SEQ ID NO: 4940 - DNA, 20 bp, Artificial Sequence
  sgRNA
  mm45427_Tmem2
gatttgcagataacggaaag

SEQ ID NO: 4941 - DNA, 20 bp, Artificial Sequence
  sgRNA
  mm45452_Jam3
ttcagccatctatcgctgtg

SEQ ID NO: 4942 - DNA, 20 bp, Artificial Sequence
  sgRNA
  mm45453_Jam3
ttgcggtaccagctgtagtg

SEQ ID NO: 4943 - DNA, 20 bp, Artificial Sequence
  sgRNA
  mm45454_Jam3
tttcaaattcatgtaccact

SEQ ID NO: 4944 - DNA, 20 bp, Artificial Sequence
  sgRNA
  mm45455_Jam3
gaatggaagaaaatccaaga

SEQ ID NO: 4945 - DNA, 20 bp, Artificial Sequence
  sgRNA
  mm45456_Enpp5
aataggtcgggaaactatcg

SEQ ID NO: 4946 - DNA, 20 bp, Artificial Sequence
  sgRNA
  mm45457_Enpp5
tgggaagaacccgatgacac

SEQ ID NO: 4947 - DNA, 20 bp, Artificial Sequence
  sgRNA
  mm45458_Enpp5
tcatcgtcacgagcgaccat

SEQ ID NO: 4948 - DNA, 20 bp, Artificial Sequence
  sgRNA
  mm45459_Enpp5
cgttagattaggatgggcac

SEQ ID NO: 4949 - DNA, 20 bp, Artificial Sequence
  sgRNA
  mm45480_Mcam
cctgccgaaaagcaccatag

SEQ ID NO: 4950 - DNA, 20 bp, Artificial Sequence
  sgRNA
  mm45481_Mcam
actattcaagccaatgtcgt

SEQ ID NO: 4951 - DNA, 20 bp, Artificial Sequence
  sgRNA
  mm45482_Mcam
aggaacattcgctcatcatg

SEQ ID NO: 4952 - DNA, 20 bp, Artificial Sequence
  sgRNA
  mm45483_Mcam
ccacatgaaggaatctaagg

SEQ ID NO: 4953 - DNA, 20 bp, Artificial Sequence
  sgRNA
  mm45496_Plvap
cggacgtgctgagtgcgtgg

SEQ ID NO: 4954 - DNA, 20 bp, Artificial Sequence
  sgRNA
  mm45497_Plvap
gctgtcggcgcggatctccg

SEQ ID NO: 4955 - DNA, 20 bp, Artificial Sequence
  sgRNA
  mm45498_Plvap
cggagtacgcgtccctccgt

SEQ ID NO: 4956 - DNA, 20 bp, Artificial Sequence
  sgRNA
  mm45499_Plvap
cctgtggcaaagcacgcgaa

SEQ ID NO: 4957 - DNA, 20 bp, Artificial Sequence
  sgRNA
  mm45528_Cd96
agtgggtagatgtttcgttg

SEQ ID NO: 4958 - DNA, 20 bp, Artificial Sequence
  sgRNA
  mm45529_Cd96
ccagtccaaatccaagacga

SEQ ID NO: 4959 - DNA, 20 bp, Artificial Sequence
  sgRNA
  mm45530_Cd96
ccacagtagaggccatattg

SEQ ID NO: 4960 - DNA, 20 bp, Artificial Sequence
  sgRNA
  mm45531_Cd96
tacagtctacaacctcattg

SEQ ID NO: 4961 - DNA, 20 bp, Artificial Sequence
  sgRNA
  mm45576_Cd163
acctgtccttcggaacacgt

SEQ ID NO: 4962 - DNA, 20 bp, Artificial Sequence
  sgRNA
  mm45577_Cd163
gtacaagttctgtctagcgg

SEQ ID NO: 4963 - DNA, 20 bp, Artificial Sequence
  sgRNA
  mm45578_Cd163
ctctgggactgcaaacaccg

SEQ ID NO: 4964 - DNA, 20 bp, Artificial Sequence
  sgRNA
  mm45579_Cd163
aaactggggcaacaaatacg

SEQ ID NO: 4965 - DNA, 20 bp, Artificial Sequence
  sgRNA
  mm45592_Clec2i
gggcaaatgtccagttacgt

SEQ ID NO: 4966 - DNA, 20 bp, Artificial Sequence
  sgRNA
  mm45593_Clec2i
tgcacacctccagttccaag

SEQ ID NO: 4967 - DNA, 20 bp, Artificial Sequence
  sgRNA
  mm45594_Clec2i
gcttgctcaaaaaactggac

SEQ ID NO: 4968 - DNA, 20 bp, Artificial Sequence
  sgRNA
  mm45595_Clec2i
agctcggtttgacaacgagg

SEQ ID NO: 4969 - DNA, 20 bp, Artificial Sequence
  sgRNA
  mm45608_Glce
aggacataaacacaccgtca

SEQ ID NO: 4970 - DNA, 20 bp, Artificial Sequence
  sgRNA
  mm45609_Glce
cttgagtagtggattcagag

SEQ ID NO: 4971 - DNA, 20 bp, Artificial Sequence
  sgRNA
  mm45610_Glce
gggggcttcaatagcaacgg

SEQ ID NO: 4972 - DNA, 20 bp, Artificial Sequence
  sgRNA
  mm45611_Glce
tctctacccaagtgaatgga

SEQ ID NO: 4973 - DNA, 20 bp, Artificial Sequence
  sgRNA
  mm45616_Entpd7
tctgaattatggactcgtgg

SEQ ID NO: 4974 - DNA, 20 bp, Artificial Sequence
  sgRNA
  mm45617_Entpd7
agatagccaactgttgcctg

SEQ ID NO: 4975 - DNA, 20 bp, Artificial Sequence
  sgRNA
  mm45618_Entpd7
cctgtcccgtggtaacgaag

SEQ ID NO: 4976 - DNA, 20 bp, Artificial Sequence
  sgRNA
  mm45619_Entpd7
gtggttaagaaaataaagcc

SEQ ID NO: 4977 - DNA, 20 bp, Artificial Sequence
  sgRNA
  mm45648_Clec2d
aagcttagcacaagactcag

SEQ ID NO: 4978 - DNA, 20 bp, Artificial Sequence
  sgRNA
  mm45649_Clec2d
gggcgaatgtccagttactt

SEQ ID NO: 4979 - DNA, 20 bp, Artificial Sequence
  sgRNA
  mm45650_Clec2d
actagctcggtttgacaacc

SEQ ID NO: 4980 - DNA, 20 bp, Artificial Sequence
  sgRNA
  mm45651_Clec2d
ttacccacttctacctcctg

SEQ ID NO: 4981 - DNA, 20 bp, Artificial Sequence
  sgRNA
  mm45652_Gpnmb
agagagcacaaccaattacg

SEQ ID NO: 4982 - DNA, 20 bp, Artificial Sequence
  sgRNA
  mm45653_Gpnmb
tccatggatttgtaaccagt

SEQ ID NO: 4983 - DNA, 20 bp, Artificial Sequence
  sgRNA
  mm45654_Gpnmb
ggcatacattcccatctcga

SEQ ID NO: 4984 - DNA, 20 bp, Artificial Sequence
  sgRNA
  mm45655_Gpnmb
aggaaatggcagagtcgttg

SEQ ID NO: 4985 - DNA, 20 bp, Artificial Sequence
  sgRNA
  mm45856_Igsf9
caatgcagaagtaccccccg

SEQ ID NO: 4986 - DNA, 20 bp, Artificial Sequence
  sgRNA
  mm45857_Igsf9
actgacgtagctatcagcga

SEQ ID NO: 4987 - DNA, 20 bp, Artificial Sequence
  sgRNA
  mm45858_Igsf9
acgtaatcggggtcaattcg

SEQ ID NO: 4988 - DNA, 20 bp, Artificial Sequence
  sgRNA
  mm45859_Igsf9
gggctggtctataaaagccg

SEQ ID NO: 4989 - DNA, 20 bp, Artificial Sequence
  sgRNA
  mm45960_Fzd10
gggtcacgagaaccagcgcg

SEQ ID NO: 4990 - DNA, 20 bp, Artificial Sequence
  sgRNA
  mm45961_Fzd10
ggaagatgataggacgttcg

SEQ ID NO: 4991 - DNA, 20 bp, Artificial Sequence
  sgRNA
  mm45962_Fzd10
ggtactttactacttcggca

SEQ ID NO: 4992 - DNA, 20 bp, Artificial Sequence
  sgRNA
  mm45963_Fzd10
gagcacccactaaaggacgg

SEQ ID NO: 4993 - DNA, 20 bp, Artificial Sequence
  sgRNA
  mm45984_Tm2d1
ggcgaccgtcacgagccaca

SEQ ID NO: 4994 - DNA, 20 bp, Artificial Sequence
  sgRNA
  mm45985_Tm2d1
gaggatattgtcccaccctg

SEQ ID NO: 4995 - DNA, 20 bp, Artificial Sequence
  sgRNA
  mm45986_Tm2d1
tgtacaaactacacagctca

SEQ ID NO: 4996 - DNA, 20 bp, Artificial Sequence
  sgRNA
  mm45987_Tm2d1
ataacttgtaaggatttgag

SEQ ID NO: 4997 - DNA, 20 bp, Artificial Sequence
  sgRNA
  mm46060_Csmd1
gtacttaccaatgcacaaag

SEQ ID NO: 4998 - DNA, 20 bp, Artificial Sequence
  sgRNA
  mm46061_Csmd1
gtcacacactcaatggacga

SEQ ID NO: 4999 - DNA, 20 bp, Artificial Sequence
  sgRNA
  mm46062_Csmd1
cgaactgaaacccaattctg

SEQ ID NO: 5000 - DNA, 20 bp, Artificial Sequence
  sgRNA
  mm46063_Csmd1
gtggtactctcctatgagtg

SEQ ID NO: 5001 - DNA, 20 bp, Artificial Sequence
  sgRNA
  mm46076_Mcoln1
gacataggcataccggccca

SEQ ID NO: 5002 - DNA, 20 bp, Artificial Sequence
  sgRNA
  mm46077_Mcoln1
tttgacaataaagcgcacag

SEQ ID NO: 5003 - DNA, 20 bp, Artificial Sequence
  sgRNA
  mm46078_Mcoln1
atacctttgacattgatcca

SEQ ID NO: 5004 - DNA, 20 bp, Artificial Sequence
  sgRNA
  mm46079_Mcoln1
tggcccggaacttgtcacat

SEQ ID NO: 5005 - DNA, 20 bp, Artificial Sequence
  sgRNA
  mm46128_Spock2
agacgcagtagactgctccg

SEQ ID NO: 5006 - DNA, 20 bp, Artificial Sequence
  sgRNA
  mm46129_Spock2
tctgcttggagttctcacga

SEQ ID NO: 5007 - DNA, 20 bp, Artificial Sequence
  sgRNA
  mm46130_Spock2
acagcggcaagattaagcac

SEQ ID NO: 5008 - DNA, 20 bp, Artificial Sequence
  sgRNA
  mm46131_Spock2
agagctgtaggtatggccgt

SEQ ID NO: 5009 - DNA, 20 bp, Artificial Sequence
  sgRNA
  mm46136_Lrp1b
aagacgttctgagatccgag

SEQ ID NO: 5010 - DNA, 20 bp, Artificial Sequence
  sgRNA
  mm46137_Lrp1b
gtgggagtagtagactacca

SEQ ID NO: 5011 - DNA, 20 bp, Artificial Sequence
  sgRNA
  mm46138_Lrp1b
acacagcgacgattgtagca

SEQ ID NO: 5012 - DNA, 20 bp, Artificial Sequence
  sgRNA
  mm46139_Lrp1b
tatgatccacgaaaacaaca

SEQ ID NO: 5013 - DNA, 20 bp, Artificial Sequence
  sgRNA
  mm46144_Cnnm2
accgtcgtggtaaatccagg

SEQ ID NO: 5014 - DNA, 20 bp, Artificial Sequence
  sgRNA
  mm46145_Cnnm2
cggcgattgagaatgatgtg

SEQ ID NO: 5015 - DNA, 20 bp, Artificial Sequence
  sgRNA
  mm46146_Cnnm2
tgctaaccggataagaagcg

SEQ ID NO: 5016 - DNA, 20 bp, Artificial Sequence
  sgRNA
  mm46147_Cnnm2
ctgcttcatgataaccggcg

SEQ ID NO: 5017 - DNA, 20 bp, Artificial Sequence
  sgRNA
  mm46148_Cnnm4
agagcgtgatcctaggcatg

SEQ ID NO: 5018 - DNA, 20 bp, Artificial Sequence
  sgRNA
  mm46149_Cnnm4
ccatgatgccagacccgatg

SEQ ID NO: 5019 - DNA, 20 bp, Artificial Sequence
  sgRNA
  mm46150_Cnnm4
gaaaaacaaaatgtaccggg

SEQ ID NO: 5020 - DNA, 20 bp, Artificial Sequence
  sgRNA
  mm46151_Cnnm4
gcatccccgacgtgttcccg

SEQ ID NO: 5021 - DNA, 20 bp, Artificial Sequence
  sgRNA
  mm46176_Slc4a10
agagaacatctggcacgtag

SEQ ID NO: 5022 - DNA, 20 bp, Artificial Sequence
  sgRNA
  mm46177_Slc4a10
cacgatgcctgtgacgacga

SEQ ID NO: 5023 - DNA, 20 bp, Artificial Sequence
  sgRNA
  mm46178_Slc4a10
tgagatttgctggcgtgaag

SEQ ID NO: 5024 - DNA, 20 bp, Artificial Sequence
  sgRNA
  mm46179_Slc4a10
ttcctgataccaagtcattg

SEQ ID NO: 5025 - DNA, 20 bp, Artificial Sequence
  sgRNA
  mm46204_Slc24a3
aatcccaattaagcacacag

SEQ ID NO: 5026 - DNA, 20 bp, Artificial Sequence
  sgRNA
  mm46205_Slc24a3
ggccccagagctgttcacgt

SEQ ID NO: 5027 - DNA, 20 bp, Artificial Sequence
  sgRNA
  mm46206_Slc24a3
cagcaactgcgatgccactg

SEQ ID NO: 5028 - DNA, 20 bp, Artificial Sequence
  sgRNA
  mm46207_Slc24a3
tccaatgaagaccgacgaca

SEQ ID NO: 5029 - DNA, 20 bp, Artificial Sequence
  sgRNA
  mm46244_Cadm3
ctggttataagtcatcattg

SEQ ID NO: 5030 - DNA, 20 bp, Artificial Sequence
  sgRNA
  mm46245_Cadm3
ctgaatccgattatctcgaa

SEQ ID NO: 5031 - DNA, 20 bp, Artificial Sequence
  sgRNA
  mm46246_Cadm3
agctgttgttacattgtgag

SEQ ID NO: 5032 - DNA, 20 bp, Artificial Sequence
  sgRNA
  mm46247_Cadm3
gacatctgatgaaacagttg

SEQ ID NO: 5033 - DNA, 20 bp, Artificial Sequence
  sgRNA
  mm46252_Loxl2
acagagcctaaatatacagg

SEQ ID NO: 5034 - DNA, 20 bp, Artificial Sequence
  sgRNA
  mm46253_Loxl2
tactggcaaagagtcgaccc

SEQ ID NO: 5035 - DNA, 20 bp, Artificial Sequence
  sgRNA
  mm46254_Loxl2
ggaaccttgagggtccatcg

SEQ ID NO: 5036 - DNA, 20 bp, Artificial Sequence
  sgRNA
  mm46255_Loxl2
ggggatgttgcatcgcaccc

SEQ ID NO: 5037 - DNA, 20 bp, Artificial Sequence
  sgRNA
  mm46260_Prg4
gcctgaacctacaaccccca

SEQ ID NO: 5038 - DNA, 20 bp, Artificial Sequence
  sgRNA
  mm46261_Prg4
tcagaattaggtgcaagact

SEQ ID NO: 5039 - DNA, 20 bp, Artificial Sequence
  sgRNA
  mm46262_Prg4
gcctgaacccacaactccca

SEQ ID NO: 5040 - DNA, 20 bp, Artificial Sequence
  sgRNA
  mm46263_Prg4
tcgagtccttcgctcgaggg

SEQ ID NO: 5041 - DNA, 20 bp, Artificial Sequence
  sgRNA
  mm46268_Tmem62
gccaaaacaaaggaacactt

SEQ ID NO: 5042 - DNA, 20 bp, Artificial Sequence
  sgRNA
  mm46269_Tmem62
tcagcccaccaagcgtatgg

SEQ ID NO: 5043 - DNA, 20 bp, Artificial Sequence
  sgRNA
  mm46270_Tmem62
gaatggaagagcctttctag

SEQ ID NO: 5044 - DNA, 20 bp, Artificial Sequence
  sgRNA
  mm46271_Tmem62
gaagccaacaacatcttctg

SEQ ID NO: 5045 - DNA, 20 bp, Artificial Sequence
  sgRNA
  mm46396_Tmem132a
agccgcaccggaatacgctg

SEQ ID NO: 5046 - DNA, 20 bp, Artificial Sequence
  sgRNA
  mm46397_Tmem132a
ggtctaacttagcagtccag

SEQ ID NO: 5047 - DNA, 20 bp, Artificial Sequence
  sgRNA
  mm46398_Tmem132a
tatgcgaggatcttgcacat

SEQ ID NO: 5048 - DNA, 20 bp, Artificial Sequence
  sgRNA
  mm46399_Tmem132a
accactctggaacaaatccg

SEQ ID NO: 5049 - DNA, 20 bp, Artificial Sequence
  sgRNA
  mm46436_Slamf9
gcagtggatcctcgataccg

SEQ ID NO: 5050 - DNA, 20 bp, Artificial Sequence
  sgRNA
  mm46437_Slamf9
gatggtaagacttcgtgatg

SEQ ID NO: 5051 - DNA, 20 bp, Artificial Sequence
  sgRNA
  mm46438_Slamf9
agcactaacacatcccatga

SEQ ID NO: 5052 - DNA, 20 bp, Artificial Sequence
  sgRNA
  mm46439_Slamf9
ttagagttcacagtgatgtg

SEQ ID NO: 5053 - DNA, 20 bp, Artificial Sequence
  sgRNA
  mm46572_Nat10
gtcaatccgatacgcccctg

SEQ ID NO: 5054 - DNA, 20 bp, Artificial Sequence
  sgRNA
  mm46573_Nat10
tcaccgctttattaaactcg

SEQ ID NO: 5055 - DNA, 20 bp, Artificial Sequence
  sgRNA
  mm46574_Nat10
tggtgggaagatttaacgag

SEQ ID NO: 5056 - DNA, 20 bp, Artificial Sequence
  sgRNA
  mm46575_Nat10
tgttcacccagattatcaag

SEQ ID NO: 5057 - DNA, 20 bp, Artificial Sequence
  sgRNA
  mm46632_Tm9sf4
gagttcatgtaccctacccg

SEQ ID NO: 5058 - DNA, 20 bp, Artificial Sequence
  sgRNA
  mm46633_Tm9sf4
tccggatgataatcatgctg

SEQ ID NO: 5059 - DNA, 20 bp, Artificial Sequence
  sgRNA
  mm46634_Tm9sf4
accgaactctaaaaggccat

SEQ ID NO: 5060 - DNA, 20 bp, Artificial Sequence
  sgRNA
  mm46635_Tm9sf4
tggcttcacggatgtcaaca

SEQ ID NO: 5061 - DNA, 20 bp, Artificial Sequence
  sgRNA
  mm46696_Fgg
ttagtgtactgtgaaatcga

SEQ ID NO: 5062 - DNA, 20 bp, Artificial Sequence
  sgRNA
  mm46697_Fgg
taacccacgagacaagcatt

SEQ ID NO: 5063 - DNA, 20 bp, Artificial Sequence
  sgRNA
  mm46698_Fgg
tgtcaggaaattgccaacaa

SEQ ID NO: 5064 - DNA, 20 bp, Artificial Sequence
  sgRNA
  mm46699_Fgg
atttcccagccaaaactctg

SEQ ID NO: 5065 - DNA, 20 bp, Artificial Sequence
  sgRNA
  mm46744_Kcnc4
gtgacggagattcatcgggt

SEQ ID NO: 5066 - DNA, 20 bp, Artificial Sequence
  sgRNA
  mm46745_Kcnc4
ctattatgccgagcgaattg

SEQ ID NO: 5067 - DNA, 20 bp, Artificial Sequence
  sgRNA
  mm46746_Kcnc4
agcatcgcggtgctgccggt

SEQ ID NO: 5068 - DNA, 20 bp, Artificial Sequence
  sgRNA
  mm46747_Kcnc4
gtacaaagcgtaccacacgc

SEQ ID NO: 5069 - DNA, 20 bp, Artificial Sequence
  sgRNA
  mm46808_Pcsk9
gctgccaggaacctacattg

SEQ ID NO: 5070 - DNA, 20 bp, Artificial Sequence
  sgRNA
  mm46809_Pcsk9
tggagcgaattatcccagca

SEQ ID NO: 5071 - DNA, 20 bp, Artificial Sequence
  sgRNA
  mm46810_Pcsk9
aggaccagccagttaccttg

SEQ ID NO: 5072 - DNA, 20 bp, Artificial Sequence
  sgRNA
  mm46811_Pcsk9
catgcttcatgtcacagagt

SEQ ID NO: 5073 - DNA, 20 bp, Artificial Sequence
  sgRNA
  mm46868_Smpdl3b
caaccgcatctataaccagg

SEQ ID NO: 5074 - DNA, 20 bp, Artificial Sequence
  sgRNA
  mm46869_Smpdl3b
gccaccggaactgctcgccg

SEQ ID NO: 5075 - DNA, 20 bp, Artificial Sequence
  sgRNA
  mm46870_Smpdl3b
ttattggccacgtgcccccg

SEQ ID NO: 5076 - DNA, 20 bp, Artificial Sequence
  sgRNA
  mm46871_Smpdl3b
agcaccatcgggtcatagca

SEQ ID NO: 5077 - DNA, 20 bp, Artificial Sequence
  sgRNA
  mm46880_Slc44a1
ctggaagcaataccgaacag

SEQ ID NO: 5078 - DNA, 20 bp, Artificial Sequence
  sgRNA
  mm46881_Slc44a1
gtacatgtggtggtaccacg

SEQ ID NO: 5079 - DNA, 20 bp, Artificial Sequence
  sgRNA
  mm46882_Slc44a1
gtggcacgggtgtattatgg

SEQ ID NO: 5080 - DNA, 20 bp, Artificial Sequence
  sgRNA
  mm46883_Slc44a1
caccatcgccttgttccacg

SEQ ID NO: 5081 - DNA, 20 bp, Artificial Sequence
  sgRNA
  mm46916_Slc15a4
gcgtggagggccgttcacag

SEQ ID NO: 5082 - DNA, 20 bp, Artificial Sequence
  sgRNA
  mm46917_Slc15a4
gacacgacgctgacccgttg

SEQ ID NO: 5083 - DNA, 20 bp, Artificial Sequence
  sgRNA
  mm46918_Slc15a4
tatcaccaccacccatcaca

SEQ ID NO: 5084 - DNA, 20 bp, Artificial Sequence
  sgRNA
  mm46919_Slc15a4
ccaattgaaaaatctccgag

SEQ ID NO: 5085 - DNA, 20 bp, Artificial Sequence
  sgRNA
  mm46920_Lrrc8c
agtggaccccggacaaactg

SEQ ID NO: 5086 - DNA, 20 bp, Artificial Sequence
  sgRNA
  mm46921_Lrrc8c
tggttgacaaatctgctgcg

SEQ ID NO: 5087 - DNA, 20 bp, Artificial Sequence
  sgRNA
  mm46922_Lrrc8c
ctcctgccggacatactcga

SEQ ID NO: 5088 - DNA, 20 bp, Artificial Sequence
  sgRNA
  mm46923_Lrrc8c
agacattgggaacggaagag

SEQ ID NO: 5089 - DNA, 20 bp, Artificial Sequence
  sgRNA
  mm47008_Emilin1
atgatacttcgggaacagtg

SEQ ID NO: 5090 - DNA, 20 bp, Artificial Sequence
  sgRNA
  mm47009_Emilin1
tgcccattgttacctccacg

SEQ ID NO: 5091 - DNA, 20 bp, Artificial Sequence
  sgRNA
  mm47010_Emilin1
acagtgctaagtggacgcag

SEQ ID NO: 5092 - DNA, 20 bp, Artificial Sequence
  sgRNA
  mm47011_Emilin1
gagggccggttacagctagt

SEQ ID NO: 5093 - DNA, 20 bp, Artificial Sequence
  sgRNA
  mm47068_Hepacam2
gtggacagtgtatgacggca

SEQ ID NO: 5094 - DNA, 20 bp, Artificial Sequence
  sgRNA
  mm47069_Hepacam2
tgagggcaattacatcgtga

SEQ ID NO: 5095 - DNA, 20 bp, Artificial Sequence
  sgRNA
  mm47070_Hepacam2
aggctccgttaataagtctg

SEQ ID NO: 5096 - DNA, 20 bp, Artificial Sequence
  sgRNA
  mm47071_Hepacam2
agttacttacaatatatggt

SEQ ID NO: 5097 - DNA, 20 bp, Artificial Sequence
  sgRNA
  mm47208_Ano1
ggagcgtcgagtacttctcg

SEQ ID NO: 5098 - DNA, 20 bp, Artificial Sequence
  sgRNA
  mm47209_Ano1
gaagagaacaacgtgcacca

SEQ ID NO: 5099 - DNA, 20 bp, Artificial Sequence
  sgRNA
  mm47210_Ano1
gatgaggctcaactaccgat

SEQ ID NO: 5100 - DNA, 20 bp, Artificial Sequence
  sgRNA
  mm47211_Ano1
tgacaaacgcttcagacggg

SEQ ID NO: 5101 - DNA, 20 bp, Artificial Sequence
  sgRNA
  mm47412_Cd276
cgcgtccgagtaaccgacga

SEQ ID NO: 5102 - DNA, 20 bp, Artificial Sequence
  sgRNA
  mm47413_Cd276
atcacgtgctctagctacca

SEQ ID NO: 5103 - DNA, 20 bp, Artificial Sequence
  sgRNA
  mm47414_Cd276
atcgaacaagccccgctcgt

SEQ ID NO: 5104 - DNA, 20 bp, Artificial Sequence
  sgRNA
  mm47415_Cd276
agctgtgccagactgaagcc

SEQ ID NO: 5105 - DNA, 20 bp, Artificial Sequence
  sgRNA
  mm47432_Slc6a8
ggaagcgccacacgttaccg

SEQ ID NO: 5106 - DNA, 20 bp, Artificial Sequence
  sgRNA
  mm47433_Slc6a8
gcatcagtgtgacagcccgt

SEQ ID NO: 5107 - DNA, 20 bp, Artificial Sequence
  sgRNA
  mm47434_Slc6a8
gcacaacgaggaccacgtag

SEQ ID NO: 5108 - DNA, 20 bp, Artificial Sequence
  sgRNA
  mm47435_Slc6a8
actcgatgacaggggaccgg

SEQ ID NO: 5109 - DNA, 20 bp, Artificial Sequence
  sgRNA
  mm47456_Slc6a15
ttcccggtaccagtaatagg

SEQ ID NO: 5110 - DNA, 20 bp, Artificial Sequence
  sgRNA
  mm47457_Slc6a15
gaaacatataaggaccacgt

SEQ ID NO: 5111 - DNA, 20 bp, Artificial Sequence
  sgRNA
  mm47458_Slc6a15
ttgttccaaacatgctgccg

SEQ ID NO: 5112 - DNA, 20 bp, Artificial Sequence
  sgRNA
  mm47459_Slc6a15
acataagccctaaattgggt

SEQ ID NO: 5113 - DNA, 20 bp, Artificial Sequence
  sgRNA
  mm47520_Ncln
gtaatgagccacgatgacaa

SEQ ID NO: 5114 - DNA, 20 bp, Artificial Sequence
  sgRNA
  mm47521_Ncln
gggggcaagttcaactacca

SEQ ID NO: 5115 - DNA, 20 bp, Artificial Sequence
  sgRNA
  mm47522_Ncln
ggagccgcataagcacgcag

SEQ ID NO: 5116 - DNA, 20 bp, Artificial Sequence
  sgRNA
  mm47523_Ncln
gtacacggtgaactcgtgcg

SEQ ID NO: 5117 - DNA, 20 bp, Artificial Sequence
  sgRNA
  mm47536_Mgat4b
ccacgcccatacctccggtg

SEQ ID NO: 5118 - DNA, 20 bp, Artificial Sequence
  sgRNA
  mm47537_Mgat4b
tctgcgagaccgtttgcacg

SEQ ID NO: 5119 - DNA, 20 bp, Artificial Sequence
  sgRNA
  mm47538_Mgat4b
tcatgaggaagcagtaatcg

SEQ ID NO: 5120 - DNA, 20 bp, Artificial Sequence
  sgRNA
  mm47539_Mgat4b
gaaggaagactcagtcatcg

SEQ ID NO: 5121 - DNA, 20 bp, Artificial Sequence
  sgRNA
  mm47568_Tmed4
gcttctcagtctcgccgatg

SEQ ID NO: 5122 - DNA, 20 bp, Artificial Sequence
  sgRNA
  mm47569_Tmed4
tatccttagcagcgatctcg

SEQ ID NO: 5123 - DNA, 20 bp, Artificial Sequence
  sgRNA
  mm47570_Tmed4
caactatcgaactcagatgt

SEQ ID NO: 5124 - DNA, 20 bp, Artificial Sequence
  sgRNA
  mm47571_Tmed4
agaatggctctcttcgctgg

SEQ ID NO: 5125 - DNA, 20 bp, Artificial Sequence
  sgRNA
  mm47640_Rpn1
tctcccgctacgattaccag

SEQ ID NO: 5126 - DNA, 20 bp, Artificial Sequence
  sgRNA
  mm47641_Rpn1
cgaggacgtgaagcgcacgg

SEQ ID NO: 5127 - DNA, 20 bp, Artificial Sequence
  sgRNA
  mm47642_Rpn1
tcacttgctcatcaaacacg

SEQ ID NO: 5128 - DNA, 20 bp, Artificial Sequence
  sgRNA
  mm47643_Rpn1
gtgagatacctcgatgaccc

SEQ ID NO: 5129 - DNA, 20 bp, Artificial Sequence
  sgRNA
  mm47720_Acly
gagagagattgaccccgacg

SEQ ID NO: 5130 - DNA, 20 bp, Artificial Sequence
  sgRNA
  mm47721_Acly
agagcgattcgagattacca

SEQ ID NO: 5131 - DNA, 20 bp, Artificial Sequence
  sgRNA
  mm47722_Acly
ttgtcacctgtacacgacgg

SEQ ID NO: 5132 - DNA, 20 bp, Artificial Sequence
  sgRNA
  mm47723_Acly
ggacgaaaagctgaataccg

SEQ ID NO: 5133 - DNA, 20 bp, Artificial Sequence
  sgRNA
  mm47896_Pld4
gatgggcgacacatctacgt

SEQ ID NO: 5134 - DNA, 20 bp, Artificial Sequence
  sgRNA
  mm47897_Pld4
agtgagggaccagtagtacg

SEQ ID NO: 5135 - DNA, 20 bp, Artificial Sequence
  sgRNA
  mm47898_Pld4
cagtcatcggatgttccctg

SEQ ID NO: 5136 - DNA, 20 bp, Artificial Sequence
  sgRNA
  mm47899_Pld4
gctatgtggatcatgagatg

SEQ ID NO: 5137 - DNA, 20 bp, Artificial Sequence
  sgRNA
  mm48012_Epdr1
gatcccaggattccaccaag

SEQ ID NO: 5138 - DNA, 20 bp, Artificial Sequence
  sgRNA
  mm48013_Epdr1
aagatcagtactccatcgga

SEQ ID NO: 5139 - DNA, 20 bp, Artificial Sequence
  sgRNA
  mm48014_Epdr1
gctgatcccctgcaagaggt

SEQ ID NO: 5140 - DNA, 20 bp, Artificial Sequence
  sgRNA
  mm48015_Epdr1
gcgctggttgagaccatcgt

SEQ ID NO: 5141 - DNA, 20 bp, Artificial Sequence
  sgRNA
  mm48016_Golm1
gaatgtcaacaagctacacc

SEQ ID NO: 5142 - DNA, 20 bp, Artificial Sequence
  sgRNA
  mm48017_Golm1
gattgctagctcgagaagcg

SEQ ID NO: 5143 - DNA, 20 bp, Artificial Sequence
  sgRNA
  mm48018_Golm1
gtgtgacgagcggatagagg

SEQ ID NO: 5144 - DNA, 20 bp, Artificial Sequence
  sgRNA
  mm48019_Golm1
acagatgccacaagagaaag

SEQ ID NO: 5145 - DNA, 20 bp, Artificial Sequence
  sgRNA
  mm48132_Ano6
ggtgataaacgagatcactc

SEQ ID NO: 5146 - DNA, 20 bp, Artificial Sequence
  sgRNA
  mm48133_Ano6
cagattcaactatgagtcgg

SEQ ID NO: 5147 - DNA, 20 bp, Artificial Sequence
  sgRNA
  mm48134_Ano6
tgaagaaggaatctctatcg

SEQ ID NO: 5148 - DNA, 20 bp, Artificial Sequence
  sgRNA
  mm48135_Ano6
caaattcgtgggctatcccg

SEQ ID NO: 5149 - DNA, 20 bp, Artificial Sequence
  sgRNA
  mm48136_Slc38a1
atactttggtgtgcacgcgt

SEQ ID NO: 5150 - DNA, 20 bp, Artificial Sequence
  sgRNA
  mm48137_Slc38a1
tgcatggtgtatgagaagct

SEQ ID NO: 5151 - DNA, 20 bp, Artificial Sequence
  sgRNA
  mm48138_Slc38a1
tcaccatcaccaccaacact

SEQ ID NO: 5152 - DNA, 20 bp, Artificial Sequence
  sgRNA
  mm48139_Slc38a1
agattggcaggacggacggg

SEQ ID NO: 5153 - DNA, 20 bp, Artificial Sequence
  sgRNA
  mm48184_Lmf2
agaaggcagtaagtcgtagg

SEQ ID NO: 5154 - DNA, 20 bp, Artificial Sequence
  sgRNA
  mm48185_Lmf2
cagaatgggaggtcttcatg

SEQ ID NO: 5155 - DNA, 20 bp, Artificial Sequence
  sgRNA
  mm48186_Lmf2
gcaggcactgagtctcatag

SEQ ID NO: 5156 - DNA, 20 bp, Artificial Sequence
  sgRNA
  mm48187_Lmf2
ctggggctggatactgccca

SEQ ID NO: 5157 - DNA, 20 bp, Artificial Sequence
  sgRNA
  mm48240_Slc45a4
aggtcgctcatgcttcggga

SEQ ID NO: 5158 - DNA, 20 bp, Artificial Sequence
  sgRNA
  mm48241_Slc45a4
cgtagccaatggccccacca

SEQ ID NO: 5159 - DNA, 20 bp, Artificial Sequence
  sgRNA
  mm48242_Slc45a4
gcatgacccataggcgtgtg

SEQ ID NO: 5160 - DNA, 20 bp, Artificial Sequence
  sgRNA
  mm48243_Slc45a4
ggaaaagtgcaacaccaatg

SEQ ID NO: 5161 - DNA, 20 bp, Artificial Sequence
  sgRNA
  mm48252_Txndc11
tgttgcaggaccatatcccg

SEQ ID NO: 5162 - DNA, 20 bp, Artificial Sequence
  sgRNA
  mm48253_Txndc11
tttggaccaatcgaatacaa

SEQ ID NO: 5163 - DNA, 20 bp, Artificial Sequence
  sgRNA
  mm48254_Txndc11
ggaatacaataactgtcatg

SEQ ID NO: 5164 - DNA, 20 bp, Artificial Sequence
  sgRNA
  mm48255_Txndc11
ctaaggataccagtctcgca

SEQ ID NO: 5165 - DNA, 20 bp, Artificial Sequence
  sgRNA
  mm48332_Itfg3
aaaggaaaaatgccactgtg

SEQ ID NO: 5166 - DNA, 20 bp, Artificial Sequence
  sgRNA
  mm48333_Itfg3
ctgtccatccagcaacacgc

SEQ ID NO: 5167 - DNA, 20 bp, Artificial Sequence
  sgRNA
  mm48334_Itfg3
gcagcatccaacataccaca

SEQ ID NO: 5168 - DNA, 20 bp, Artificial Sequence
  sgRNA
  mm48335_Itfg3
tggcatggcacactttacaa

SEQ ID NO: 5169 - DNA, 20 bp, Artificial Sequence
  sgRNA
  mm48444_Slc39a6
cgtggtccgagtgatgctcg

SEQ ID NO: 5170 - DNA, 20 bp, Artificial Sequence
  sgRNA
  mm48445_Slc39a6
aggaatcattctctccgtag

SEQ ID NO: 5171 - DNA, 20 bp, Artificial Sequence
  sgRNA
  mm48446_Slc39a6
cagccacggaacttacgtgt

SEQ ID NO: 5172 - DNA, 20 bp, Artificial Sequence
  sgRNA
  mm48447_Slc39a6
gacagcgttgtataccgccg

SEQ ID NO: 5173 - DNA, 20 bp, Artificial Sequence
  sgRNA
  mm48552_Tm9sf3
ggaagtctgtatgctagaca

SEQ ID NO: 5174 - DNA, 20 bp, Artificial Sequence
  sgRNA
  mm48553_Tm9sf3
gatgttaatctaactagtga

SEQ ID NO: 5175 - DNA, 20 bp, Artificial Sequence
  sgRNA
  mm48554_Tm9sf3
acgagcacgaacacacggtg

SEQ ID NO: 5176 - DNA, 20 bp, Artificial Sequence
  sgRNA
  mm48555_Tm9sf3
atagatgacttaccaatatg

SEQ ID NO: 5177 - DNA, 20 bp, Artificial Sequence
  sgRNA
  mm48580_Unc5a
ctgcgtggccaagaacatcg

SEQ ID NO: 5178 - DNA, 20 bp, Artificial Sequence
  sgRNA
  mm48581_Unc5a
tctcgtagatctttcctcgg

SEQ ID NO: 5179 - DNA, 20 bp, Artificial Sequence
  sgRNA
  mm48582_Unc5a
aacccggcacctctcaacgg

SEQ ID NO: 5180 - DNA, 20 bp, Artificial Sequence
  sgRNA
  mm48583_Unc5a
agcaggattgccaaccatgg

SEQ ID NO: 5181 - DNA, 20 bp, Artificial Sequence
  sgRNA
  mm48584_Unc5b
gcaggggcgaattagtcatg

SEQ ID NO: 5182 - DNA, 20 bp, Artificial Sequence
  sgRNA
  mm48585_Unc5b
cacaccatagacgatgactg

SEQ ID NO: 5183 - DNA, 20 bp, Artificial Sequence
  sgRNA
  mm48586_Unc5b
ggaggaactcttcgggctcg

SEQ ID NO: 5184 - DNA, 20 bp, Artificial Sequence
  sgRNA
  mm48587_Unc5b
cctgtatctacatatcaaca

SEQ ID NO: 5185 - DNA, 20 bp, Artificial Sequence
  sgRNA
  mm48600_Eprs
gacagtcagattccccccag

SEQ ID NO: 5186 - DNA, 20 bp, Artificial Sequence
  sgRNA
  mm48601_Eprs
atggtcacatttataaactg

SEQ ID NO: 5187 - DNA, 20 bp, Artificial Sequence
  sgRNA
  mm48602_Eprs
caataaagtcgctgcccaag

SEQ ID NO: 5188 - DNA, 20 bp, Artificial Sequence
  sgRNA
  mm48603_Eprs
ccacgaactgtaggaaaccg

SEQ ID NO: 5189 - DNA, 20 bp, Artificial Sequence
  sgRNA
  mm48604_Ssr1
gtcctgaggataacggaacg

SEQ ID NO: 5190 - DNA, 20 bp, Artificial Sequence
  sgRNA
  mm48605_Ssr1
acactgtagtgccaccccag

SEQ ID NO: 5191 - DNA, 20 bp, Artificial Sequence
  sgRNA
  mm48606_Ssr1
ccaaagggtcgtcctcccat

SEQ ID NO: 5192 - DNA, 20 bp, Artificial Sequence
  sgRNA
  mm48607_Ssr1
gccgcctcggagcagcacgg

SEQ ID NO: 5193 - DNA, 20 bp, Artificial Sequence
  sgRNA
  mm48608_Lgr4
ctgattcgtgaaattcacag

SEQ ID NO: 5194 - DNA, 20 bp, Artificial Sequence
  sgRNA
  mm48609_Lgr4
acagcactaccaagcttgaa

SEQ ID NO: 5195 - DNA, 20 bp, Artificial Sequence
  sgRNA
  mm48610_Lgr4
ccatattacctcagtcccgg

SEQ ID NO: 5196 - DNA, 20 bp, Artificial Sequence
  sgRNA
  mm48611_Lgr4
aagccctgtgaatatttact

SEQ ID NO: 5197 - DNA, 20 bp, Artificial Sequence
  sgRNA
  mm48612_Ece2
tcggtggttggaacataacg

SEQ ID NO: 5198 - DNA, 20 bp, Artificial Sequence
  sgRNA
  mm48613_Ece2
tttaggtagtaatctcgaga

SEQ ID NO: 5199 - DNA, 20 bp, Artificial Sequence
  sgRNA
  mm48614_Ece2
tactggagagtaatccacac

SEQ ID NO: 5200 - DNA, 20 bp, Artificial Sequence
  sgRNA
  mm48615_Ece2
ccaccttcttggtaccgtag

SEQ ID NO: 5201 - DNA, 20 bp, Artificial Sequence
  sgRNA
  mm48640_Col16a1
tgatgcaaatgggtacccac

SEQ ID NO: 5202 - DNA, 20 bp, Artificial Sequence
  sgRNA
  mm48641_Col16a1
ggaggaacctcagaacagca

SEQ ID NO: 5203 - DNA, 20 bp, Artificial Sequence
  sgRNA
  mm48642_Col16a1
gtatcgccaaaactaccctg

SEQ ID NO: 5204 - DNA, 20 bp, Artificial Sequence
  sgRNA
  mm48643_Col16a1
catcgagaaacacctcctca

SEQ ID NO: 5205 - DNA, 20 bp, Artificial Sequence
  sgRNA
  mm48656_Mylk
gaagccaaagaccatatccg

SEQ ID NO: 5206 - DNA, 20 bp, Artificial Sequence
  sgRNA
  mm48657_Mylk
ggtataccaaagcctgacgt

SEQ ID NO: 5207 - DNA, 20 bp, Artificial Sequence
  sgRNA
  mm48658_Mylk
ctgcacgttctttagaacca

SEQ ID NO: 5208 - DNA, 20 bp, Artificial Sequence
  sgRNA
  mm48659_Mylk
tgtcatccacactgtccgcg

SEQ ID NO: 5209 - DNA, 20 bp, Artificial Sequence
  sgRNA
  mm48680_Snrpd2
ccccatcaggcactgcaaca

SEQ ID NO: 5210 - DNA, 20 bp, Artificial Sequence
  sgRNA
  mm48681_Snrpd2
gactgcgtgagcactgagag

SEQ ID NO: 5211 - DNA, 20 bp, Artificial Sequence
  sgRNA
  mm48682_Snrpd2
caagagtgagatgaccccag

SEQ ID NO: 5212 - DNA, 20 bp, Artificial Sequence
  sgRNA
  mm48683_Snrpd2
tgtgaaggagatgtggactg

SEQ ID NO: 5213 - DNA, 20 bp, Artificial Sequence
  sgRNA
  mm48692_Slc12a6
aatccccaggatgttacgga

SEQ ID NO: 5214 - DNA, 20 bp, Artificial Sequence
  sgRNA
  mm48693_Slc12a6
aactatacaaatctgacaca

SEQ ID NO: 5215 - DNA, 20 bp, Artificial Sequence
  sgRNA
  mm48694_Slc12a6
aatggggggatggtatccgt

SEQ ID NO: 5216 - DNA, 20 bp, Artificial Sequence
  sgRNA
  mm48695_Slc12a6
caagatcgacacaattacac

SEQ ID NO: 5217 - DNA, 20 bp, Artificial Sequence
  sgRNA
  mm48784_Mgat5
ggtactggagccataaacag

SEQ ID NO: 5218 - DNA, 20 bp, Artificial Sequence
  sgRNA
  mm48785_Mgat5
gtcgcttgagaaaattaatg

SEQ ID NO: 5219 - DNA, 20 bp, Artificial Sequence
  sgRNA
  mm48786_Mgat5
ccttaatgtacctcttgctg

SEQ ID NO: 5220 - DNA, 20 bp, Artificial Sequence
  sgRNA
  mm48787_Mgat5
tttgctctccaaggtaaacg

SEQ ID NO: 5221 - DNA, 20 bp, Artificial Sequence
  sgRNA
  mm48792_Celsr3
gagttccactatcgaccgag

SEQ ID NO: 5222 - DNA, 20 bp, Artificial Sequence
  sgRNA
  mm48793_Celsr3
gtgctgataagacccgaacg

SEQ ID NO: 5223 - DNA, 20 bp, Artificial Sequence
  sgRNA
  mm48794_Celsr3
gtaccaccttcggctcaatg

SEQ ID NO: 5224 - DNA, 20 bp, Artificial Sequence
  sgRNA
  mm48795_Celsr3
aaagtaaaacagctccacgt

SEQ ID NO: 5225 - DNA, 20 bp, Artificial Sequence
  sgRNA
  mm48896_Grm3
ctcacggatcacgctgtcgt

SEQ ID NO: 5226 - DNA, 20 bp, Artificial Sequence
  sgRNA
  mm48897_Grm3
ggtattcatagggctcacat

SEQ ID NO: 5227 - DNA, 20 bp, Artificial Sequence
  sgRNA
  mm48898_Grm3
cagaggtatccaacgcctgg

SEQ ID NO: 5228 - DNA, 20 bp, Artificial Sequence
  sgRNA
  mm48899_Grm3
tgactcctgcaatgagtagt

SEQ ID NO: 5229 - DNA, 20 bp, Artificial Sequence
  sgRNA
  mm48900_Grm5
tagtcatgcattatatccgg

SEQ ID NO: 5230 - DNA, 20 bp, Artificial Sequence
  sgRNA
  mm48901_Grm5
gtacctgtcaagtcgtcagt

SEQ ID NO: 5231 - DNA, 20 bp, Artificial Sequence
  sgRNA
  mm48902_Grm5
gaccgatgccaattctctga

SEQ ID NO: 5232 - DNA, 20 bp, Artificial Sequence
  sgRNA
  mm48903_Grm5
aaatggatgatgatgaagtg

SEQ ID NO: 5233 - DNA, 20 bp, Artificial Sequence
  sgRNA
  mm48908_Grm7
tccgttggtgcaacgcacgt

SEQ ID NO: 5234 - DNA, 20 bp, Artificial Sequence
  sgRNA
  mm48909_Grm7
tgatactggtatccatcaca

SEQ ID NO: 5235 - DNA, 20 bp, Artificial Sequence
  sgRNA
  mm48910_Grm7
ccaacctaagagagcgactg

SEQ ID NO: 5236 - DNA, 20 bp, Artificial Sequence
  sgRNA
  mm48911_Grm7
gccctgcggcgacatcaaga

SEQ ID NO: 5237 - DNA, 20 bp, Artificial Sequence
  sgRNA
  mm48912_Ltbp4
attgacgagtgtcgtgaacg

SEQ ID NO: 5238 - DNA, 20 bp, Artificial Sequence
  sgRNA
  mm48913_Ltbp4
ggctgattgaaggtcactcg

SEQ ID NO: 5239 - DNA, 20 bp, Artificial Sequence
  sgRNA
  mm48914_Ltbp4
tcatgattgtcacccgtgcg

SEQ ID NO: 5240 - DNA, 20 bp, Artificial Sequence
  sgRNA
  mm48915_Ltbp4
aggccgctgcgacaacaccg

SEQ ID NO: 5241 - DNA, 20 bp, Artificial Sequence
  sgRNA
  mm48940_Slco1a5
ctggtaggaaacatcatacg

SEQ ID NO: 5242 - DNA, 20 bp, Artificial Sequence
  sgRNA
  mm48941_Slco1a5
agacagaaggtactcaaaca

SEQ ID NO: 5243 - DNA, 20 bp, Artificial Sequence
  sgRNA
  mm48942_Slco1a5
agaatacttaccggcccatg

SEQ ID NO: 5244 - DNA, 20 bp, Artificial Sequence
  sgRNA
  mm48943_Slco1a5
aatgaacggacatacctatg

SEQ ID NO: 5245 - DNA, 20 bp, Artificial Sequence
  sgRNA
  mm48976_Slco4a1
catccatctctacctcatag

SEQ ID NO: 5246 - DNA, 20 bp, Artificial Sequence
  sgRNA
  mm48977_Slco4a1
gcgctacgttgttatgagag

SEQ ID NO: 5247 - DNA, 20 bp, Artificial Sequence
  sgRNA
  mm48978_Slco4a1
tgaccactgacagcccactg

SEQ ID NO: 5248 - DNA, 20 bp, Artificial Sequence
  sgRNA
  mm48979_Slco4a1
aggtgcagtatgtgtcctcg

SEQ ID NO: 5249 - DNA, 20 bp, Artificial Sequence
  sgRNA
  mm48980_Slco3a1
taagttacttcggagcacgt

SEQ ID NO: 5250 - DNA, 20 bp, Artificial Sequence
  sgRNA
  mm48981_Slco3a1
gtgcctacctatgtagagcg

SEQ ID NO: 5251 - DNA, 20 bp, Artificial Sequence
  sgRNA
  mm48982_Slco3a1
tgggaacccaaacatcagga

SEQ ID NO: 5252 - DNA, 20 bp, Artificial Sequence
  sgRNA
  mm48983_Slco3a1
gaggctggcgagatccgatg

SEQ ID NO: 5253 - DNA, 20 bp, Artificial Sequence
  sgRNA
  mm48984_U2af1
tgcaggtgctgtgagcgacg

SEQ ID NO: 5254 - DNA, 20 bp, Artificial Sequence
  sgRNA
  mm48985_U2af1
ggtggggaacgtgtatgtca

SEQ ID NO: 5255 - DNA, 20 bp, Artificial Sequence
  sgRNA
  mm48986_U2af1
acacaaacctggctaaaggt

SEQ ID NO: 5256 - DNA, 20 bp, Artificial Sequence
  sgRNA
  mm48987_U2af1
aaaatcggagcatgtcgtca

SEQ ID NO: 5257 - DNA, 20 bp, Artificial Sequence
  sgRNA
  mm49108_Pttg1ip
cgtgtatggactacccagtg

SEQ ID NO: 5258 - DNA, 20 bp, Artificial Sequence
  sgRNA
  mm49109_Pttg1ip
aaattgagttccgctcgctg

SEQ ID NO: 5259 - DNA, 20 bp, Artificial Sequence
  sgRNA
  mm49110_Pttg1ip
ccgaggagcatcacccagtg

SEQ ID NO: 5260 - DNA, 20 bp, Artificial Sequence
  sgRNA
  mm49111_Pttg1ip
gcgcaggaacctccgagagt

SEQ ID NO: 5261 - DNA, 20 bp, Artificial Sequence
  sgRNA
  mm49424_Tspan9
acaacacagagaacaacgtg

SEQ ID NO: 5262 - DNA, 20 bp, Artificial Sequence
  sgRNA
  mm49425_Tspan9
gaagcccgtcaccatgacga

SEQ ID NO: 5263 - DNA, 20 bp, Artificial Sequence
  sgRNA
  mm49426_Tspan9
cccacagatgcggtgttgtg

SEQ ID NO: 5264 - DNA, 20 bp, Artificial Sequence
  sgRNA
  mm49427_Tspan9
cttcttcgtctacatggaca

SEQ ID NO: 5265 - DNA, 20 bp, Artificial Sequence
  sgRNA
  mm49480_Cdcp1
aggactgcctatagcagtag

SEQ ID NO: 5266 - DNA, 20 bp, Artificial Sequence
  sgRNA
  mm49481_Cdcp1
agttcgcaacccctcgactg

SEQ ID NO: 5267 - DNA, 20 bp, Artificial Sequence
  sgRNA
  mm49482_Cdcp1
atcatcgagtcagtatttga

SEQ ID NO: 5268 - DNA, 20 bp, Artificial Sequence
  sgRNA
  mm49483_Cdcp1
accgagttgattatcagacc

SEQ ID NO: 5269 - DNA, 20 bp, Artificial Sequence
  sgRNA
  mm49484_Pkn2
catcgttgtatcggatccag

SEQ ID NO: 5270 - DNA, 20 bp, Artificial Sequence
  sgRNA
  mm49485_Pkn2
tttgaagctagataatactg

SEQ ID NO: 5271 - DNA, 20 bp, Artificial Sequence
  sgRNA
  mm49486_Pkn2
tgtgccagaatgatttactg

SEQ ID NO: 5272 - DNA, 20 bp, Artificial Sequence
  sgRNA
  mm49487_Pkn2
atagaatttgcagtagccga

SEQ ID NO: 5273 - DNA, 20 bp, Artificial Sequence
  sgRNA
  mm49528_Upk1a
gaccggatcatgattgaggt

SEQ ID NO: 5274 - DNA, 20 bp, Artificial Sequence
  sgRNA
  mm49529_Upk1a
cgcccatcagtgggtacacg

SEQ ID NO: 5275 - DNA, 20 bp, Artificial Sequence
  sgRNA
  mm49530_Upk1a
ccacactgtctccgcaaaca

SEQ ID NO: 5276 - DNA, 20 bp, Artificial Sequence
  sgRNA
  mm49531_Upk1a
ccccactcacatagtcgcgg

SEQ ID NO: 5277 - DNA, 20 bp, Artificial Sequence
  sgRNA
  mm49560_Ank2
tcagaatcattatcccacct

SEQ ID NO: 5278 - DNA, 20 bp, Artificial Sequence
  sgRNA
  mm49561_Ank2
tgctcagtactccaccctcg

SEQ ID NO: 5279 - DNA, 20 bp, Artificial Sequence
  sgRNA
  mm49562_Ank2
accgcaacctggcttcaatg

SEQ ID NO: 5280 - DNA, 20 bp, Artificial Sequence
  sgRNA
  mm49563_Ank2
cagtgccatgattgacgaca

SEQ ID NO: 5281 - DNA, 20 bp, Artificial Sequence
  sgRNA
  mm49576_Itga1
attcggattctcgaacggtg

SEQ ID NO: 5282 - DNA, 20 bp, Artificial Sequence
  sgRNA
  mm49577_Itga1
actttagtcaccaatccgaa

SEQ ID NO: 5283 - DNA, 20 bp, Artificial Sequence
  sgRNA
  mm49578_Itga1
gcaaacaaaataggccgcag

SEQ ID NO: 5284 - DNA, 20 bp, Artificial Sequence
  sgRNA
  mm49579_Itga1
tggccggtgtgattgtaccg

SEQ ID NO: 5285 - DNA, 20 bp, Artificial Sequence
  sgRNA
  mm49672_Gusb
gtatcttgggtccatcgccg

SEQ ID NO: 5286 - DNA, 20 bp, Artificial Sequence
  sgRNA
  mm49673_Gusb
tgttcgaatcccgataggaa

SEQ ID NO: 5287 - DNA, 20 bp, Artificial Sequence
  sgRNA
  mm49674_Gusb
ggagcgcgcacctcccgtag

SEQ ID NO: 5288 - DNA, 20 bp, Artificial Sequence
  sgRNA
  mm49675_Gusb
ggtgtcagtcttgtagacga

SEQ ID NO: 5289 - DNA, 20 bp, Artificial Sequence
  sgRNA
  mm49696_Bmp3
tccaacgtagaaatacagtg

SEQ ID NO: 5290 - DNA, 20 bp, Artificial Sequence
  sgRNA
  mm49697_Bmp3
gagcacacgagctacccaag

SEQ ID NO: 5291 - DNA, 20 bp, Artificial Sequence
  sgRNA
  mm49698_Bmp3
tcgggctaccacctgtcgcg

SEQ ID NO: 5292 - DNA, 20 bp, Artificial Sequence
  sgRNA
  mm49699_Bmp3
accgtgttaccaccgcgcag

SEQ ID NO: 5293 - DNA, 20 bp, Artificial Sequence
  sgRNA
  mm49732_Fgb
gaagacgcgaagaagtactg

SEQ ID NO: 5294 - DNA, 20 bp, Artificial Sequence
  sgRNA
  mm49733_Fgb
ggagcacacgaagattaagg

SEQ ID NO: 5295 - DNA, 20 bp, Artificial Sequence
  sgRNA
  mm49734_Fgb
tgttgcaatgtacatcccgt

SEQ ID NO: 5296 - DNA, 20 bp, Artificial Sequence
  sgRNA
  mm49735_Fgb
tactctgtacggcttgatgg

SEQ ID NO: 5297 - DNA, 20 bp, Artificial Sequence
  sgRNA
  mm49864_Ly6a
ccatactttcaatattagga

SEQ ID NO: 5298 - DNA, 20 bp, Artificial Sequence
  sgRNA
  mm49865_Ly6a
gagtaacacagactccatca

SEQ ID NO: 5299 - DNA, 20 bp, Artificial Sequence
  sgRNA
  mm49866_Ly6a
ggtaggggcaggtaattgat

SEQ ID NO: 5300 - DNA, 20 bp, Artificial Sequence
  sgRNA
  mm49867_Ly6a
ttcttgcagattctcaaaca

SEQ ID NO: 5301 - DNA, 20 bp, Artificial Sequence
  sgRNA
  mm49892_H2-Q6
agacctgaaaacctggacgg

SEQ ID NO: 5302 - DNA, 20 bp, Artificial Sequence
  sgRNA
  mm49893_H2-Q6
cgggccaggacacagcagtg

SEQ ID NO: 5303 - DNA, 20 bp, Artificial Sequence
  sgRNA
  mm49894_H2-Q6
ggatgtatggctgtgacgtg

SEQ ID NO: 5304 - DNA, 20 bp, Artificial Sequence
  sgRNA
  mm49895_H2-Q6
acagaaagccaagggccatg

SEQ ID NO: 5305 - DNA, 20 bp, Artificial Sequence
  sgRNA
  mm49960_Adgrv1
ggacacgttgaggatcgaca

SEQ ID NO: 5306 - DNA, 20 bp, Artificial Sequence
  sgRNA
  mm49961_Adgrv1
acatccgaatacttccgctg

SEQ ID NO: 5307 - DNA, 20 bp, Artificial Sequence
  sgRNA
  mm49962_Adgrv1
tatggtgtaatacgaactcg

SEQ ID NO: 5308 - DNA, 20 bp, Artificial Sequence
  sgRNA
  mm49963_Adgrv1
tgatctgccggagttatccg

SEQ ID NO: 5309 - DNA, 20 bp, Artificial Sequence
  sgRNA
  mm50016_Kcnq3
gttcgcctttctaatcctcg

SEQ ID NO: 5310 - DNA, 20 bp, Artificial Sequence
  sgRNA
  mm50017_Kcnq3
ggatgttgctgtcgatacaa

SEQ ID NO: 5311 - DNA, 20 bp, Artificial Sequence
  sgRNA
  mm50018_Kcnq3
tgcgcatgcttcgaatggat

SEQ ID NO: 5312 - DNA, 20 bp, Artificial Sequence
  sgRNA
  mm50019_Kcnq3
caatcgaaggaacttactgc

SEQ ID NO: 5313 - DNA, 20 bp, Artificial Sequence
  sgRNA
  mm50056_Hspa13
gaggacaagacttcaatcag

SEQ ID NO: 5314 - DNA, 20 bp, Artificial Sequence
  sgRNA
  mm50057_Hspa13
gtgttggtcatagacttggg

SEQ ID NO: 5315 - DNA, 20 bp, Artificial Sequence
  sgRNA
  mm50058_Hspa13
aaatacaccaaccgaacagt

SEQ ID NO: 5316 - DNA, 20 bp, Artificial Sequence
  sgRNA
  mm50059_Hspa13
gacaattcatcagtctgccc

SEQ ID NO: 5317 - DNA, 20 bp, Artificial Sequence
  sgRNA
  mm50072_D1Pas1
cacaaggacgaactcgagag

SEQ ID NO: 5318 - DNA, 20 bp, Artificial Sequence
  sgRNA
  mm50073_D1Pas1
aaggcgttctacgacaaaga

SEQ ID NO: 5319 - DNA, 20 bp, Artificial Sequence
  sgRNA
  mm50074_D1Pas1
acatcacacagaaagtcgtg

SEQ ID NO: 5320 - DNA, 20 bp, Artificial Sequence
  sgRNA
  mm50075_D1Pas1
cggagtgactacgagagtgt

SEQ ID NO: 5321 - DNA, 20 bp, Artificial Sequence
  sgRNA
  mm50252_Kiss1r
gtcaacgcctcggatgaccc

SEQ ID NO: 5322 - DNA, 20 bp, Artificial Sequence
  sgRNA
  mm50253_Kiss1r
cggcggtgaagtgcacgcag

SEQ ID NO: 5323 - DNA, 20 bp, Artificial Sequence
  sgRNA
  mm50254_Kiss1r
acagttaccaacttctacat

SEQ ID NO: 5324 - DNA, 20 bp, Artificial Sequence
  sgRNA
  mm50255_Kiss1r
gtgcggggcgtacagccgca

SEQ ID NO: 5325 - DNA, 20 bp, Artificial Sequence
  sgRNA
  mm50280_Slc5a5
ctgcaccttgtacacgaccg

SEQ ID NO: 5326 - DNA, 20 bp, Artificial Sequence
  sgRNA
  mm50281_Slc5a5
gctggccgctagcttcatgt

SEQ ID NO: 5327 - DNA, 20 bp, Artificial Sequence
  sgRNA
  mm50282_Slc5a5
gtccaccagtatcaacgcta

SEQ ID NO: 5328 - DNA, 20 bp, Artificial Sequence
  sgRNA
  mm50283_Slc5a5
gtacatgccattgctcgtgt

SEQ ID NO: 5329 - DNA, 20 bp, Artificial Sequence
  sgRNA
  mm50296_Clic1
cacagacaccaacaagatcg

SEQ ID NO: 5330 - DNA, 20 bp, Artificial Sequence
  sgRNA
  mm50297_Clic1
caccttcaacgttaccactg

SEQ ID NO: 5331 - DNA, 20 bp, Artificial Sequence
  sgRNA
  mm50298_Clic1
tcttgcacagacctagagaa

SEQ ID NO: 5332 - DNA, 20 bp, Artificial Sequence
  sgRNA
  mm50299_Clic1
gagcaccatgaacagtctct

SEQ ID NO: 5333 - DNA, 20 bp, Artificial Sequence
  sgRNA
  mm50344_Ly6g5c
cttcggtctccagcagacat

SEQ ID NO: 5334 - DNA, 20 bp, Artificial Sequence
  sgRNA
  mm50345_Ly6g5c
tctaggtgataccaagctcg

SEQ ID NO: 5335 - DNA, 20 bp, Artificial Sequence
  sgRNA
  mm50346_Ly6g5c
gacattaaaaccgctgccta

SEQ ID NO: 5336 - DNA, 20 bp, Artificial Sequence
  sgRNA
  mm50347_Ly6g5c
tgttaagaggacagcacaca

SEQ ID NO: 5337 - DNA, 20 bp, Artificial Sequence
  sgRNA
  mm50348_Ly6g6d
aagcagacagtgatcacttg

SEQ ID NO: 5338 - DNA, 20 bp, Artificial Sequence
  sgRNA
  mm50349_Ly6g6d
cgcagtcatagcaccgcgtg

SEQ ID NO: 5339 - DNA, 20 bp, Artificial Sequence
  sgRNA
  mm50350_Ly6g6d
caagtggccatagagtcagt

SEQ ID NO: 5340 - DNA, 20 bp, Artificial Sequence
  sgRNA
  mm50351_Ly6g6d
gtgatggctcaaggtcgcgg

SEQ ID NO: 5341 - DNA, 20 bp, Artificial Sequence
  sgRNA
  mm50428_Dscaml1
gaagttcgctcagtacggcg

SEQ ID NO: 5342 - DNA, 20 bp, Artificial Sequence
  sgRNA
  mm50429_Dscaml1
aaggtcaatgcgtggcaacg

SEQ ID NO: 5343 - DNA, 20 bp, Artificial Sequence
  sgRNA
  mm50430_Dscaml1
gcggattggcatgtcccccg

SEQ ID NO: 5344 - DNA, 20 bp, Artificial Sequence
  sgRNA
  mm50431_Dscaml1
caggacgtggcgtatcagca

SEQ ID NO: 5345 - DNA, 20 bp, Artificial Sequence
  sgRNA
  mm50456_Fgfrl1
gatggccgcacaatccacag

SEQ ID NO: 5346 - DNA, 20 bp, Artificial Sequence
  sgRNA
  mm50457_Fgfrl1
cgtgaccacacatcacccgt

SEQ ID NO: 5347 - DNA, 20 bp, Artificial Sequence
  sgRNA
  mm50458_Fgfrl1
agcccatggtatttgcacct

SEQ ID NO: 5348 - DNA, 20 bp, Artificial Sequence
  sgRNA
  mm50459_Fgfrl1
cacgtgccgtgtatctaaca

SEQ ID NO: 5349 - DNA, 20 bp, Artificial Sequence
  sgRNA
  mm50588_Ttyh2
gaaacagcgagaccaacgat

SEQ ID NO: 5350 - DNA, 20 bp, Artificial Sequence
  sgRNA
  mm50589_Ttyh2
cctggtaagtttcgtcgccg

SEQ ID NO: 5351 - DNA, 20 bp, Artificial Sequence
  sgRNA
  mm50590_Ttyh2
acagggagccagatcaactc

SEQ ID NO: 5352 - DNA, 20 bp, Artificial Sequence
  sgRNA
  mm50591_Ttyh2
tcacctgtagtattccacat

SEQ ID NO: 5353 - DNA, 20 bp, Artificial Sequence
  sgRNA
  mm50592_Steap4
tgtgtactgtgcaatacgag

SEQ ID NO: 5354 - DNA, 20 bp, Artificial Sequence
  sgRNA
  mm50593_Steap4
gataatcaactagttccgtg

SEQ ID NO: 5355 - DNA, 20 bp, Artificial Sequence
  sgRNA
  mm50594_Steap4
aataccagggaggtacacca

SEQ ID NO: 5356 - DNA, 20 bp, Artificial Sequence
  sgRNA
  mm50595_Steap4
gttaaatgctttgaccacgt

SEQ ID NO: 5357 - DNA, 20 bp, Artificial Sequence
  sgRNA
  mm50632_B3galt6
gcgcgccaggtacaacagag

SEQ ID NO: 5358 - DNA, 20 bp, Artificial Sequence
  sgRNA
  mm50633_B3galt6
cctggtggacctacgcgcac

SEQ ID NO: 5359 - DNA, 20 bp, Artificial Sequence
  sgRNA
  mm50634_B3galt6
gttctcgtaggcgtcgcgca

SEQ ID NO: 5360 - DNA, 20 bp, Artificial Sequence
  sgRNA
  mm50635_B3galt6
tggcggacccgaggacgtgt

SEQ ID NO: 5361 - DNA, 20 bp, Artificial Sequence
  sgRNA
  mm50644_Boc
gggaagccgccgttccctcg

SEQ ID NO: 5362 - DNA, 20 bp, Artificial Sequence
  sgRNA
  mm50645_Boc
gtaggctgtaccgacgacgt

SEQ ID NO: 5363 - DNA, 20 bp, Artificial Sequence
  sgRNA
  mm50646_Boc
ccgatgtatggccagcaatg

SEQ ID NO: 5364 - DNA, 20 bp, Artificial Sequence
  sgRNA
  mm50647_Boc
ctacgtagtgaagcatcgta

SEQ ID NO: 5365 - DNA, 20 bp, Artificial Sequence
  sgRNA
  mm50668_Cspg4
ccacggttgaaagtacgcgt

SEQ ID NO: 5366 - DNA, 20 bp, Artificial Sequence
  sgRNA
  mm50669_Cspg4
ggaatcagccgacccctaag

SEQ ID NO: 5367 - DNA, 20 bp, Artificial Sequence
  sgRNA
  mm50670_Cspg4
aaggcccgctttgttcacga

SEQ ID NO: 5368 - DNA, 20 bp, Artificial Sequence
  sgRNA
  mm50671_Cspg4
gtcagtagaaacgaacgcgg

SEQ ID NO: 5369 - DNA, 20 bp, Artificial Sequence
  sgRNA
  mm50684_Strc
gctttaccaaaggacgactg

SEQ ID NO: 5370 - DNA, 20 bp, Artificial Sequence
  sgRNA
  mm50685_Strc
tgttattagagggtacacgc

SEQ ID NO: 5371 - DNA, 20 bp, Artificial Sequence
  sgRNA
  mm50686_Strc
agggccggagaagtgtactg

SEQ ID NO: 5372 - DNA, 20 bp, Artificial Sequence
  sgRNA
  mm50687_Strc
catgtcgataaagagttggg

SEQ ID NO: 5373 - DNA, 20 bp, Artificial Sequence
  sgRNA
  mm50708_Igf2bp1
agaggcttacgagaacgacg

SEQ ID NO: 5374 - DNA, 20 bp, Artificial Sequence
  sgRNA
  mm50709_Igf2bp1
atagcgcctacatactgcgt

SEQ ID NO: 5375 - DNA, 20 bp, Artificial Sequence
  sgRNA
  mm50710_Igf2bp1
tcatcgcccagtgctcgtcg

SEQ ID NO: 5376 - DNA, 20 bp, Artificial Sequence
  sgRNA
  mm50711_Igf2bp1
cgtcgggcgactcattggca

SEQ ID NO: 5377 - DNA, 20 bp, Artificial Sequence
  sgRNA
  mm50760_Igsf8
tcacgcctcacagtgcacga

SEQ ID NO: 5378 - DNA, 20 bp, Artificial Sequence
  sgRNA
  mm50761_Igsf8
gcagttctaagggttcgcct

SEQ ID NO: 5379 - DNA, 20 bp, Artificial Sequence
  sgRNA
  mm50762_Igsf8
ccattccggaggcgccagtg

SEQ ID NO: 5380 - DNA, 20 bp, Artificial Sequence
  sgRNA
  mm50763_Igsf8
tccacagatacgcagtacct

SEQ ID NO: 5381 - DNA, 20 bp, Artificial Sequence
  sgRNA
  mm50764_Plxnb2
gcagtactacgagtgtcggg

SEQ ID NO: 5382 - DNA, 20 bp, Artificial Sequence
  sgRNA
  mm50765_Plxnb2
tgacgtcaagaagataactg

SEQ ID NO: 5383 - DNA, 20 bp, Artificial Sequence
  sgRNA
  mm50766_Plxnb2
accgtccatccgtatcagca

SEQ ID NO: 5384 - DNA, 20 bp, Artificial Sequence
  sgRNA
  mm50767_Plxnb2
ttctcacggactttatctag

SEQ ID NO: 5385 - DNA, 20 bp, Artificial Sequence
  sgRNA
  mm50768_Plxnb3
ggacgagtgattcgagtcag

SEQ ID NO: 5386 - DNA, 20 bp, Artificial Sequence
  sgRNA
  mm50769_Plxnb3
gggcaccactaggcctactg

SEQ ID NO: 5387 - DNA, 20 bp, Artificial Sequence
  sgRNA
  mm50770_Plxnb3
gtgcccatctatgtaaccag

SEQ ID NO: 5388 - DNA, 20 bp, Artificial Sequence
  sgRNA
  mm50771_Plxnb3
ggggtggtacagaccacatg

SEQ ID NO: 5389 - DNA, 20 bp, Artificial Sequence
  sgRNA
  mm50792_Emid1
gacagtccgggtcaccacgt

SEQ ID NO: 5390 - DNA, 20 bp, Artificial Sequence
  sgRNA
  mm50793_Emid1
cgtggacggacagcggcatg

SEQ ID NO: 5391 - DNA, 20 bp, Artificial Sequence
  sgRNA
  mm50794_Emid1
cagtgacggcccgagaatgg

SEQ ID NO: 5392 - DNA, 20 bp, Artificial Sequence
  sgRNA
  mm50795_Emid1
gagtgctacagaactgcccg

SEQ ID NO: 5393 - DNA, 20 bp, Artificial Sequence
  sgRNA
  mm50836_Colec12
gactagtgtgttattcaagg

SEQ ID NO: 5394 - DNA, 20 bp, Artificial Sequence
  sgRNA
  mm50837_Colec12
ggagaagttgcaagcaaatg

SEQ ID NO: 5395 - DNA, 20 bp, Artificial Sequence
  sgRNA
  mm50838_Colec12
agaccttcaggacttacaca

SEQ ID NO: 5396 - DNA, 20 bp, Artificial Sequence
  sgRNA
  mm50839_Colec12
caacaacctgaacctaaccc

SEQ ID NO: 5397 - DNA, 20 bp, Artificial Sequence
  sgRNA
  mm50892_Tlr3
cttagatgaaatcccagtcg

SEQ ID NO: 5398 - DNA, 20 bp, Artificial Sequence
  sgRNA
  mm50893_Tlr3
gttgtaggaaagatcgagct

SEQ ID NO: 5399 - DNA, 20 bp, Artificial Sequence
  sgRNA
  mm50894_Tlr3
gaatggtcaagttacgaaga

SEQ ID NO: 5400 - DNA, 20 bp, Artificial Sequence
  sgRNA
  mm50895_Tlr3
atctacaaagttgggaacgg

SEQ ID NO: 5401 - DNA, 20 bp, Artificial Sequence
  sgRNA
  mm50936_Cntnap4
ggaggaccaaataactcctg

SEQ ID NO: 5402 - DNA, 20 bp, Artificial Sequence
  sgRNA
  mm50937_Cntnap4
ttgtgtccaacaaataccag

SEQ ID NO: 5403 - DNA, 20 bp, Artificial Sequence
  sgRNA
  mm50938_Cntnap4
aagattgtgattacggacac

SEQ ID NO: 5404 - DNA, 20 bp, Artificial Sequence
  sgRNA
  mm50939_Cntnap4
actcaccttgctgattaacg

SEQ ID NO: 5405 - DNA, 20 bp, Artificial Sequence
  sgRNA
  mm50956_Kirrel
tgggtaaactacaatccggg

SEQ ID NO: 5406 - DNA, 20 bp, Artificial Sequence
  sgRNA
  mm50957_Kirrel
gagcccacgacccggtaccg

SEQ ID NO: 5407 - DNA, 20 bp, Artificial Sequence
  sgRNA
  mm50958_Kirrel
caccattaataatgtcatgg

SEQ ID NO: 5408 - DNA, 20 bp, Artificial Sequence
  sgRNA
  mm50959_Kirrel
catcgtgcctcggatcggag

SEQ ID NO: 5409 - DNA, 20 bp, Artificial Sequence
  sgRNA
  mm51084_Tlr8
agttcaagaaattgcctcgg

SEQ ID NO: 5410 - DNA, 20 bp, Artificial Sequence
  sgRNA
  mm51085_Tlr8
ctccaagagttacttatcag

SEQ ID NO: 5411 - DNA, 20 bp, Artificial Sequence
  sgRNA
  mm51086_Tlr8
tactgaaatagtgtgcattg

SEQ ID NO: 5412 - DNA, 20 bp, Artificial Sequence
  sgRNA
  mm51087_Tlr8
aacttggcaaccatcaactt

SEQ ID NO: 5413 - DNA, 20 bp, Artificial Sequence
  sgRNA
  mm51180_Cd209e
tgaagaacgtccaatcccaa

SEQ ID NO: 5414 - DNA, 20 bp, Artificial Sequence
  sgRNA
  mm51181_Cd209e
ccaagaaaaatagctacacc

SEQ ID NO: 5415 - DNA, 20 bp, Artificial Sequence
  sgRNA
  mm51182_Cd209e
agtcatcatcaaaagtcatg

SEQ ID NO: 5416 - DNA, 20 bp, Artificial Sequence
  sgRNA
  mm51183_Cd209e
gctgcaacaccaggggaatg

SEQ ID NO: 5417 - DNA, 20 bp, Artificial Sequence
  sgRNA
  mm51184_Cd209a
caagttgagcccccacattg

SEQ ID NO: 5418 - DNA, 20 bp, Artificial Sequence
  sgRNA
  mm51185_Cd209a
gtgccaaggggacttgactg

SEQ ID NO: 5419 - DNA, 20 bp, Artificial Sequence
  sgRNA
  mm51186_Cd209a
acctacgccagccttcaact

SEQ ID NO: 5420 - DNA, 20 bp, Artificial Sequence
  sgRNA
  mm51187_Cd209a
ggaagtgcgtccagtcccag

SEQ ID NO: 5421 - DNA, 20 bp, Artificial Sequence
  sgRNA
  mm51276_Il17rc
ctgtggaacgatgacaacat

SEQ ID NO: 5422 - DNA, 20 bp, Artificial Sequence
  sgRNA
  mm51277_Il17rc
agcaatacttaccccagagg

SEQ ID NO: 5423 - DNA, 20 bp, Artificial Sequence
  sgRNA
  mm51278_Il17rc
ggagccacaagatttccagt

SEQ ID NO: 5424 - DNA, 20 bp, Artificial Sequence
  sgRNA
  mm51279_Il17rc
atctagctgccatacccctg

SEQ ID NO: 5425 - DNA, 20 bp, Artificial Sequence
  sgRNA
  mm51284_Fut10
ccagcatcatccgatgacca

SEQ ID NO: 5426 - DNA, 20 bp, Artificial Sequence
  sgRNA
  mm51285_Fut10
cgactgaacatataccaatg

SEQ ID NO: 5427 - DNA, 20 bp, Artificial Sequence
  sgRNA
  mm51286_Fut10
gtgggggatccgtaatacac

SEQ ID NO: 5428 - DNA, 20 bp, Artificial Sequence
  sgRNA
  mm51287_Fut10
actgcgtagtcagtggcaag

SEQ ID NO: 5429 - DNA, 20 bp, Artificial Sequence
  sgRNA
  mm51616_Havcr1
ggaatcacaacgacatgttg

SEQ ID NO: 5430 - DNA, 20 bp, Artificial Sequence
  sgRNA
  mm51617_Havcr1
tggtctgtattgttgtcgag

SEQ ID NO: 5431 - DNA, 20 bp, Artificial Sequence
  sgRNA
  mm51618_Havcr1
tccccatgagacaacagctg

SEQ ID NO: 5432 - DNA, 20 bp, Artificial Sequence
  sgRNA
  mm51619_Havcr1
gcagtcggtacaacttaaag

SEQ ID NO: 5433 - DNA, 20 bp, Artificial Sequence
  sgRNA
  mm51620_Timd2
gatatacggtcacacatcag

SEQ ID NO: 5434 - DNA, 20 bp, Artificial Sequence
  sgRNA
  mm51621_Timd2
ggaatcgttcctatgtgttg

SEQ ID NO: 5435 - DNA, 20 bp, Artificial Sequence
  sgRNA
  mm51622_Timd2
tgttggaagttaaaccaggt

SEQ ID NO: 5436 - DNA, 20 bp, Artificial Sequence
  sgRNA
  mm51623_Timd2
ctgatctggataaaatgtag

SEQ ID NO: 5437 - DNA, 20 bp, Artificial Sequence
  sgRNA
  mm51624_Havcr2
gttacactctatctacacct

SEQ ID NO: 5438 - DNA, 20 bp, Artificial Sequence
  sgRNA
  mm51625_Havcr2
ttctccaagaaccctaacca

SEQ ID NO: 5439 - DNA, 20 bp, Artificial Sequence
  sgRNA
  mm51626_Havcr2
ctaaagggcgatctcaacaa

SEQ ID NO: 5440 - DNA, 20 bp, Artificial Sequence
  sgRNA
  mm51627_Havcr2
atcagttctgagcaactcgt

SEQ ID NO: 5441 - DNA, 20 bp, Artificial Sequence
  sgRNA
  mm51632_Trpm8
caaaagcaagatcccttgtg

SEQ ID NO: 5442 - DNA, 20 bp, Artificial Sequence
  sgRNA
  mm51633_Trpm8
ctcacctttgtacagcgcat

SEQ ID NO: 5443 - DNA, 20 bp, Artificial Sequence
  sgRNA
  mm51634_Trpm8
cctgatgaagtacataggcg

SEQ ID NO: 5444 - DNA, 20 bp, Artificial Sequence
  sgRNA
  mm51635_Trpm8
gtccacacctaaatgatacg

SEQ ID NO: 5445 - DNA, 20 bp, Artificial Sequence
  sgRNA
  mm51644_Il17rd
tggccagaatcacatgaacg

SEQ ID NO: 5446 - DNA, 20 bp, Artificial Sequence
  sgRNA
  mm51645_Il17rd
cttcccgccgggattcaagt

SEQ ID NO: 5447 - DNA, 20 bp, Artificial Sequence
  sgRNA
  mm51646_Il17rd
actcgccttgcgcctcgccg

SEQ ID NO: 5448 - DNA, 20 bp, Artificial Sequence
  sgRNA
  mm51647_Il17rd
cctccaaaacgtttctccag

SEQ ID NO: 5449 - DNA, 20 bp, Artificial Sequence
  sgRNA
  mm51648_Gpr37l1
cctaccagaatgcccgcatg

SEQ ID NO: 5450 - DNA, 20 bp, Artificial Sequence
  sgRNA
  mm51649_Gpr37l1
gggcatagaccgattccatg

SEQ ID NO: 5451 - DNA, 20 bp, Artificial Sequence
  sgRNA
  mm51650_Gpr37l1
tctcggtcaccggatacagg

SEQ ID NO: 5452 - DNA, 20 bp, Artificial Sequence
  sgRNA
  mm51651_Gpr37l1
tcgaccccgaagaggcacca

SEQ ID NO: 5453 - DNA, 20 bp, Artificial Sequence
  sgRNA
  mm51744_Nlgn1
caaacacagtgattcgcaag

SEQ ID NO: 5454 - DNA, 20 bp, Artificial Sequence
  sgRNA
  mm51745_Nlgn1
gcgttccggatgtcagacca

SEQ ID NO: 5455 - DNA, 20 bp, Artificial Sequence
  sgRNA
  mm51746_Nlgn1
aaggctatgtggtatcgggc

SEQ ID NO: 5456 - DNA, 20 bp, Artificial Sequence
  sgRNA
  mm51747_Nlgn1
gtgagccaaagttcgagtga

SEQ ID NO: 5457 - DNA, 20 bp, Artificial Sequence
  sgRNA
  mm51772_Stab1
gtgtgcaaaaacgacgaggt

SEQ ID NO: 5458 - DNA, 20 bp, Artificial Sequence
  sgRNA
  mm51773_Stab1
gcttgtgtttcgctaccacg

SEQ ID NO: 5459 - DNA, 20 bp, Artificial Sequence
  sgRNA
  mm51774_Stab1
gcgacatcacgtgatccttg

SEQ ID NO: 5460 - DNA, 20 bp, Artificial Sequence
  sgRNA
  mm51775_Stab1
catccgtagactgagcctcg

SEQ ID NO: 5461 - DNA, 20 bp, Artificial Sequence
  sgRNA
  mm51776_Stab2
aatgcatccaagctagcacg

SEQ ID NO: 5462 - DNA, 20 bp, Artificial Sequence
  sgRNA
  mm51777_Stab2
gcagattctggcaaacaacg

SEQ ID NO: 5463 - DNA, 20 bp, Artificial Sequence
  sgRNA
  mm51778_Stab2
tcctgccgcacatttgcacg

SEQ ID NO: 5464 - DNA, 20 bp, Artificial Sequence
  sgRNA
  mm51779_Stab2
aggtaggaacaacttgcgtg

SEQ ID NO: 5465 - DNA, 20 bp, Artificial Sequence
  sgRNA
  mm51804_Lrrc4
ggctaagttgagttccacga

SEQ ID NO: 5466 - DNA, 20 bp, Artificial Sequence
  sgRNA
  mm51805_Lrrc4
aaggtggtgtgcacccgccg

SEQ ID NO: 5467 - DNA, 20 bp, Artificial Sequence
  sgRNA
  mm51806_Lrrc4
cccccaagtccagacgcatg

SEQ ID NO: 5468 - DNA, 20 bp, Artificial Sequence
  sgRNA
  mm51807_Lrrc4
ccagagtgttgagactggcg

SEQ ID NO: 5469 - DNA, 20 bp, Artificial Sequence
  sgRNA
  mm51820_Prom2
cgtgcgacgattcctctccg

SEQ ID NO: 5470 - DNA, 20 bp, Artificial Sequence
  sgRNA
  mm51821_Prom2
aacacacacatagtcagacg

SEQ ID NO: 5471 - DNA, 20 bp, Artificial Sequence
  sgRNA
  mm51822_Prom2
aacaatatgagacatacagg

SEQ ID NO: 5472 - DNA, 20 bp, Artificial Sequence
  sgRNA
  mm51823_Prom2
gccacgaggagaattgcaag

SEQ ID NO: 5473 - DNA, 20 bp, Artificial Sequence
  sgRNA
  mm51928_Trpv1
taagctgaataacaccgttg

SEQ ID NO: 5474 - DNA, 20 bp, Artificial Sequence
  sgRNA
  mm51929_Trpv1
aagccacatactccttgcga

SEQ ID NO: 5475 - DNA, 20 bp, Artificial Sequence
  sgRNA
  mm51930_Trpv1
cctgcgatcatagagccttg

SEQ ID NO: 5476 - DNA, 20 bp, Artificial Sequence
  sgRNA
  mm51931_Trpv1
gctccacgagaagcatgtcg

SEQ ID NO: 5477 - DNA, 20 bp, Artificial Sequence
  sgRNA
  mm52152_Ggt7
ggtcatgcaaatctacttcg

SEQ ID NO: 5478 - DNA, 20 bp, Artificial Sequence
  sgRNA
  mm52153_Ggt7
cgcaggcggtgtcataaccg

SEQ ID NO: 5479 - DNA, 20 bp, Artificial Sequence
  sgRNA
  mm52154_Ggt7
gcgacggcctgatctcgctg

SEQ ID NO: 5480 - DNA, 20 bp, Artificial Sequence
  sgRNA
  mm52155_Ggt7
tgttggtacatgatatccgg

SEQ ID NO: 5481 - DNA, 20 bp, Artificial Sequence
  sgRNA
  mm52200_Elfn2
gaacgagatttcctacatcg

SEQ ID NO: 5482 - DNA, 20 bp, Artificial Sequence
  sgRNA
  mm52201_Elfn2
gcaccaagtcaccttcacct

SEQ ID NO: 5483 - DNA, 20 bp, Artificial Sequence
  sgRNA
  mm52202_Elfn2
gatagtcatgatgtagtgcg

SEQ ID NO: 5484 - DNA, 20 bp, Artificial Sequence
  sgRNA
  mm52203_Elfn2
cctattccacggatgcgcag

SEQ ID NO: 5485 - DNA, 20 bp, Artificial Sequence
  sgRNA
  mm52228_Thsd4
tgataacacgggctgccagg

SEQ ID NO: 5486 - DNA, 20 bp, Artificial Sequence
  sgRNA
  mm52229_Thsd4
actatgagtacgtgatcatg

SEQ ID NO: 5487 - DNA, 20 bp, Artificial Sequence
  sgRNA
  mm52230_Thsd4
atgaaccagctgggacatcg

SEQ ID NO: 5488 - DNA, 20 bp, Artificial Sequence
  sgRNA
  mm52231_Thsd4
ttctgacgtgaatacctcag

SEQ ID NO: 5489 - DNA, 20 bp, Artificial Sequence
  sgRNA
  mm52380_Btla
cagtgcaacttactattacg

SEQ ID NO: 5490 - DNA, 20 bp, Artificial Sequence
  sgRNA
  mm52381_Btla
ttcatagacctaatgtgact

SEQ ID NO: 5491 - DNA, 20 bp, Artificial Sequence
  sgRNA
  mm52382_Btla
tcacatggatggttactgaa

SEQ ID NO: 5492 - DNA, 20 bp, Artificial Sequence
  sgRNA
  mm52383_Btla
tttgatacttacttattagt

SEQ ID NO: 5493 - DNA, 20 bp, Artificial Sequence
  sgRNA
  mm52408_Ghsr
gctcgacacccataccatca

SEQ ID NO: 5494 - DNA, 20 bp, Artificial Sequence
  sgRNA
  mm52409_Ghsr
caacctctacctatccagca

SEQ ID NO: 5495 - DNA, 20 bp, Artificial Sequence
  sgRNA
  mm52410_Ghsr
cggcactcgttggtgtcccg

SEQ ID NO: 5496 - DNA, 20 bp, Artificial Sequence
  sgRNA
  mm52411_Ghsr
caccacgaagagcgccacgc

SEQ ID NO: 5497 - DNA, 20 bp, Artificial Sequence
  sgRNA
  mm52424_Tmem132c
ttgggtgaggacgcgcactg

SEQ ID NO: 5498 - DNA, 20 bp, Artificial Sequence
  sgRNA
  mm52425_Tmem132c
aggaagctataatcagcaca

SEQ ID NO: 5499 - DNA, 20 bp, Artificial Sequence
  sgRNA
  mm52426_Tmem132c
ggaagagaatagcaccctga

SEQ ID NO: 5500 - DNA, 20 bp, Artificial Sequence
  sgRNA
  mm52427_Tmem132c
tagctgacgtttaataccgg

SEQ ID NO: 5501 - DNA, 20 bp, Artificial Sequence
  sgRNA
  mm52436_Tor1aip1
gaaaactcttagaacaccag

SEQ ID NO: 5502 - DNA, 20 bp, Artificial Sequence
  sgRNA
  mm52437_Tor1aip1
agagtcaaaacgagaagctg

SEQ ID NO: 5503 - DNA, 20 bp, Artificial Sequence
  sgRNA
  mm52438_Tor1aip1
agcgattctcttgagtcaag

SEQ ID NO: 5504 - DNA, 20 bp, Artificial Sequence
  sgRNA
  mm52439_Tor1aip1
accaaaatagtcccactgca

SEQ ID NO: 5505 - DNA, 20 bp, Artificial Sequence
  sgRNA
  mm52576_Tmem63a
agatgcgtatcccacgtgtg

SEQ ID NO: 5506 - DNA, 20 bp, Artificial Sequence
  sgRNA
  mm52577_Tmem63a
aaggtacctggtgagaccga

SEQ ID NO: 5507 - DNA, 20 bp, Artificial Sequence
  sgRNA
  mm52578_Tmem63a
ccagggccttcggtgcaaag

SEQ ID NO: 5508 - DNA, 20 bp, Artificial Sequence
  sgRNA
  mm52579_Tmem63a
cacccagcaagtctcccgag

SEQ ID NO: 5509 - DNA, 20 bp, Artificial Sequence
  sgRNA
  mm52712_Enox2
acacttaccagacagataga

SEQ ID NO: 5510 - DNA, 20 bp, Artificial Sequence
  sgRNA
  mm52713_Enox2
tctgaatagtggaccactgg

SEQ ID NO: 5511 - DNA, 20 bp, Artificial Sequence
  sgRNA
  mm52714_Enox2
tttgctaccggcatatctgg

SEQ ID NO: 5512 - DNA, 20 bp, Artificial Sequence
  sgRNA
  mm52715_Enox2
tgggacagagcagatcattg

SEQ ID NO: 5513 - DNA, 20 bp, Artificial Sequence
  sgRNA
  mm52728_Igsf1
ttcctggccccggattggaa

SEQ ID NO: 5514 - DNA, 20 bp, Artificial Sequence
  sgRNA
  mm52729_Igsf1
ggaacaattgaaagtcactc

SEQ ID NO: 5515 - DNA, 20 bp, Artificial Sequence
  sgRNA
  mm52730_Igsf1
acttggaatgtcttgtaagg

SEQ ID NO: 5516 - DNA, 20 bp, Artificial Sequence
  sgRNA
  mm52731_Igsf1
tagattaccaagtcccaact

SEQ ID NO: 5517 - DNA, 20 bp, Artificial Sequence
  sgRNA
  mm52744_Wfdc6a
ccagagagttaccttgcctg

SEQ ID NO: 5518 - DNA, 20 bp, Artificial Sequence
  sgRNA
  mm52745_Wfdc6a
aagagtcagagtgaagtgtg

SEQ ID NO: 5519 - DNA, 20 bp, Artificial Sequence
  sgRNA
  mm52746_Wfdc6a
aagaaagaaatgagtgtaca

SEQ ID NO: 5520 - DNA, 20 bp, Artificial Sequence
  sgRNA
  mm52747_Wfdc6a
aggtgttgcctgttcagctg

SEQ ID NO: 5521 - DNA, 20 bp, Artificial Sequence
  sgRNA
  mm52760_Itih5
gcatgctctactacgtcagg

SEQ ID NO: 5522 - DNA, 20 bp, Artificial Sequence
  sgRNA
  mm52761_Itih5
aaataaccattcagaacctg

SEQ ID NO: 5523 - DNA, 20 bp, Artificial Sequence
  sgRNA
  mm52762_Itih5
gcagaagctcttcataactg

SEQ ID NO: 5524 - DNA, 20 bp, Artificial Sequence
  sgRNA
  mm52763_Itih5
aggtgggtttcccatcggtg

SEQ ID NO: 5525 - DNA, 20 bp, Artificial Sequence
  sgRNA
  mm52820_Enpp3
ggtttgtatccggagtcaca

SEQ ID NO: 5526 - DNA, 20 bp, Artificial Sequence
  sgRNA
  mm52821_Enpp3
acatagatggtataaaaact

SEQ ID NO: 5527 - DNA, 20 bp, Artificial Sequence
  sgRNA
  mm52822_Enpp3
gtgcaatttattccgttgtg

SEQ ID NO: 5528 - DNA, 20 bp, Artificial Sequence
  sgRNA
  mm52823_Enpp3
atattacgagtcctgattcg

SEQ ID NO: 5529 - DNA, 20 bp, Artificial Sequence
  sgRNA
  mm52892_Slc38a5
agctacaggcaggaacgcga

SEQ ID NO: 5530 - DNA, 20 bp, Artificial Sequence
  sgRNA
  mm52893_Slc38a5
acctgccgggaaagtagtcg

SEQ ID NO: 5531 - DNA, 20 bp, Artificial Sequence
  sgRNA
  mm52894_Slc38a5
ggaaggtgccaataacaagg

SEQ ID NO: 5532 - DNA, 20 bp, Artificial Sequence
  sgRNA
  mm52895_Slc38a5
acctcagcaacgctatcatg

SEQ ID NO: 5533 - DNA, 20 bp, Artificial Sequence
  sgRNA
  mm52928_Iglon5
acagacggtttcacctcaga

SEQ ID NO: 5534 - DNA, 20 bp, Artificial Sequence
  sgRNA
  mm52929_Iglon5
gctgctcatcaacacacccg

SEQ ID NO: 5535 - DNA, 20 bp, Artificial Sequence
  sgRNA
  mm52930_Iglon5
tgtgaacatctcctcacccg

SEQ ID NO: 5536 - DNA, 20 bp, Artificial Sequence
  sgRNA
  mm52931_Iglon5
cacactgtatagttgtccgc

SEQ ID NO: 5537 - DNA, 20 bp, Artificial Sequence
  sgRNA
  mm52980_Gprc6a
ctactctgaaacatccatcg

SEQ ID NO: 5538 - DNA, 20 bp, Artificial Sequence
  sgRNA
  mm52981_Gprc6a
tcccgattgtcggatcaggt

SEQ ID NO: 5539 - DNA, 20 bp, Artificial Sequence
  sgRNA
  mm52982_Gprc6a
accagtatttaaatccccgt

SEQ ID NO: 5540 - DNA, 20 bp, Artificial Sequence
  sgRNA
  mm52983_Gprc6a
atgcaacaatgaaacccact

SEQ ID NO: 5541 - DNA, 20 bp, Artificial Sequence
  sgRNA
  mm53084_Unc5d
accatggcaagaatcactcg

SEQ ID NO: 5542 - DNA, 20 bp, Artificial Sequence
  sgRNA
  mm53085_Unc5d
gtgagtctactcataccaca

SEQ ID NO: 5543 - DNA, 20 bp, Artificial Sequence
  sgRNA
  mm53086_Unc5d
ctgtatggcagccaacatcg

SEQ ID NO: 5544 - DNA, 20 bp, Artificial Sequence
  sgRNA
  mm53087_Unc5d
acctgggaacgtccaagagt

SEQ ID NO: 5545 - DNA, 20 bp, Artificial Sequence
  sgRNA
  mm53172_Lrrc25
ctgcatggttcacccgagca

SEQ ID NO: 5546 - DNA, 20 bp, Artificial Sequence
  sgRNA
  mm53173_Lrrc25
cctgcaggccattcttagac

SEQ ID NO: 5547 - DNA, 20 bp, Artificial Sequence
  sgRNA
  mm53174_Lrrc25
ctggttgtgggtgacaatca

SEQ ID NO: 5548 - DNA, 20 bp, Artificial Sequence
  sgRNA
  mm53175_Lrrc25
ggcacctgcctcaatttcag

SEQ ID NO: 5549 - DNA, 20 bp, Artificial Sequence
  sgRNA
  mm53188_Cln5
gacaaaattcgaacagtcgt

SEQ ID NO: 5550 - DNA, 20 bp, Artificial Sequence
  sgRNA
  mm53189_Cln5
ccagcgttgcccagacgtcg

SEQ ID NO: 5551 - DNA, 20 bp, Artificial Sequence
  sgRNA
  mm53190_Cln5
gccccttggttacaccagaa

SEQ ID NO: 5552 - DNA, 20 bp, Artificial Sequence
  sgRNA
  mm53191_Cln5
atatttaaattcccaaatcg

SEQ ID NO: 5553 - DNA, 20 bp, Artificial Sequence
  sgRNA
  mm53196_Nrg1
agtcgtggagtgatgagctg

SEQ ID NO: 5554 - DNA, 20 bp, Artificial Sequence
  sgRNA
  mm53197_Nrg1
ggtggtcggcatcatgtgtg

SEQ ID NO: 5555 - DNA, 20 bp, Artificial Sequence
  sgRNA
  mm53198_Nrg1
gcaaggtgaccatgtcgctg

SEQ ID NO: 5556 - DNA, 20 bp, Artificial Sequence
  sgRNA
  mm53199_Nrg1
cagccatctcataaagtgtg

SEQ ID NO: 5557 - DNA, 20 bp, Artificial Sequence
  sgRNA
  mm53248_Tmem87a
gttgacttacaatcatcagt

SEQ ID NO: 5558 - DNA, 20 bp, Artificial Sequence
  sgRNA
  mm53249_Tmem87a
aggagtcctcagagttacag

SEQ ID NO: 5559 - DNA, 20 bp, Artificial Sequence
  sgRNA
  mm53250_Tmem87a
tttcagaatatccgatacaa

SEQ ID NO: 5560 - DNA, 20 bp, Artificial Sequence
  sgRNA
  mm53251_Tmem87a
agatgaaatagagtcatact

SEQ ID NO: 5561 - DNA, 20 bp, Artificial Sequence
  sgRNA
  mm53268_Mrgprf
gatgtgtcctggtatgagcg

SEQ ID NO: 5562 - DNA, 20 bp, Artificial Sequence
  sgRNA
  mm53269_Mrgprf
gctgaagaggtacatcccat

SEQ ID NO: 5563 - DNA, 20 bp, Artificial Sequence
  sgRNA
  mm53270_Mrgprf
tcttcgaatgtagtcgggga

SEQ ID NO: 5564 - DNA, 20 bp, Artificial Sequence
  sgRNA
  mm53271_Mrgprf
gaatgatagcatccagagca

SEQ ID NO: 5565 - DNA, 20 bp, Artificial Sequence
  sgRNA
  mm53280_Ptchd1
aacccaagtaggcctaacca

SEQ ID NO: 5566 - DNA, 20 bp, Artificial Sequence
  sgRNA
  mm53281_Ptchd1
tctgacggctagattcagtg

SEQ ID NO: 5567 - DNA, 20 bp, Artificial Sequence
  sgRNA
  mm53282_Ptchd1
tataatgggcaccaactcgg

SEQ ID NO: 5568 - DNA, 20 bp, Artificial Sequence
  sgRNA
  mm53283_Ptchd1
ttgaaatgttatcctcgtgg

SEQ ID NO: 5569 - DNA, 20 bp, Artificial Sequence
  sgRNA
  mm53584_Dse
gtcaaagtataagcatgacc

SEQ ID NO: 5570 - DNA, 20 bp, Artificial Sequence
  sgRNA
  mm53585_Dse
cagcacacagaacattgcca

SEQ ID NO: 5571 - DNA, 20 bp, Artificial Sequence
  sgRNA
  mm53586_Dse
agtttcatacatatagcccg

SEQ ID NO: 5572 - DNA, 20 bp, Artificial Sequence
  sgRNA
  mm53587_Dse
taatgaacggcacaccattg

SEQ ID NO: 5573 - DNA, 20 bp, Artificial Sequence
  sgRNA
  mm53624_Wbscr17
tgaccgaagtatcacagaca

SEQ ID NO: 5574 - DNA, 20 bp, Artificial Sequence
  sgRNA
  mm53625_Wbscr17
gggccacccttgaacatgga

SEQ ID NO: 5575 - DNA, 20 bp, Artificial Sequence
  sgRNA
  mm53626_Wbscr17
atctggaatagaccggtcca

SEQ ID NO: 5576 - DNA, 20 bp, Artificial Sequence
  sgRNA
  mm53627_Wbscr17
gctacgagaactccgcccac

SEQ ID NO: 5577 - DNA, 20 bp, Artificial Sequence
  sgRNA
  mm53664_Slc39a14
gagcgagcgatctcagatcg

SEQ ID NO: 5578 - DNA, 20 bp, Artificial Sequence
  sgRNA
  mm53665_Slc39a14
gtagagggttccaatcgcca

SEQ ID NO: 5579 - DNA, 20 bp, Artificial Sequence
  sgRNA
  mm53666_Slc39a14
taaaatggttatgcccgtga

SEQ ID NO: 5580 - DNA, 20 bp, Artificial Sequence
  sgRNA
  mm53667_Slc39a14
gtgaccgagaagctacagaa

SEQ ID NO: 5581 - DNA, 20 bp, Artificial Sequence
  sgRNA
  mm53708_Tapbpl
gccgccactccacgccagtg

SEQ ID NO: 5582 - DNA, 20 bp, Artificial Sequence
  sgRNA
  mm53709_Tapbpl
aaggcatcacagatttccag

SEQ ID NO: 5583 - DNA, 20 bp, Artificial Sequence
  sgRNA
  mm53710_Tapbpl
ggagcctgaggagctactca

SEQ ID NO: 5584 - DNA, 20 bp, Artificial Sequence
  sgRNA
  mm53711_Tapbpl
gaaatacttggagatctcgc

SEQ ID NO: 5585 - DNA, 20 bp, Artificial Sequence
  sgRNA
  mm53848_Slc44a3
aggatggcacacgtccacag

SEQ ID NO: 5586 - DNA, 20 bp, Artificial Sequence
  sgRNA
  mm53849_Slc44a3
gttcatcatgggttattcgg

SEQ ID NO: 5587 - DNA, 20 bp, Artificial Sequence
  sgRNA
  mm53850_Slc44a3
gaaccggaaggcgaacaaca

SEQ ID NO: 5588 - DNA, 20 bp, Artificial Sequence
  sgRNA
  mm53851_Slc44a3
ccaccacatataccgaatgc

SEQ ID NO: 5589 - DNA, 20 bp, Artificial Sequence
  sgRNA
  mm53884_Casd1
catgcacattcgagttctgg

SEQ ID NO: 5590 - DNA, 20 bp, Artificial Sequence
  sgRNA
  mm53885_Casd1
tgtgaataccttctctcgag

SEQ ID NO: 5591 - DNA, 20 bp, Artificial Sequence
  sgRNA
  mm53886_Casd1
tgtggtgttatgtatcgtaa

SEQ ID NO: 5592 - DNA, 20 bp, Artificial Sequence
  sgRNA
  mm53887_Casd1
gaagatagacgcctacaatg

SEQ ID NO: 5593 - DNA, 20 bp, Artificial Sequence
  sgRNA
  mm53932_Slc18a2
cgagccatacgtacctacga

SEQ ID NO: 5594 - DNA, 20 bp, Artificial Sequence
  sgRNA
  mm53933_Slc18a2
ccatctgctttgcaaacatg

SEQ ID NO: 5595 - DNA, 20 bp, Artificial Sequence
  sgRNA
  mm53934_Slc18a2
gtacatacctaagaccccca

SEQ ID NO: 5596 - DNA, 20 bp, Artificial Sequence
  sgRNA
  mm53935_Slc18a2
atgcagaatccagcaaacat

SEQ ID NO: 5597 - DNA, 20 bp, Artificial Sequence
  sgRNA
  mm53948_Nipal4
attcctttgcccgtaacgtg

SEQ ID NO: 5598 - DNA, 20 bp, Artificial Sequence
  sgRNA
  mm53949_Nipal4
gctacctgaaggacccaatg

SEQ ID NO: 5599 - DNA, 20 bp, Artificial Sequence
  sgRNA
  mm53950_Nipal4
tgcctctcacgatctgacag

SEQ ID NO: 5600 - DNA, 20 bp, Artificial Sequence
  sgRNA
  mm53951_Nipal4
ggatgacactggtgccgatg

SEQ ID NO: 5601 - DNA, 20 bp, Artificial Sequence
  sgRNA
  mm53988_Disp2
caagtgtaccggaagcaacg

SEQ ID NO: 5602 - DNA, 20 bp, Artificial Sequence
  sgRNA
  mm53989_Disp2
gcttccactaaacacagcgt

SEQ ID NO: 5603 - DNA, 20 bp, Artificial Sequence
  sgRNA
  mm53990_Disp2
ctacagtacagagtacggcc

SEQ ID NO: 5604 - DNA, 20 bp, Artificial Sequence
  sgRNA
  mm53991_Disp2
cgaaacttaatgacaccaca

SEQ ID NO: 5605 - DNA, 20 bp, Artificial Sequence
  sgRNA
  mm54068_Tmprss4
ccacggccaagaatccacag

SEQ ID NO: 5606 - DNA, 20 bp, Artificial Sequence
  sgRNA
  mm54069_Tmprss4
agggcaggctcaaacatact

SEQ ID NO: 5607 - DNA, 20 bp, Artificial Sequence
  sgRNA
  mm54070_Tmprss4
ctgtgacttgagcaacaggg

SEQ ID NO: 5608 - DNA, 20 bp, Artificial Sequence
  sgRNA
  mm54071_Tmprss4
gctgctgtgaggatccagtg

SEQ ID NO: 5609 - DNA, 20 bp, Artificial Sequence
  sgRNA
  mm54112_Sidt2
atagttgtaaccctcgtaag

SEQ ID NO: 5610 - DNA, 20 bp, Artificial Sequence
  sgRNA
  mm54113_Sidt2
tcttggaccatagatatcag

SEQ ID NO: 5611 - DNA, 20 bp, Artificial Sequence
  sgRNA
  mm54114_Sidt2
caaaaacgtcattcgaacca

SEQ ID NO: 5612 - DNA, 20 bp, Artificial Sequence
  sgRNA
  mm54115_Sidt2
tgttgtccagatcatagaca

SEQ ID NO: 5613 - DNA, 20 bp, Artificial Sequence
  sgRNA
  mm54188_Lman2l
tcttgacatagcgaatcacg

SEQ ID NO: 5614 - DNA, 20 bp, Artificial Sequence
  sgRNA
  mm54189_Lman2l
tcttaccacccggttccaca

SEQ ID NO: 5615 - DNA, 20 bp, Artificial Sequence
  sgRNA
  mm54190_Lman2l
tcgctgtcgaagccctacca

SEQ ID NO: 5616 - DNA, 20 bp, Artificial Sequence
  sgRNA
  mm54191_Lman2l
cttggcaatctggtacacaa

SEQ ID NO: 5617 - DNA, 20 bp, Artificial Sequence
  sgRNA
  mm54360_Rab11fip3
ggacggcttcgtccgcatcg

SEQ ID NO: 5618 - DNA, 20 bp, Artificial Sequence
  sgRNA
  mm54361_Rab11fip3
cgcaccgtgcctcttgacgg

SEQ ID NO: 5619 - DNA, 20 bp, Artificial Sequence
  sgRNA
  mm54362_Rab11fip3
ggagcagcagcaatgcacca

SEQ ID NO: 5620 - DNA, 20 bp, Artificial Sequence
  sgRNA
  mm54363_Rab11fip3
attctgtcacttgctcaagg

SEQ ID NO: 5621 - DNA, 20 bp, Artificial Sequence
  sgRNA
  mm54400_Rnpep
tgataacgtcggctaacgag

SEQ ID NO: 5622 - DNA, 20 bp, Artificial Sequence
  sgRNA
  mm54401_Rnpep
agcagtaacctttctcgtag

SEQ ID NO: 5623 - DNA, 20 bp, Artificial Sequence
  sgRNA
  mm54402_Rnpep
tgtgatgagtgcagacacct

SEQ ID NO: 5624 - DNA, 20 bp, Artificial Sequence
  sgRNA
  mm54403_Rnpep
tggcaccttaccaaacagga

SEQ ID NO: 5625 - DNA, 20 bp, Artificial Sequence
  sgRNA
  mm54464_Adgrg6
aatgctgttgatattagccg

SEQ ID NO: 5626 - DNA, 20 bp, Artificial Sequence
  sgRNA
  mm54465_Adgrg6
cttgtgtggaataattcttg

SEQ ID NO: 5627 - DNA, 20 bp, Artificial Sequence
  sgRNA
  mm54466_Adgrg6
catcactagaggatggactg

SEQ ID NO: 5628 - DNA, 20 bp, Artificial Sequence
  sgRNA
  mm54467_Adgrg6
cacatgcatctcattcacgc

SEQ ID NO: 5629 - DNA, 20 bp, Artificial Sequence
  sgRNA
  mm54504_Fam26f
gggacactggaacaccactg

SEQ ID NO: 5630 - DNA, 20 bp, Artificial Sequence
  sgRNA
  mm54505_Fam26f
cgctcccgctgacagcacat

SEQ ID NO: 5631 - DNA, 20 bp, Artificial Sequence
  sgRNA
  mm54506_Fam26f
ggtgaggggcgcgaatgccg

SEQ ID NO: 5632 - DNA, 20 bp, Artificial Sequence
  sgRNA
  mm54507_Fam26f
ggagcgcgcgattcagttcg

SEQ ID NO: 5633 - DNA, 20 bp, Artificial Sequence
  sgRNA
  mm54544_Lrrtm3
gggggttaacgtgatcgatg

SEQ ID NO: 5634 - DNA, 20 bp, Artificial Sequence
  sgRNA
  mm54545_Lrrtm3
caaccggcagatatactcga

SEQ ID NO: 5635 - DNA, 20 bp, Artificial Sequence
  sgRNA
  mm54546_Lrrtm3
cactgagaaccatcccggtg

SEQ ID NO: 5636 - DNA, 20 bp, Artificial Sequence
  sgRNA
  mm54547_Lrrtm3
tctcgtcgatattgctgatg

SEQ ID NO: 5637 - DNA, 20 bp, Artificial Sequence
  sgRNA
  mm54624_Ckap4
tctgtcggacgggatccacg

SEQ ID NO: 5638 - DNA, 20 bp, Artificial Sequence
  sgRNA
  mm54625_Ckap4
agaggacatccggagactgg

SEQ ID NO: 5639 - DNA, 20 bp, Artificial Sequence
  sgRNA
  mm54626_Ckap4
ccgcacctctgtgtagacgt

SEQ ID NO: 5640 - DNA, 20 bp, Artificial Sequence
  sgRNA
  mm54627_Ckap4
ccgcagaaccaggcgcaccg

SEQ ID NO: 5641 - DNA, 20 bp, Artificial Sequence
  sgRNA
  mm54672_Tspan8
tgaggcaaaagacttccaga

SEQ ID NO: 5642 - DNA, 20 bp, Artificial Sequence
  sgRNA
  mm54673_Tspan8
gtatgtggtacactgatctt

SEQ ID NO: 5643 - DNA, 20 bp, Artificial Sequence
  sgRNA
  mm54674_Tspan8
acgtacctcaggtttgaaag

SEQ ID NO: 5644 - DNA, 20 bp, Artificial Sequence
  sgRNA
  mm54675_Tspan8
agatattcacagcaatgaag

SEQ ID NO: 5645 - DNA, 20 bp, Artificial Sequence
  sgRNA
  mm54684_Tmem5
tgcataaattaaccactggg

SEQ ID NO: 5646 - DNA, 20 bp, Artificial Sequence
  sgRNA
  mm54685_Tmem5
gcgcccgaagaagacgtggt

SEQ ID NO: 5647 - DNA, 20 bp, Artificial Sequence
  sgRNA
  mm54686_Tmem5
atgtctgcaccattaatcca

SEQ ID NO: 5648 - DNA, 20 bp, Artificial Sequence
  sgRNA
  mm54687_Tmem5
tctttacagtgacttaccaa

SEQ ID NO: 5649 - DNA, 20 bp, Artificial Sequence
  sgRNA
  mm54900_Nlgn2
accagccgctcaagtacacg

SEQ ID NO: 5650 - DNA, 20 bp, Artificial Sequence
  sgRNA
  mm54901_Nlgn2
gctcacaaaaaaacgtgacg

SEQ ID NO: 5651 - DNA, 20 bp, Artificial Sequence
  sgRNA
  mm54902_Nlgn2
gaaagtgtaaaagtagacgg

SEQ ID NO: 5652 - DNA, 20 bp, Artificial Sequence
  sgRNA
  mm54903_Nlgn2
ccgagatcctcatgcaacag

SEQ ID NO: 5653 - DNA, 20 bp, Artificial Sequence
  sgRNA
  mm55124_Fam171a2
cccgagacttagcatcctcg

SEQ ID NO: 5654 - DNA, 20 bp, Artificial Sequence
  sgRNA
  mm55125_Fam171a2
gtggcccagataatggtcga

SEQ ID NO: 5655 - DNA, 20 bp, Artificial Sequence
  sgRNA
  mm55126_Fam171a2
ggtacccaggcggtaactga

SEQ ID NO: 5656 - DNA, 20 bp, Artificial Sequence
  sgRNA
  mm55127_Fam171a2
ctgtgggtacgaaatggcac

SEQ ID NO: 5657 - DNA, 20 bp, Artificial Sequence
  sgRNA
  mm55140_Abca9
tgggcgcttacaaagcgatg

SEQ ID NO: 5658 - DNA, 20 bp, Artificial Sequence
  sgRNA
  mm55141_Abca9
gctgcccatcgcaatgtaag

SEQ ID NO: 5659 - DNA, 20 bp, Artificial Sequence
  sgRNA
  mm55142_Abca9
taggtaagtacggacatcaa

SEQ ID NO: 5660 - DNA, 20 bp, Artificial Sequence
  sgRNA
  mm55143_Abca9
ctgggttggatccactctcg

SEQ ID NO: 5661 - DNA, 20 bp, Artificial Sequence
  sgRNA
  mm55208_Rhbdf2
acagatatcctcttgcggcg

SEQ ID NO: 5662 - DNA, 20 bp, Artificial Sequence
  sgRNA
  mm55209_Rhbdf2
gtgaacgaacgtcagccagt

SEQ ID NO: 5663 - DNA, 20 bp, Artificial Sequence
  sgRNA
  mm55210_Rhbdf2
taaagtggcagaatgatact

SEQ ID NO: 5664 - DNA, 20 bp, Artificial Sequence
  sgRNA
  mm55211_Rhbdf2
accagaaaagaatacagcgg

SEQ ID NO: 5665 - DNA, 20 bp, Artificial Sequence
  sgRNA
  mm55216_Tmc6
ggagtcatgtcgctccagag

SEQ ID NO: 5666 - DNA, 20 bp, Artificial Sequence
  sgRNA
  mm55217_Tmc6
tttccaaggtcgcagccgtg

SEQ ID NO: 5667 - DNA, 20 bp, Artificial Sequence
  sgRNA
  mm55218_Tmc6
gaccagaaaacgtaggcacg

SEQ ID NO: 5668 - DNA, 20 bp, Artificial Sequence
  sgRNA
  mm55219_Tmc6
taccgggttggcagtaccaa

SEQ ID NO: 5669 - DNA, 20 bp, Artificial Sequence
  sgRNA
  mm55316_Mgat2
gaagttcaactggtacacca

SEQ ID NO: 5670 - DNA, 20 bp, Artificial Sequence
  sgRNA
  mm55317_Mgat2
tgtaatggccgaaggagtca

SEQ ID NO: 5671 - DNA, 20 bp, Artificial Sequence
  sgRNA
  mm55318_Mgat2
aaaagtctggggctaagtag

SEQ ID NO: 5672 - DNA, 20 bp, Artificial Sequence
  sgRNA
  mm55319_Mgat2
ctggacgcggagcccgtacg

SEQ ID NO: 5673 - DNA, 20 bp, Artificial Sequence
  sgRNA
  mm55380_Tmem63c
cctgacctcactgatctacg

SEQ ID NO: 5674 - DNA, 20 bp, Artificial Sequence
  sgRNA
  mm55381_Tmem63c
gattacaagtacatccattg

SEQ ID NO: 5675 - DNA, 20 bp, Artificial Sequence
  sgRNA
  mm55382_Tmem63c
gaatgaccaccataaacacc

SEQ ID NO: 5676 - DNA, 20 bp, Artificial Sequence
  sgRNA
  mm55383_Tmem63c
tctcccaactccagttcacg

SEQ ID NO: 5677 - DNA, 20 bp, Artificial Sequence
  sgRNA
  mm55384_Pomt2
tggacagatccagtacggtg

SEQ ID NO: 5678 - DNA, 20 bp, Artificial Sequence
  sgRNA
  mm55385_Pomt2
gtagtccttatgcaaatagg

SEQ ID NO: 5679 - DNA, 20 bp, Artificial Sequence
  sgRNA
  mm55386_Pomt2
cctgcacagtcactatcatg

SEQ ID NO: 5680 - DNA, 20 bp, Artificial Sequence
  sgRNA
  mm55387_Pomt2
tctttatcatcgtgcaagtg

SEQ ID NO: 5681 - DNA, 20 bp, Artificial Sequence
  sgRNA
  mm55568_Clptm1l
cctacgacaagatctcattg

SEQ ID NO: 5682 - DNA, 20 bp, Artificial Sequence
  sgRNA
  mm55569_Clptm1l
tgagtgtttacaccaccaca

SEQ ID NO: 5683 - DNA, 20 bp, Artificial Sequence
  sgRNA
  mm55570_Clptm1l
ctggcgttgcttcagcactg

SEQ ID NO: 5684 - DNA, 20 bp, Artificial Sequence
  sgRNA
  mm55571_Clptm1l
caaacccccaggattcagct

SEQ ID NO: 5685 - DNA, 20 bp, Artificial Sequence
  sgRNA
  mm55592_Serinc5
ccagagagattagcacgcat

SEQ ID NO: 5686 - DNA, 20 bp, Artificial Sequence
  sgRNA
  mm55593_Serinc5
gcaccgtccgtaataagctg

SEQ ID NO: 5687 - DNA, 20 bp, Artificial Sequence
  sgRNA
  mm55594_Serinc5
tgccgggcctacattcacaa

SEQ ID NO: 5688 - DNA, 20 bp, Artificial Sequence
  sgRNA
  mm55595_Serinc5
acaccgcagaataccctacc

SEQ ID NO: 5689 - DNA, 20 bp, Artificial Sequence
  sgRNA
  mm55640_Il31ra
gaaggtgcgattgttgtgga

SEQ ID NO: 5690 - DNA, 20 bp, Artificial Sequence
  sgRNA
  mm55641_Il31ra
acgaactggaccatcgagca

SEQ ID NO: 5691 - DNA, 20 bp, Artificial Sequence
  sgRNA
  mm55642_Il31ra
aaccgcgtgaaaagactcgt

SEQ ID NO: 5692 - DNA, 20 bp, Artificial Sequence
  sgRNA
  mm55643_Il31ra
tgccagttcaccaccaacag

SEQ ID NO: 5693 - DNA, 20 bp, Artificial Sequence
  sgRNA
  mm55672_Slc4a7
tcaggaacataaggtccatg

SEQ ID NO: 5694 - DNA, 20 bp, Artificial Sequence
  sgRNA
  mm55673_Slc4a7
tctgcaaaggatcgaaccag

SEQ ID NO: 5695 - DNA, 20 bp, Artificial Sequence
  sgRNA
  mm55674_Slc4a7
acagtataggaaaagaatcg

SEQ ID NO: 5696 - DNA, 20 bp, Artificial Sequence
  sgRNA
  mm55675_Slc4a7
gcagatccattaggaaacac

SEQ ID NO: 5697 - DNA, 20 bp, Artificial Sequence
  sgRNA
  mm56140_Rtp2
gagcagtgttacgatgagga

SEQ ID NO: 5698 - DNA, 20 bp, Artificial Sequence
  sgRNA
  mm56141_Rtp2
gctatcagtgcggcacgtcg

SEQ ID NO: 5699 - DNA, 20 bp, Artificial Sequence
  sgRNA
  mm56142_Rtp2
atgctggaggagaatatcga

SEQ ID NO: 5700 - DNA, 20 bp, Artificial Sequence
  sgRNA
  mm56143_Rtp2
tggagcaacatgcctcaggc

SEQ ID NO: 5701 - DNA, 20 bp, Artificial Sequence
  sgRNA
  mm56152_Atp13a3
atagtgcaggactgacacag

SEQ ID NO: 5702 - DNA, 20 bp, Artificial Sequence
  sgRNA
  mm56153_Atp13a3
ttcagcgagtggaaaatacc

SEQ ID NO: 5703 - DNA, 20 bp, Artificial Sequence
  sgRNA
  mm56154_Atp13a3
ttaataagtactgcatcaca

SEQ ID NO: 5704 - DNA, 20 bp, Artificial Sequence
  sgRNA
  mm56155_Atp13a3
taaccggatcatgcctactg

SEQ ID NO: 5705 - DNA, 20 bp, Artificial Sequence
  sgRNA
  mm56212_Cldnd1
tgactcgaataaaatcgcct

SEQ ID NO: 5706 - DNA, 20 bp, Artificial Sequence
  sgRNA
  mm56213_Cldnd1
tgccgctattgtggttgccg

SEQ ID NO: 5707 - DNA, 20 bp, Artificial Sequence
  sgRNA
  mm56214_Cldnd1
atctacatggcggcctccat

SEQ ID NO: 5708 - DNA, 20 bp, Artificial Sequence
  sgRNA
  mm56215_Cldnd1
actggtatgcgccaccggaa

SEQ ID NO: 5709 - DNA, 20 bp, Artificial Sequence
  sgRNA
  mm56384_Adgrf5
gtacgctgtgactttccacg

SEQ ID NO: 5710 - DNA, 20 bp, Artificial Sequence
  sgRNA
  mm56385_Adgrf5
aagagcatggtgataaaacg

SEQ ID NO: 5711 - DNA, 20 bp, Artificial Sequence
  sgRNA
  mm56386_Adgrf5
tccctcgaattggaaaactg

SEQ ID NO: 5712 - DNA, 20 bp, Artificial Sequence
  sgRNA
  mm56387_Adgrf5
ctcaccgttccactctcggg

SEQ ID NO: 5713 - DNA, 20 bp, Artificial Sequence
  sgRNA
  mm56388_Enpp4
tgttatagacttgacccctg

SEQ ID NO: 5714 - DNA, 20 bp, Artificial Sequence
  sgRNA
  mm56389_Enpp4
aaggataccagaagtaaccg

SEQ ID NO: 5715 - DNA, 20 bp, Artificial Sequence
  sgRNA
  mm56390_Enpp4
tgatcattacaagcgatcat

SEQ ID NO: 5716 - DNA, 20 bp, Artificial Sequence
  sgRNA
  mm56391_Enpp4
gactgggtaacgttaccaca

SEQ ID NO: 5717 - DNA, 20 bp, Artificial Sequence
  sgRNA
  mm56400_Tmem63b
atgatcaaccccaaaccgtg

SEQ ID NO: 5718 - DNA, 20 bp, Artificial Sequence
  sgRNA
  mm56401_Tmem63b
cagtagcgtagggaagaact

SEQ ID NO: 5719 - DNA, 20 bp, Artificial Sequence
  sgRNA
  mm56402_Tmem63b
gctctgtcgactttgaccaa

SEQ ID NO: 5720 - DNA, 20 bp, Artificial Sequence
  sgRNA
  mm56403_Tmem63b
aaagtgaacgagaaacctct

SEQ ID NO: 5721 - DNA, 20 bp, Artificial Sequence
  sgRNA
  mm56672_Mppe1
attggctggacaaattacga

SEQ ID NO: 5722 - DNA, 20 bp, Artificial Sequence
  sgRNA
  mm56673_Mppe1
aagtggagctccgatcaggt

SEQ ID NO: 5723 - DNA, 20 bp, Artificial Sequence
  sgRNA
  mm56674_Mppe1
catggtcaacagcgttgcaa

SEQ ID NO: 5724 - DNA, 20 bp, Artificial Sequence
  sgRNA
  mm56675_Mppe1
taaactgaattgctcccaag

SEQ ID NO: 5725 - DNA, 20 bp, Artificial Sequence
  sgRNA
  mm56704_Cd226
attgacgcataacttaaccc

SEQ ID NO: 5726 - DNA, 20 bp, Artificial Sequence
  sgRNA
  mm56705_Cd226
acttcctaaactcaacagtg

SEQ ID NO: 5727 - DNA, 20 bp, Artificial Sequence
  sgRNA
  mm56706_Cd226
gctaagatgtctacctgatg

SEQ ID NO: 5728 - DNA, 20 bp, Artificial Sequence
  sgRNA
  mm56707_Cd226
tgcagacaggtagctatccg

SEQ ID NO: 5729 - DNA, 20 bp, Artificial Sequence
  sgRNA
  mm56732_Lrfn4
caaaggagcgagccccaatg

SEQ ID NO: 5730 - DNA, 20 bp, Artificial Sequence
  sgRNA
  mm56733_Lrfn4
gctgtttgtgccacccaacg

SEQ ID NO: 5731 - DNA, 20 bp, Artificial Sequence
  sgRNA
  mm56734_Lrfn4
tgtgtgtgccgggcaatcag

SEQ ID NO: 5732 - DNA, 20 bp, Artificial Sequence
  sgRNA
  mm56735_Lrfn4
ctcatcgatgcactaccccc

SEQ ID NO: 5733 - DNA, 20 bp, Artificial Sequence
  sgRNA
  mm56836_Ermp1
gcatctccgtagatatacag

SEQ ID NO: 5734 - DNA, 20 bp, Artificial Sequence
  sgRNA
  mm56837_Ermp1
attgcgtacccttctcgtgt

SEQ ID NO: 5735 - DNA, 20 bp, Artificial Sequence
  sgRNA
  mm56838_Ermp1
gatgttgagtaataaaacca

SEQ ID NO: 5736 - DNA, 20 bp, Artificial Sequence
  sgRNA
  mm56839_Ermp1
tggtgctgagccggacctcg

SEQ ID NO: 5737 - DNA, 20 bp, Artificial Sequence
  sgRNA
  mm57020_Lamc1
atgtagcgatgggtactatg

SEQ ID NO: 5738 - DNA, 20 bp, Artificial Sequence
  sgRNA
  mm57021_Lamc1
ttgacctctatcaagatccg

SEQ ID NO: 5739 - DNA, 20 bp, Artificial Sequence
  sgRNA
  mm57022_Lamc1
acgtactcaaaggctaaccg

SEQ ID NO: 5740 - DNA, 20 bp, Artificial Sequence
  sgRNA
  mm57023_Lamc1
cagtcgcggccagacacatg

SEQ ID NO: 5741 - DNA, 20 bp, Artificial Sequence
  sgRNA
  mm57200_Slc39a10
cgtgcgtatgctgatgactg

SEQ ID NO: 5742 - DNA, 20 bp, Artificial Sequence
  sgRNA
  mm57201_Slc39a10
tgaacaatatgagcataacc

SEQ ID NO: 5743 - DNA, 20 bp, Artificial Sequence
  sgRNA
  mm57202_Slc39a10
agtcgttgagattaatcacg

SEQ ID NO: 5744 - DNA, 20 bp, Artificial Sequence
  sgRNA
  mm57203_Slc39a10
cgatctgatacagcaatgca

SEQ ID NO: 5745 - DNA, 20 bp, Artificial Sequence
  sgRNA
  mm57256_Aamp
tggatgtggaaggtcccgaa

SEQ ID NO: 5746 - DNA, 20 bp, Artificial Sequence
  sgRNA
  mm57257_Aamp
atcaccgagcctccacacga

SEQ ID NO: 5747 - DNA, 20 bp, Artificial Sequence
  sgRNA
  mm57258_Aamp
aagaccactcatgtcccctg

SEQ ID NO: 5748 - DNA, 20 bp, Artificial Sequence
  sgRNA
  mm57259_Aamp
ggagggcccggatgatagtg

SEQ ID NO: 5749 - DNA, 20 bp, Artificial Sequence
  sgRNA
  mm57268_Dner
aacactctaagtcatttgag

SEQ ID NO: 5750 - DNA, 20 bp, Artificial Sequence
  sgRNA
  mm57269_Dner
cattcccacaggcaacatca

SEQ ID NO: 5751 - DNA, 20 bp, Artificial Sequence
  sgRNA
  mm57270_Dner
gaacaatggcacttgctacg

SEQ ID NO: 5752 - DNA, 20 bp, Artificial Sequence
  sgRNA
  mm57271_Dner
cacacttcgaccatctatga

SEQ ID NO: 5753 - DNA, 20 bp, Artificial Sequence
  sgRNA
  mm57304_Slco4c1
ttatagttcggatctgactg

SEQ ID NO: 5754 - DNA, 20 bp, Artificial Sequence
  sgRNA
  mm57305_Slco4c1
acaaagatacgtgcttaaca

SEQ ID NO: 5755 - DNA, 20 bp, Artificial Sequence
  sgRNA
  mm57306_Slco4c1
tttccccttagaatttgatg

SEQ ID NO: 5756 - DNA, 20 bp, Artificial Sequence
  sgRNA
  mm57307_Slco4c1
agagaggacacaaacctcgc

SEQ ID NO: 5757 - DNA, 20 bp, Artificial Sequence
  sgRNA
  mm57400_Qsox2
tggtgcagttccactcgtcg

SEQ ID NO: 5758 - DNA, 20 bp, Artificial Sequence
  sgRNA
  mm57401_Qsox2
gaggagaaaaacgatcgtag

SEQ ID NO: 5759 - DNA, 20 bp, Artificial Sequence
  sgRNA
  mm57402_Qsox2
agaagtggatgtcatatgtg

SEQ ID NO: 5760 - DNA, 20 bp, Artificial Sequence
  sgRNA
  mm57403_Qsox2
gggatgtcaaggaagtcgat

SEQ ID NO: 5761 - DNA, 20 bp, Artificial Sequence
  sgRNA
  mm57612_Lrp4
atagtgccaacaagtttacg

SEQ ID NO: 5762 - DNA, 20 bp, Artificial Sequence
  sgRNA
  mm57613_Lrp4
tgacatctgtccaatacacg

SEQ ID NO: 5763 - DNA, 20 bp, Artificial Sequence
  sgRNA
  mm57614_Lrp4
gacaacagtgacgagcaatg

SEQ ID NO: 5764 - DNA, 20 bp, Artificial Sequence
  sgRNA
  mm57615_Lrp4
tggtataatacaatggcccg

SEQ ID NO: 5765 - DNA, 20 bp, Artificial Sequence
  sgRNA
  mm58020_Pbxip1
tgttgataccctgattctcg

SEQ ID NO: 5766 - DNA, 20 bp, Artificial Sequence
  sgRNA
  mm58021_Pbxip1
gagcctcggaccagacacac

SEQ ID NO: 5767 - DNA, 20 bp, Artificial Sequence
  sgRNA
  mm58022_Pbxip1
cgtggtacccgtagatgtgg

SEQ ID NO: 5768 - DNA, 20 bp, Artificial Sequence
  sgRNA
  mm58023_Pbxip1
tatgctgctccaataagctg

SEQ ID NO: 5769 - DNA, 20 bp, Artificial Sequence
  sgRNA
  mm58060_Adamtsl4
tgagatttcccgaaaccagg

SEQ ID NO: 5770 - DNA, 20 bp, Artificial Sequence
  sgRNA
  mm58061_Adamtsl4
ggggaatccgcacctgacgt

SEQ ID NO: 5771 - DNA, 20 bp, Artificial Sequence
  sgRNA
  mm58062_Adamtsl4
catactgataaaaaacacct

SEQ ID NO: 5772 - DNA, 20 bp, Artificial Sequence
  sgRNA
  mm58063_Adamtsl4
gaactgaactgccgcccccg

SEQ ID NO: 5773 - DNA, 20 bp, Artificial Sequence
  sgRNA
  mm58136_Amigo1
gcttgcagtcgcactccaag

SEQ ID NO: 5774 - DNA, 20 bp, Artificial Sequence
  sgRNA
  mm58137_Amigo1
cgggacaactaaccacagat

SEQ ID NO: 5775 - DNA, 20 bp, Artificial Sequence
  sgRNA
  mm58138_Amigo1
agtacctaaggttgggtacg

SEQ ID NO: 5776 - DNA, 20 bp, Artificial Sequence
  sgRNA
  mm58139_Amigo1
gcaaggcatgaccaaagtgt

SEQ ID NO: 5777 - DNA, 20 bp, Artificial Sequence
  sgRNA
  mm58248_Npr2
cagcggggtacacacaaccg

SEQ ID NO: 5778 - DNA, 20 bp, Artificial Sequence
  sgRNA
  mm58249_Npr2
atggcaggacaatcgaaccc

SEQ ID NO: 5779 - DNA, 20 bp, Artificial Sequence
  sgRNA
  mm58250_Npr2
acaggacgaaatcagtctcg

SEQ ID NO: 5780 - DNA, 20 bp, Artificial Sequence
  sgRNA
  mm58251_Npr2
caactcggatcgctatcaca

SEQ ID NO: 5781 - DNA, 20 bp, Artificial Sequence
  sgRNA
  mm58268_Tmeff1
gcaccagaaagacataaccg

SEQ ID NO: 5782 - DNA, 20 bp, Artificial Sequence
  sgRNA
  mm58269_Tmeff1
attgttataggaactcccgt

SEQ ID NO: 5783 - DNA, 20 bp, Artificial Sequence
  sgRNA
  mm58270_Tmeff1
ccctgtctgtgggtcaaacg

SEQ ID NO: 5784 - DNA, 20 bp, Artificial Sequence
  sgRNA
  mm58271_Tmeff1
cgccgtctgcggctacacgt

SEQ ID NO: 5785 - DNA, 20 bp, Artificial Sequence
  sgRNA
  mm58312_Megf9
ggacggacacactcccacca

SEQ ID NO: 5786 - DNA, 20 bp, Artificial Sequence
  sgRNA
  mm58313_Megf9
tgggaattgccaatgcaaag

SEQ ID NO: 5787 - DNA, 20 bp, Artificial Sequence
  sgRNA
  mm58314_Megf9
caccacagtccgcaaaaccg

SEQ ID NO: 5788 - DNA, 20 bp, Artificial Sequence
  sgRNA
  mm58315_Megf9
ctgtgtaaccatctttacat

SEQ ID NO: 5789 - DNA, 20 bp, Artificial Sequence
  sgRNA
  mm58364_Fam151a
atcaatgctgacatcctgag

SEQ ID NO: 5790 - DNA, 20 bp, Artificial Sequence
  sgRNA
  mm58365_Fam151a
gtactggcctcatctcagaa

SEQ ID NO: 5791 - DNA, 20 bp, Artificial Sequence
  sgRNA
  mm58366_Fam151a
cttgtaaataggcgatgtca

SEQ ID NO: 5792 - DNA, 20 bp, Artificial Sequence
  sgRNA
  mm58367_Fam151a
ggagatcttctactgacacg

SEQ ID NO: 5793 - DNA, 20 bp, Artificial Sequence
  sgRNA
  mm58368_Yipf1
caacgactctgacgagaccg

SEQ ID NO: 5794 - DNA, 20 bp, Artificial Sequence
  sgRNA
  mm58369_Yipf1
ggggtcctcaatgtttatcg

SEQ ID NO: 5795 - DNA, 20 bp, Artificial Sequence
  sgRNA
  mm58370_Yipf1
tgctatggcaaagaccaacg

SEQ ID NO: 5796 - DNA, 20 bp, Artificial Sequence
  sgRNA
  mm58371_Yipf1
gacacacacgatctccagaa

SEQ ID NO: 5797 - DNA, 20 bp, Artificial Sequence
  sgRNA
  mm58476_Epha10
gcgatggtgtcaatcttgcg

SEQ ID NO: 5798 - DNA, 20 bp, Artificial Sequence
  sgRNA
  mm58477_Epha10
gcttcacgcagggtgacctg

SEQ ID NO: 5799 - DNA, 20 bp, Artificial Sequence
  sgRNA
  mm58478_Epha10
gactgcactgccaagcactg

SEQ ID NO: 5800 - DNA, 20 bp, Artificial Sequence
  sgRNA
  mm58479_Epha10
cagacaggctggatcagccg

SEQ ID NO: 5801 - DNA, 20 bp, Artificial Sequence
  sgRNA
  mm58592_Ece1
gcacgcacggtagtacactt

SEQ ID NO: 5802 - DNA, 20 bp, Artificial Sequence
  sgRNA
  mm58593_Ece1
agtgacacggaaaacaacct

SEQ ID NO: 5803 - DNA, 20 bp, Artificial Sequence
  sgRNA
  mm58594_Ece1
caatgagtctgagccaatcg

SEQ ID NO: 5804 - DNA, 20 bp, Artificial Sequence
  sgRNA
  mm58595_Ece1
cttctctgtttatgtcagcg

SEQ ID NO: 5805 - DNA, 20 bp, Artificial Sequence
  sgRNA
  mm58608_Igsf21
gtatctacgaccgagccacg

SEQ ID NO: 5806 - DNA, 20 bp, Artificial Sequence
  sgRNA
  mm58609_Igsf21
tcacggtggactgatacaca

SEQ ID NO: 5807 - DNA, 20 bp, Artificial Sequence
  sgRNA
  mm58610_Igsf21
tcggcgctgtgtacccaacg

SEQ ID NO: 5808 - DNA, 20 bp, Artificial Sequence
  sgRNA
  mm58611_Igsf21
aacctccaagcacttaccat

SEQ ID NO: 5809 - DNA, 20 bp, Artificial Sequence
  sgRNA
  mm58660_Ajap1
ttcaacgatttcgacttccg

SEQ ID NO: 5810 - DNA, 20 bp, Artificial Sequence
  sgRNA
  mm58661_Ajap1
tgcgaagtggacccccaacg

SEQ ID NO: 5811 - DNA, 20 bp, Artificial Sequence
  sgRNA
  mm58662_Ajap1
gccaccctcggacccaaagg

SEQ ID NO: 5812 - DNA, 20 bp, Artificial Sequence
  sgRNA
  mm58663_Ajap1
gcaaacacggaagacaacgg

SEQ ID NO: 5813 - DNA, 20 bp, Artificial Sequence
  sgRNA
  mm58676_Tnfrsf14
tgggcggtatatgtctgtgg

SEQ ID NO: 5814 - DNA, 20 bp, Artificial Sequence
  sgRNA
  mm58677_Tnfrsf14
tatgtgctgactgcctaaca

SEQ ID NO: 5815 - DNA, 20 bp, Artificial Sequence
  sgRNA
  mm58678_Tnfrsf14
cctggatcacagactccgca

SEQ ID NO: 5816 - DNA, 20 bp, Artificial Sequence
  sgRNA
  mm58679_Tnfrsf14
gccccatgtgcaacccaggt

SEQ ID NO: 5817 - DNA, 20 bp, Artificial Sequence
  sgRNA
  mm58832_Tmprss11d
tacggagctgtacccgtcgt

SEQ ID NO: 5818 - DNA, 20 bp, Artificial Sequence
  sgRNA
  mm58833_Tmprss11d
ctcaataatgtccaccactg

SEQ ID NO: 5819 - DNA, 20 bp, Artificial Sequence
  sgRNA
  mm58834_Tmprss11d
cctaaacgttgaatacactg

SEQ ID NO: 5820 - DNA, 20 bp, Artificial Sequence
  sgRNA
  mm58835_Tmprss11d
tcgttgtcataataacggta

SEQ ID NO: 5821 - DNA, 20 bp, Artificial Sequence
  sgRNA
  mm58864_Fras1
tggtgggtgtgcttacaacg

SEQ ID NO: 5822 - DNA, 20 bp, Artificial Sequence
  sgRNA
  mm58865_Fras1
ccccacttggcaataaaccg

SEQ ID NO: 5823 - DNA, 20 bp, Artificial Sequence
  sgRNA
  mm58866_Fras1
actggggctgaataacactt

SEQ ID NO: 5824 - DNA, 20 bp, Artificial Sequence
  sgRNA
  mm58867_Fras1
ctgaagagtacgccatacag

SEQ ID NO: 5825 - DNA, 20 bp, Artificial Sequence
  sgRNA
  mm58924_P2rx2
ggaatacgtaaagcccccgg

SEQ ID NO: 5826 - DNA, 20 bp, Artificial Sequence
  sgRNA
  mm58925_P2rx2
ctgtgtaccctattaccatg

SEQ ID NO: 5827 - DNA, 20 bp, Artificial Sequence
  sgRNA
  mm58926_P2rx2
tttgatgagagttcgagtgg

SEQ ID NO: 5828 - DNA, 20 bp, Artificial Sequence
  sgRNA
  mm58927_P2rx2
atctccaccctagagcatga

SEQ ID NO: 5829 - DNA, 20 bp, Artificial Sequence
  sgRNA
  mm59160_Tmem150a
gccaagtctctacactacat

SEQ ID NO: 5830 - DNA, 20 bp, Artificial Sequence
  sgRNA
  mm59161_Tmem150a
gcacacgtggcggttcatca

SEQ ID NO: 5831 - DNA, 20 bp, Artificial Sequence
  sgRNA
  mm59162_Tmem150a
gaaaattgccgaccaccacg

SEQ ID NO: 5832 - DNA, 20 bp, Artificial Sequence
  sgRNA
  mm59163_Tmem150a
taggccatagccatgtccag

SEQ ID NO: 5833 - DNA, 20 bp, Artificial Sequence
  sgRNA
  mm59244_Slc6a1
caccaacatgaccagcgccg

SEQ ID NO: 5834 - DNA, 20 bp, Artificial Sequence
  sgRNA
  mm59245_Slc6a1
gcagaaatacacgagcaccc

SEQ ID NO: 5835 - DNA, 20 bp, Artificial Sequence
  sgRNA
  mm59246_Slc6a1
tacctctgtgggaaaaacgg

SEQ ID NO: 5836 - DNA, 20 bp, Artificial Sequence
  sgRNA
  mm59247_Slc6a1
tccatgtgtcccggtcaggg

SEQ ID NO: 5837 - DNA, 20 bp, Artificial Sequence
  sgRNA
  mm59264_A2m
cccttgactcacgatgaagg

SEQ ID NO: 5838 - DNA, 20 bp, Artificial Sequence
  sgRNA
  mm59265_A2m
ccggaagaccgatatttggg

SEQ ID NO: 5839 - DNA, 20 bp, Artificial Sequence
  sgRNA
  mm59266_A2m
gggcacgtccctaactgtca

SEQ ID NO: 5840 - DNA, 20 bp, Artificial Sequence
  sgRNA
  mm59267_A2m
aaggcttggaaatcgatcac

SEQ ID NO: 5841 - DNA, 20 bp, Artificial Sequence
  sgRNA
  mm59276_Clstn3
cagacgctccacaaagaccg

SEQ ID NO: 5842 - DNA, 20 bp, Artificial Sequence
  sgRNA
  mm59277_Clstn3
cagttacctgcatagcgcag

SEQ ID NO: 5843 - DNA, 20 bp, Artificial Sequence
  sgRNA
  mm59278_Clstn3
accgagacaactattcagag

SEQ ID NO: 5844 - DNA, 20 bp, Artificial Sequence
  sgRNA
  mm59279_Clstn3
agtagtggtggatcagcaag

SEQ ID NO: 5845 - DNA, 20 bp, Artificial Sequence
  sgRNA
  mm59292_Klrb1f
aataaacatttgttccagtg

SEQ ID NO: 5846 - DNA, 20 bp, Artificial Sequence
  sgRNA
  mm59293_Klrb1f
gaagatgcttgcttataccc

SEQ ID NO: 5847 - DNA, 20 bp, Artificial Sequence
  sgRNA
  mm59294_Klrb1f
ctaagacactgagtccaatc

SEQ ID NO: 5848 - DNA, 20 bp, Artificial Sequence
  sgRNA
  mm59295_Klrb1f
agagccaaatgatgccagtg

SEQ ID NO: 5849 - DNA, 20 bp, Artificial Sequence
  sgRNA
  mm59300_Clec12a
aactcaatcagtatggaaca

SEQ ID NO: 5850 - DNA, 20 bp, Artificial Sequence
  sgRNA
  mm59301_Clec12a
gagattgtgcttcagctgta

SEQ ID NO: 5851 - DNA, 20 bp, Artificial Sequence
  sgRNA
  mm59302_Clec12a
cagaagtctgacaaatgtgg

SEQ ID NO: 5852 - DNA, 20 bp, Artificial Sequence
  sgRNA
  mm59303_Clec12a
gagctgtatagcaaagaacc

SEQ ID NO: 5853 - DNA, 20 bp, Artificial Sequence
  sgRNA
  mm59304_Clec9a
cattggtgaaccttacacag

SEQ ID NO: 5854 - DNA, 20 bp, Artificial Sequence
  sgRNA
  mm59305_Clec9a
attacctgaacatttgctag

SEQ ID NO: 5855 - DNA, 20 bp, Artificial Sequence
  sgRNA
  mm59306_Clec9a
caagcccatacagaccacac

SEQ ID NO: 5856 - DNA, 20 bp, Artificial Sequence
  sgRNA
  mm59307_Clec9a
gttactatgtctttgaacgc

SEQ ID NO: 5857 - DNA, 20 bp, Artificial Sequence
  sgRNA
  mm59372_Tspan33
gccaggctaatgaagcacgc

SEQ ID NO: 5858 - DNA, 20 bp, Artificial Sequence
  sgRNA
  mm59373_Tspan33
gaatatgtacttcaactgct

SEQ ID NO: 5859 - DNA, 20 bp, Artificial Sequence
  sgRNA
  mm59374_Tspan33
aaggcagatgttctcccgaa

SEQ ID NO: 5860 - DNA, 20 bp, Artificial Sequence
  sgRNA
  mm59375_Tspan33
cgtgcattatcgagatgacc

SEQ ID NO: 5861 - DNA, 20 bp, Artificial Sequence
  sgRNA
  mm59608_Lrfn3
cctaggcaacgtcaacacgt

SEQ ID NO: 5862 - DNA, 20 bp, Artificial Sequence
  sgRNA
  mm59609_Lrfn3
cctaagcgtgttgtgcccag

SEQ ID NO: 5863 - DNA, 20 bp, Artificial Sequence
  sgRNA
  mm59610_Lrfn3
ggtgatacccaacgcactcg

SEQ ID NO: 5864 - DNA, 20 bp, Artificial Sequence
  sgRNA
  mm59611_Lrfn3
gcaccagctgtgaccccccg

SEQ ID NO: 5865 - DNA, 20 bp, Artificial Sequence
  sgRNA
  mm59712_Siglech
gatgcacaaaagggtgacaa

SEQ ID NO: 5866 - DNA, 20 bp, Artificial Sequence
  sgRNA
  mm59713_Siglech
caaaacatggaatttctgtg

SEQ ID NO: 5867 - DNA, 20 bp, Artificial Sequence
  sgRNA
  mm59714_Siglech
gttccccgttcacaagccca

SEQ ID NO: 5868 - DNA, 20 bp, Artificial Sequence
  sgRNA
  mm59715_Siglech
actgaggagagtgtggtcgt

SEQ ID NO: 5869 - DNA, 20 bp, Artificial Sequence
  sgRNA
  mm59760_Picalm
cctcagggagcgagtacatg

SEQ ID NO: 5870 - DNA, 20 bp, Artificial Sequence
  sgRNA
  mm59761_Picalm
tggcctatctctgaccaaag

SEQ ID NO: 5871 - DNA, 20 bp, Artificial Sequence
  sgRNA
  mm59762_Picalm
agttcattactattaaccta

SEQ ID NO: 5872 - DNA, 20 bp, Artificial Sequence
  sgRNA
  mm59763_Picalm
gccacgacccacgagatcat

SEQ ID NO: 5873 - DNA, 20 bp, Artificial Sequence
  sgRNA
  mm59788_Gdpd5
agtcgctccagtagcccatg

SEQ ID NO: 5874 - DNA, 20 bp, Artificial Sequence
  sgRNA
  mm59789_Gdpd5
ccccgtgatcacccctaccg

SEQ ID NO: 5875 - DNA, 20 bp, Artificial Sequence
  sgRNA
  mm59790_Gdpd5
ctcgcacgatgacaccacgc

SEQ ID NO: 5876 - DNA, 20 bp, Artificial Sequence
  sgRNA
  mm59791_Gdpd5
gaacctgcactggatacaca

SEQ ID NO: 5877 - DNA, 20 bp, Artificial Sequence
  sgRNA
  mm59824_Spon1
tcactgaaagcacccctcgg

SEQ ID NO: 5878 - DNA, 20 bp, Artificial Sequence
  sgRNA
  mm59825_Spon1
gtccgagaagactcatccga

SEQ ID NO: 5879 - DNA, 20 bp, Artificial Sequence
  sgRNA
  mm59826_Spon1
gaacgtgggcctatctgcag

SEQ ID NO: 5880 - DNA, 20 bp, Artificial Sequence
  sgRNA
  mm59827_Spon1
aggtgggtccatcacacaag

SEQ ID NO: 5881 - DNA, 20 bp, Artificial Sequence
  sgRNA
  mm59836_Acsm2
aaactaatacccatacagtg

SEQ ID NO: 5882 - DNA, 20 bp, Artificial Sequence
  sgRNA
  mm59837_Acsm2
caacatccggtaaatgatgg

SEQ ID NO: 5883 - DNA, 20 bp, Artificial Sequence
  sgRNA
  mm59838_Acsm2
gtgtctgaaaacagtcgaga

SEQ ID NO: 5884 - DNA, 20 bp, Artificial Sequence
  sgRNA
  mm59839_Acsm2
ctgtggtggatgaatggcag

SEQ ID NO: 5885 - DNA, 20 bp, Artificial Sequence
  sgRNA
  mm59880_Slc5a11
cgatgccagaatatctaagg

SEQ ID NO: 5886 - DNA, 20 bp, Artificial Sequence
  sgRNA
  mm59881_Slc5a11
gcgatgtctgaacagccaga

SEQ ID NO: 5887 - DNA, 20 bp, Artificial Sequence
  sgRNA
  mm59882_Slc5a11
atgtggaaggcatcttctcg

SEQ ID NO: 5888 - DNA, 20 bp, Artificial Sequence
  sgRNA
  mm59883_Slc5a11
cctgcacaatggggatccag

SEQ ID NO: 5889 - DNA, 20 bp, Artificial Sequence
  sgRNA
  mm59908_Sez6l2
tatgctaacactgttcgacg

SEQ ID NO: 5890 - DNA, 20 bp, Artificial Sequence
  sgRNA
  mm59909_Sez6l2
ggatacaatgcgacccagtg

SEQ ID NO: 5891 - DNA, 20 bp, Artificial Sequence
  sgRNA
  mm59910_Sez6l2
gtcagagtcgtaaatcacag

SEQ ID NO: 5892 - DNA, 20 bp, Artificial Sequence
  sgRNA
  mm59911_Sez6l2
ccacacattcgatagcattg

SEQ ID NO: 5893 - DNA, 20 bp, Artificial Sequence
  sgRNA
  mm60040_Gpm6a
gaggatgtgtgaatctactg

SEQ ID NO: 5894 - DNA, 20 bp, Artificial Sequence
  sgRNA
  mm60041_Gpm6a
ccggaacaccactctagtgg

SEQ ID NO: 5895 - DNA, 20 bp, Artificial Sequence
  sgRNA
  mm60042_Gpm6a
tgtacatgtatttcaatgtg

SEQ ID NO: 5896 - DNA, 20 bp, Artificial Sequence
  sgRNA
  mm60043_Gpm6a
tgcttggatctgcgtcagtt

SEQ ID NO: 5897 - DNA, 20 bp, Artificial Sequence
  sgRNA
  mm60060_Psd3
tctagacagattcaagagat

SEQ ID NO: 5898 - DNA, 20 bp, Artificial Sequence
  sgRNA
  mm60061_Psd3
tagatgctggttctgaaatg

SEQ ID NO: 5899 - DNA, 20 bp, Artificial Sequence
  sgRNA
  mm60062_Psd3
tctcatcagtaccttctgag

SEQ ID NO: 5900 - DNA, 20 bp, Artificial Sequence
  sgRNA
  mm60063_Psd3
gttgagcagcatcatagcac

SEQ ID NO: 5901 - DNA, 20 bp, Artificial Sequence
  sgRNA
  mm60292_Spire2
gtacgagcagcccatcaacg

SEQ ID NO: 5902 - DNA, 20 bp, Artificial Sequence
  sgRNA
  mm60293_Spire2
ctgcatcagcatctcgaagg

SEQ ID NO: 5903 - DNA, 20 bp, Artificial Sequence
  sgRNA
  mm60294_Spire2
gggacggttcggttggcgcg

SEQ ID NO: 5904 - DNA, 20 bp, Artificial Sequence
  sgRNA
  mm60295_Spire2
ggtcgtgttccgaaaaagag

SEQ ID NO: 5905 - DNA, 20 bp, Artificial Sequence
  sgRNA
  mm60380_Adamts15
taatgacatactccgcacct

SEQ ID NO: 5906 - DNA, 20 bp, Artificial Sequence
  sgRNA
  mm60381_Adamts15
aatggtcaagtttcacggcg

SEQ ID NO: 5907 - DNA, 20 bp, Artificial Sequence
  sgRNA
  mm60382_Adamts15
caacggtggaaaatactgcg

SEQ ID NO: 5908 - DNA, 20 bp, Artificial Sequence
  sgRNA
  mm60383_Adamts15
atgagcttacacttgtcacg

SEQ ID NO: 5909 - DNA, 20 bp, Artificial Sequence
  sgRNA
  mm60528_Prtg
gtgttgcagatctacgacgt

SEQ ID NO: 5910 - DNA, 20 bp, Artificial Sequence
  sgRNA
  mm60529_Prtg
cggctctctatacatcagtg

SEQ ID NO: 5911 - DNA, 20 bp, Artificial Sequence
  sgRNA
  mm60530_Prtg
aaataacgaggaatatcagg

SEQ ID NO: 5912 - DNA, 20 bp, Artificial Sequence
  sgRNA
  mm60531_Prtg
gcttgacatctgatataatg

SEQ ID NO: 5913 - DNA, 20 bp, Artificial Sequence
  sgRNA
  mm60544_Cd109
actgtgacggaatcactcac

SEQ ID NO: 5914 - DNA, 20 bp, Artificial Sequence
  sgRNA
  mm60545_Cd109
agtctaatgtgatccaacag

SEQ ID NO: 5915 - DNA, 20 bp, Artificial Sequence
  sgRNA
  mm60546_Cd109
tttggctagacgcctacatg

SEQ ID NO: 5916 - DNA, 20 bp, Artificial Sequence
  sgRNA
  mm60547_Cd109
ctcaatgagtatcacaacct

SEQ ID NO: 5917 - DNA, 20 bp, Artificial Sequence
  sgRNA
  mm60604_Plxnb1
taagaccgtaacgaccaccc

SEQ ID NO: 5918 - DNA, 20 bp, Artificial Sequence
  sgRNA
  mm60605_Plxnb1
gcttcccgggccacacaacg

SEQ ID NO: 5919 - DNA, 20 bp, Artificial Sequence
  sgRNA
  mm60606_Plxnb1
cttgctgataccggtccatg

SEQ ID NO: 5920 - DNA, 20 bp, Artificial Sequence
  sgRNA
  mm60607_Plxnb1
ggacgtgagatatgggtccg

SEQ ID NO: 5921 - DNA, 20 bp, Artificial Sequence
  sgRNA
  mm60612_Scap
ctgttggatgtacgccacgg

SEQ ID NO: 5922 - DNA, 20 bp, Artificial Sequence
  sgRNA
  mm60613_Scap
atgatgtaggtggtcacgag

SEQ ID NO: 5923 - DNA, 20 bp, Artificial Sequence
  sgRNA
  mm60614_Scap
ccttaggtccggactcccag

SEQ ID NO: 5924 - DNA, 20 bp, Artificial Sequence
  sgRNA
  mm60615_Scap
gcgtagccgtagtcatcgca

SEQ ID NO: 5925 - DNA, 20 bp, Artificial Sequence
  sgRNA
  mm60640_Rtp3
gtacctcccttacctagcaa

SEQ ID NO: 5926 - DNA, 20 bp, Artificial Sequence
  sgRNA
  mm60641_Rtp3
tagggaacaccagtctcgaa

SEQ ID NO: 5927 - DNA, 20 bp, Artificial Sequence
  sgRNA
  mm60642_Rtp3
ttgaggtacagctaatcttg

SEQ ID NO: 5928 - DNA, 20 bp, Artificial Sequence
  sgRNA
  mm60643_Rtp3
atgagggtccatttgtgcca

SEQ ID NO: 5929 - DNA, 20 bp, Artificial Sequence
  sgRNA
  mm60744_Slc9a7
tacttacgaggatagtacaa

SEQ ID NO: 5930 - DNA, 20 bp, Artificial Sequence
  sgRNA
  mm60745_Slc9a7
catgaaggaaacgcacccgg

SEQ ID NO: 5931 - DNA, 20 bp, Artificial Sequence
  sgRNA
  mm60746_Slc9a7
cagaaatcttatgtatggag

SEQ ID NO: 5932 - DNA, 20 bp, Artificial Sequence
  sgRNA
  mm60747_Slc9a7
ccctggcaagatcaacaacg

SEQ ID NO: 5933 - DNA, 20 bp, Artificial Sequence
  sgRNA
  mm60848_Adgrg2
ggcttgctggaagacgataa

SEQ ID NO: 5934 - DNA, 20 bp, Artificial Sequence
  sgRNA
  mm60849_Adgrg2
ggatgttcgagataggtcct

SEQ ID NO: 5935 - DNA, 20 bp, Artificial Sequence
  sgRNA
  mm60850_Adgrg2
gtcttgggctgcaaaagtcg

SEQ ID NO: 5936 - DNA, 20 bp, Artificial Sequence
  sgRNA
  mm60851_Adgrg2
cagttctgtagggacagatg

SEQ ID NO: 5937 - DNA, 20 bp, Artificial Sequence
  sgRNA
  mm60872_Lrp11
cggtacggcggtctaccggg

SEQ ID NO: 5938 - DNA, 20 bp, Artificial Sequence
  sgRNA
  mm60873_Lrp11
cagttgaacaggtagcagcg

SEQ ID NO: 5939 - DNA, 20 bp, Artificial Sequence
  sgRNA
  mm60874_Lrp11
ttacaccctcagtcgcgccg

SEQ ID NO: 5940 - DNA, 20 bp, Artificial Sequence
  sgRNA
  mm60875_Lrp11
ctgaagcagcctatccactc

SEQ ID NO: 5941 - DNA, 20 bp, Artificial Sequence
  sgRNA
  mm60928_Lingo3
caggtgacccagcgactccg

SEQ ID NO: 5942 - DNA, 20 bp, Artificial Sequence
  sgRNA
  mm60929_Lingo3
gtgtgatggacaacgacgtg

SEQ ID NO: 5943 - DNA, 20 bp, Artificial Sequence
  sgRNA
  mm60930_Lingo3
gattgcccacgtggaacctg

SEQ ID NO: 5944 - DNA, 20 bp, Artificial Sequence
  sgRNA
  mm60931_Lingo3
cccatcagcatggtgccacg

SEQ ID NO: 5945 - DNA, 20 bp, Artificial Sequence
  sgRNA
  mm61016_Col23a1
cctggagcgcctgttacggg

SEQ ID NO: 5946 - DNA, 20 bp, Artificial Sequence
  sgRNA
  mm61017_Col23a1
tggtaatcgactatgacggc

SEQ ID NO: 5947 - DNA, 20 bp, Artificial Sequence
  sgRNA
  mm61018_Col23a1
gggacttccaggccccaaag

SEQ ID NO: 5948 - DNA, 20 bp, Artificial Sequence
  sgRNA
  mm61019_Col23a1
gccatcccatcatccccctg

SEQ ID NO: 5949 - DNA, 20 bp, Artificial Sequence
  sgRNA
  mm61048_Rtn4rl1
ccttcgcagccattcccaca

SEQ ID NO: 5950 - DNA, 20 bp, Artificial Sequence
  sgRNA
  mm61049_Rtn4rl1
gggtagcacacacagtctcg

SEQ ID NO: 5951 - DNA, 20 bp, Artificial Sequence
  sgRNA
  mm61050_Rtn4rl1
gccctctacctctataagtg

SEQ ID NO: 5952 - DNA, 20 bp, Artificial Sequence
  sgRNA
  mm61051_Rtn4rl1
gcatgagaaccagctacagt

SEQ ID NO: 5953 - DNA, 20 bp, Artificial Sequence
  sgRNA
  mm61120_Sdk2
ccgctggagcgagatcccgg

SEQ ID NO: 5954 - DNA, 20 bp, Artificial Sequence
  sgRNA
  mm61121_Sdk2
tgcgcacacacgaggacggt

SEQ ID NO: 5955 - DNA, 20 bp, Artificial Sequence
  sgRNA
  mm61122_Sdk2
ggggcctctggtgatattag

SEQ ID NO: 5956 - DNA, 20 bp, Artificial Sequence
  sgRNA
  mm61123_Sdk2
atggaccaattacgagatcg

SEQ ID NO: 5957 - DNA, 20 bp, Artificial Sequence
  sgRNA
  mm61188_Tmem30b
gctcgtagtagaggtacacg

SEQ ID NO: 5958 - DNA, 20 bp, Artificial Sequence
  sgRNA
  mm61189_Tmem30b
cgagcggcacctcgacgaag

SEQ ID NO: 5959 - DNA, 20 bp, Artificial Sequence
  sgRNA
  mm61190_Tmem30b
gagctggagtacgactacac

SEQ ID NO: 5960 - DNA, 20 bp, Artificial Sequence
  sgRNA
  mm61191_Tmem30b
cgataggcagaccgtcggag

SEQ ID NO: 5961 - DNA, 20 bp, Artificial Sequence
  sgRNA
  mm61196_Kcnh5
actcgtattgtagcgatatg

SEQ ID NO: 5962 - DNA, 20 bp, Artificial Sequence
  sgRNA
  mm61197_Kcnh5
atagaggatgactcaacgaa

SEQ ID NO: 5963 - DNA, 20 bp, Artificial Sequence
  sgRNA
  mm61198_Kcnh5
atacatttgctggaaaattg

SEQ ID NO: 5964 - DNA, 20 bp, Artificial Sequence
  sgRNA
  mm61199_Kcnh5
attggcacacgcatgagcaa

SEQ ID NO: 5965 - DNA, 20 bp, Artificial Sequence
  sgRNA
  mm61232_Slc24a4
tctcatccaccataaccacg

SEQ ID NO: 5966 - DNA, 20 bp, Artificial Sequence
  sgRNA
  mm61233_Slc24a4
acccacggagatgtcggtgt

SEQ ID NO: 5967 - DNA, 20 bp, Artificial Sequence
  sgRNA
  mm61234_Slc24a4
tctgtgcagttcttagccag

SEQ ID NO: 5968 - DNA, 20 bp, Artificial Sequence
  sgRNA
  mm61235_Slc24a4
aaacgggagacatgagaaca

SEQ ID NO: 5969 - DNA, 20 bp, Artificial Sequence
  sgRNA
  mm61252_Adam6a
tctcatgactgtgtataccg

SEQ ID NO: 5970 - DNA, 20 bp, Artificial Sequence
  sgRNA
  mm61253_Adam6a
taggcctaaaacatgatgag

SEQ ID NO: 5971 - DNA, 20 bp, Artificial Sequence
  sgRNA
  mm61254_Adam6a
tctgtatatagtgcttctgg

SEQ ID NO: 5972 - DNA, 20 bp, Artificial Sequence
  sgRNA
  mm61255_Adam6a
atgctgttaatccagctgag

SEQ ID NO: 5973 - DNA, 20 bp, Artificial Sequence
  sgRNA
  mm61268_Btn2a2
ggcaaccatgaagcttatgg

SEQ ID NO: 5974 - DNA, 20 bp, Artificial Sequence
  sgRNA
  mm61269_Btn2a2
gagcagatggtggcataccg

SEQ ID NO: 5975 - DNA, 20 bp, Artificial Sequence
  sgRNA
  mm61270_Btn2a2
tggtcctatgacagtaaact

SEQ ID NO: 5976 - DNA, 20 bp, Artificial Sequence
  sgRNA
  mm61271_Btn2a2
caggtacaacttcatcatag

SEQ ID NO: 5977 - DNA, 20 bp, Artificial Sequence
  sgRNA
  mm61336_Pde4d
tcacatctgcagactcaagt

SEQ ID NO: 5978 - DNA, 20 bp, Artificial Sequence
  sgRNA
  mm61337_Pde4d
ctgctattcggaaaacgtgg

SEQ ID NO: 5979 - DNA, 20 bp, Artificial Sequence
  sgRNA
  mm61338_Pde4d
atggatggttggttgcacat

SEQ ID NO: 5980 - DNA, 20 bp, Artificial Sequence
  sgRNA
  mm61339_Pde4d
ggtcatagtcgctgtcagat

SEQ ID NO: 5981 - DNA, 20 bp, Artificial Sequence
  sgRNA
  mm61440_Slitrk6
tttgtatcttgagtacaatg

SEQ ID NO: 5982 - DNA, 20 bp, Artificial Sequence
  sgRNA
  mm61441_Slitrk6
ccaattggaggacaataagt

SEQ ID NO: 5983 - DNA, 20 bp, Artificial Sequence
  sgRNA
  mm61442_Slitrk6
cttaagtggaaaggtcgtga

SEQ ID NO: 5984 - DNA, 20 bp, Artificial Sequence
  sgRNA
  mm61443_Slitrk6
atgtattcttgcttgatagg

SEQ ID NO: 5985 - DNA, 20 bp, Artificial Sequence
  sgRNA
  mm61480_Rspo2
agaacaacttctgttgacat

SEQ ID NO: 5986 - DNA, 20 bp, Artificial Sequence
  sgRNA
  mm61481_Rspo2
ggtgtccataataccctgat

SEQ ID NO: 5987 - DNA, 20 bp, Artificial Sequence
  sgRNA
  mm61482_Rspo2
cattccatagtctcatctaa

SEQ ID NO: 5988 - DNA, 20 bp, Artificial Sequence
  sgRNA
  mm61483_Rspo2
gttggtcattggagcgaatg

SEQ ID NO: 5989 - DNA, 20 bp, Artificial Sequence
  sgRNA
  mm61552_Slc2a13
catggcccccgacaccacgc

SEQ ID NO: 5990 - DNA, 20 bp, Artificial Sequence
  sgRNA
  mm61553_Slc2a13
cctcggtggctgattcagaa

SEQ ID NO: 5991 - DNA, 20 bp, Artificial Sequence
  sgRNA
  mm61554_Slc2a13
cacatcccacaactaacgct

SEQ ID NO: 5992 - DNA, 20 bp, Artificial Sequence
  sgRNA
  mm61555_Slc2a13
aaggataatcagtgctactg

SEQ ID NO: 5993 - DNA, 20 bp, Artificial Sequence
  sgRNA
  mm61608_Rtp1
tggaagaggatgactacatg

SEQ ID NO: 5994 - DNA, 20 bp, Artificial Sequence
  sgRNA
  mm61609_Rtp1
gctacgagtgcggtacagca

SEQ ID NO: 5995 - DNA, 20 bp, Artificial Sequence
  sgRNA
  mm61610_Rtp1
atgtgtaagagtgtgaccac

SEQ ID NO: 5996 - DNA, 20 bp, Artificial Sequence
  sgRNA
  mm61611_Rtp1
ctacactttatagagaacgt

SEQ ID NO: 5997 - DNA, 20 bp, Artificial Sequence
  sgRNA
  mm61640_Cd200r4
taaatgcagtattaatcaca

SEQ ID NO: 5998 - DNA, 20 bp, Artificial Sequence
  sgRNA
  mm61641_Cd200r4
tgaacttcagatcagtgcag

SEQ ID NO: 5999 - DNA, 20 bp, Artificial Sequence
  sgRNA
  mm61642_Cd200r4
agttcatcttctctgacaca

SEQ ID NO: 6000 - DNA, 20 bp, Artificial Sequence
  sgRNA
  mm61643_Cd200r4
ctgaggtaacctactttcca

SEQ ID NO: 6001 - DNA, 20 bp, Artificial Sequence
  sgRNA
  mm61652_Cadm2
gacgaaaatccactaatctg

SEQ ID NO: 6002 - DNA, 20 bp, Artificial Sequence
  sgRNA
  mm61653_Cadm2
ccgccactccatcatcgcta

SEQ ID NO: 6003 - DNA, 20 bp, Artificial Sequence
  sgRNA
  mm61654_Cadm2
tccactaactcagaatgtca

SEQ ID NO: 6004 - DNA, 20 bp, Artificial Sequence
  sgRNA
  mm61655_Cadm2
atgataacacctccctccag

SEQ ID NO: 6005 - DNA, 20 bp, Artificial Sequence
  sgRNA
  mm61680_Lnpep
atattggaatatgccaaagg

SEQ ID NO: 6006 - DNA, 20 bp, Artificial Sequence
  sgRNA
  mm61681_Lnpep
tcctgttagaagaggttccg

SEQ ID NO: 6007 - DNA, 20 bp, Artificial Sequence
  sgRNA
  mm61682_Lnpep
tgtgaaaatgagcacatacc

SEQ ID NO: 6008 - DNA, 20 bp, Artificial Sequence
  sgRNA
  mm61683_Lnpep
tgcagtggtggaatgacctg

SEQ ID NO: 6009 - DNA, 20 bp, Artificial Sequence
  sgRNA
  mm61696_Mmp25
agaaacgcaccctgacatgg

SEQ ID NO: 6010 - DNA, 20 bp, Artificial Sequence
  sgRNA
  mm61697_Mmp25
atcaggccttacattccagg

SEQ ID NO: 6011 - DNA, 20 bp, Artificial Sequence
  sgRNA
  mm61698_Mmp25
cgttcagcttggacggaccg

SEQ ID NO: 6012 - DNA, 20 bp, Artificial Sequence
  sgRNA
  mm61699_Mmp25
ctgagactggacaaatgggt

SEQ ID NO: 6013 - DNA, 20 bp, Artificial Sequence
  sgRNA
  mm61920_Sulf1
cagttgacgactctgtcgag

SEQ ID NO: 6014 - DNA, 20 bp, Artificial Sequence
  sgRNA
  mm61921_Sulf1
agaaatacgtacatcgaccc

SEQ ID NO: 6015 - DNA, 20 bp, Artificial Sequence
  sgRNA
  mm61922_Sulf1
gcacgcaacctctactctcg

SEQ ID NO: 6016 - DNA, 20 bp, Artificial Sequence
  sgRNA
  mm61923_Sulf1
ctggcgtgatacattcctag

SEQ ID NO: 6017 - DNA, 20 bp, Artificial Sequence
  sgRNA
  mm61956_Tor1aip2
agtgccctagttctaaacta

SEQ ID NO: 6018 - DNA, 20 bp, Artificial Sequence
  sgRNA
  mm61957_Tor1aip2
taatacggtctaagaacact

SEQ ID NO: 6019 - DNA, 20 bp, Artificial Sequence
  sgRNA
  mm61958_Tor1aip2
ttctattagcaggattgtca

SEQ ID NO: 6020 - DNA, 20 bp, Artificial Sequence
  sgRNA
  mm61959_Tor1aip2
attcacactgccctgattgt

SEQ ID NO: 6021 - DNA, 20 bp, Artificial Sequence
  sgRNA
  mm61968_Tnfsf18
gtgtgaatacgacatctgat

SEQ ID NO: 6022 - DNA, 20 bp, Artificial Sequence
  sgRNA
  mm61969_Tnfsf18
atatatctgtactacgaagg

SEQ ID NO: 6023 - DNA, 20 bp, Artificial Sequence
  sgRNA
  mm61970_Tnfsf18
ctacggccaagtgattcctg

SEQ ID NO: 6024 - DNA, 20 bp, Artificial Sequence
  sgRNA
  mm61971_Tnfsf18
ctcaccaaacttaaccatgc

SEQ ID NO: 6025 - DNA, 20 bp, Artificial Sequence
  sgRNA
  mm62004_Pgap1
atagacaacaatatgcgaca

SEQ ID NO: 6026 - DNA, 20 bp, Artificial Sequence
  sgRNA
  mm62005_Pgap1
atatgtaacttaccacacga

SEQ ID NO: 6027 - DNA, 20 bp, Artificial Sequence
  sgRNA
  mm62006_Pgap1
agaatttgctcctacaagtg

SEQ ID NO: 6028 - DNA, 20 bp, Artificial Sequence
  sgRNA
  mm62007_Pgap1
gtcgtcagactgtcagtatg

SEQ ID NO: 6029 - DNA, 20 bp, Artificial Sequence
  sgRNA
  mm62068_Itga8
cagccggatatcgtagaagg

SEQ ID NO: 6030 - DNA, 20 bp, Artificial Sequence
  sgRNA
  mm62069_Itga8
tttgcaggcaaggatcaacg

SEQ ID NO: 6031 - DNA, 20 bp, Artificial Sequence
  sgRNA
  mm62070_Itga8
atatacttactgtttcgaca

SEQ ID NO: 6032 - DNA, 20 bp, Artificial Sequence
  sgRNA
  mm62071_Itga8
aattctcgctccataaagag

SEQ ID NO: 6033 - DNA, 20 bp, Artificial Sequence
  sgRNA
  mm62076_Gpr158
ggcacaaaaactagccgagg

SEQ ID NO: 6034 - DNA, 20 bp, Artificial Sequence
  sgRNA
  mm62077_Gpr158
ttgttcactgagaagacacg

SEQ ID NO: 6035 - DNA, 20 bp, Artificial Sequence
  sgRNA
  mm62078_Gpr158
ctgctgtcatgtaatcccag

SEQ ID NO: 6036 - DNA, 20 bp, Artificial Sequence
  sgRNA
  mm62079_Gpr158
gatgcgactctcctcgcggg

SEQ ID NO: 6037 - DNA, 20 bp, Artificial Sequence
  sgRNA
  mm62092_Lrrc8a
tcgacaccagtacaactacg

SEQ ID NO: 6038 - DNA, 20 bp, Artificial Sequence
  sgRNA
  mm62093_Lrrc8a
ctcgttcgagtcgatccgag

SEQ ID NO: 6039 - DNA, 20 bp, Artificial Sequence
  sgRNA
  mm62094_Lrrc8a
acggattgagcagggcatcg

SEQ ID NO: 6040 - DNA, 20 bp, Artificial Sequence
  sgRNA
  mm62095_Lrrc8a
gatgttgtgcacatagtaga

SEQ ID NO: 6041 - DNA, 20 bp, Artificial Sequence
  sgRNA
  mm62112_Crb2
gactgcccgagaccttaccg

SEQ ID NO: 6042 - DNA, 20 bp, Artificial Sequence
  sgRNA
  mm62113_Crb2
aaggcccataggtccccggt

SEQ ID NO: 6043 - DNA, 20 bp, Artificial Sequence
  sgRNA
  mm62114_Crb2
tctgacccgaccttgtacgg

SEQ ID NO: 6044 - DNA, 20 bp, Artificial Sequence
  sgRNA
  mm62115_Crb2
actctcgagacatggcactg

SEQ ID NO: 6045 - DNA, 20 bp, Artificial Sequence
  sgRNA
  mm62168_Tspan18
gagcttaccaagcactacca

SEQ ID NO: 6046 - DNA, 20 bp, Artificial Sequence
  sgRNA
  mm62169_Tspan18
cgtcagcagccgaaacacgg

SEQ ID NO: 6047 - DNA, 20 bp, Artificial Sequence
  sgRNA
  mm62170_Tspan18
gatcatgactgaattccagg

SEQ ID NO: 6048 - DNA, 20 bp, Artificial Sequence
  sgRNA
  mm62171_Tspan18
tggctgctgagagctctacc

SEQ ID NO: 6049 - DNA, 20 bp, Artificial Sequence
  sgRNA
  mm62280_Frem2
aatttcctactggaatagcg

SEQ ID NO: 6050 - DNA, 20 bp, Artificial Sequence
  sgRNA
  mm62281_Frem2
ttggagtgcacggatcgaag

SEQ ID NO: 6051 - DNA, 20 bp, Artificial Sequence
  sgRNA
  mm62282_Frem2
ggtcgagctgcattcgcgag

SEQ ID NO: 6052 - DNA, 20 bp, Artificial Sequence
  sgRNA
  mm62283_Frem2
tgggagaacccagaataaca

SEQ ID NO: 6053 - DNA, 20 bp, Artificial Sequence
  sgRNA
  mm62288_Igsf10
atagagacttaacacatcga

SEQ ID NO: 6054 - DNA, 20 bp, Artificial Sequence
  sgRNA
  mm62289_Igsf10
tcaggacgtgaaatatcccg

SEQ ID NO: 6055 - DNA, 20 bp, Artificial Sequence
  sgRNA
  mm62290_Igsf10
acaggttcggcacatcccag

SEQ ID NO: 6056 - DNA, 20 bp, Artificial Sequence
  sgRNA
  mm62291_Igsf10
gttgtgatccaggtgcaacc

SEQ ID NO: 6057 - DNA, 20 bp, Artificial Sequence
  sgRNA
  mm62292_Ppm1l
gtcccggctagacttaacga

SEQ ID NO: 6058 - DNA, 20 bp, Artificial Sequence
  sgRNA
  mm62293_Ppm1l
tccccgagagtcaccaacgt

SEQ ID NO: 6059 - DNA, 20 bp, Artificial Sequence
  sgRNA
  mm62294_Ppm1l
cttcgaagcgatcttccatg

SEQ ID NO: 6060 - DNA, 20 bp, Artificial Sequence
  sgRNA
  mm62295_Ppm1l
gcagatcttgtcaattgacc

SEQ ID NO: 6061 - DNA, 20 bp, Artificial Sequence
  sgRNA
  mm62308_Vtcn1
aaagccaatgatgagtgcga

SEQ ID NO: 6062 - DNA, 20 bp, Artificial Sequence
  sgRNA
  mm62309_Vtcn1
ggtgcggatgtaacatgtgt

SEQ ID NO: 6063 - DNA, 20 bp, Artificial Sequence
  sgRNA
  mm62310_Vtcn1
aaccttgagtataagaccgg

SEQ ID NO: 6064 - DNA, 20 bp, Artificial Sequence
  sgRNA
  mm62311_Vtcn1
tcaacggcatcgtcatccag

SEQ ID NO: 6065 - DNA, 20 bp, Artificial Sequence
  sgRNA
  mm62324_Pde5a
aaccctctgatcctttaacg

SEQ ID NO: 6066 - DNA, 20 bp, Artificial Sequence
  sgRNA
  mm62325_Pde5a
tcaacttctgcattgaaccg

SEQ ID NO: 6067 - DNA, 20 bp, Artificial Sequence
  sgRNA
  mm62326_Pde5a
tcatcactatcaaatcttgg

SEQ ID NO: 6068 - DNA, 20 bp, Artificial Sequence
  sgRNA
  mm62327_Pde5a
tggcaaggtcaagtaacacc

SEQ ID NO: 6069 - DNA, 20 bp, Artificial Sequence
  sgRNA
  mm62356_Impad1
attcctgtgtagcatcaagt

SEQ ID NO: 6070 - DNA, 20 bp, Artificial Sequence
  sgRNA
  mm62357_Impad1
tccttcacgagaagtccaag

SEQ ID NO: 6071 - DNA, 20 bp, Artificial Sequence
  sgRNA
  mm62358_Impad1
ctcccactagataaatactg

SEQ ID NO: 6072 - DNA, 20 bp, Artificial Sequence
  sgRNA
  mm62359_Impad1
gcttgggcaatggtagatgg

SEQ ID NO: 6073 - DNA, 20 bp, Artificial Sequence
  sgRNA
  mm62392_Tmem8b
gaatccataggtgagcgcgt

SEQ ID NO: 6074 - DNA, 20 bp, Artificial Sequence
  sgRNA
  mm62393_Tmem8b
cagcacgtatcggctccgaa

SEQ ID NO: 6075 - DNA, 20 bp, Artificial Sequence
  sgRNA
  mm62394_Tmem8b
attcggatgcctgactcatg

SEQ ID NO: 6076 - DNA, 20 bp, Artificial Sequence
  sgRNA
  mm62395_Tmem8b
gcccagctgtatttgccctg

SEQ ID NO: 6077 - DNA, 20 bp, Artificial Sequence
  sgRNA
  mm62400_Gabbr2
cctgcgactctacgacaccg

SEQ ID NO: 6078 - DNA, 20 bp, Artificial Sequence
  sgRNA
  mm62401_Gabbr2
catggaaggctacatcggag

SEQ ID NO: 6079 - DNA, 20 bp, Artificial Sequence
  sgRNA
  mm62402_Gabbr2
gctgacaggatgctatacag

SEQ ID NO: 6080 - DNA, 20 bp, Artificial Sequence
  sgRNA
  mm62403_Gabbr2
cttatccgcaagaacaggcg

SEQ ID NO: 6081 - DNA, 20 bp, Artificial Sequence
  sgRNA
  mm62696_Elfn1
ctacattgaagtgcgcacgg

SEQ ID NO: 6082 - DNA, 20 bp, Artificial Sequence
  sgRNA
  mm62697_Elfn1
gtttccgaagcggctcaggg

SEQ ID NO: 6083 - DNA, 20 bp, Artificial Sequence
  sgRNA
  mm62698_Elfn1
caccaactacacatactgcg

SEQ ID NO: 6084 - DNA, 20 bp, Artificial Sequence
  sgRNA
  mm62699_Elfn1
cctacaggccaacctcatcg

SEQ ID NO: 6085 - DNA, 20 bp, Artificial Sequence
  sgRNA
  mm62700_Slc29a4
gctgttgcaccgatacgtcg

SEQ ID NO: 6086 - DNA, 20 bp, Artificial Sequence
  sgRNA
  mm62701_Slc29a4
actgcccaagaggtacacgc

SEQ ID NO: 6087 - DNA, 20 bp, Artificial Sequence
  sgRNA
  mm62702_Slc29a4
gtggtgaagatagtcgacat

SEQ ID NO: 6088 - DNA, 20 bp, Artificial Sequence
  sgRNA
  mm62703_Slc29a4
tgtgctcctaaacaacgttg

SEQ ID NO: 6089 - DNA, 20 bp, Artificial Sequence
  sgRNA
  mm62704_Tmem130
tctaacctcgaccatccacg

SEQ ID NO: 6090 - DNA, 20 bp, Artificial Sequence
  sgRNA
  mm62705_Tmem130
tcagcatcgttggatctgcg

SEQ ID NO: 6091 - DNA, 20 bp, Artificial Sequence
  sgRNA
  mm62706_Tmem130
gttgataactgacaaccctg

SEQ ID NO: 6092 - DNA, 20 bp, Artificial Sequence
  sgRNA
  mm62707_Tmem130
gctgacggtcctgctaccgt

SEQ ID NO: 6093 - DNA, 20 bp, Artificial Sequence
  sgRNA
  mm62788_Slc6a11
ctcccagaactccatgaccg

SEQ ID NO: 6094 - DNA, 20 bp, Artificial Sequence
  sgRNA
  mm62789_Slc6a11
aggcattggctatgcaacac

SEQ ID NO: 6095 - DNA, 20 bp, Artificial Sequence
  sgRNA
  mm62790_Slc6a11
gttgttgtaactccccagag

SEQ ID NO: 6096 - DNA, 20 bp, Artificial Sequence
  sgRNA
  mm62791_Slc6a11
gggtactaagtcgactggaa

SEQ ID NO: 6097 - DNA, 20 bp, Artificial Sequence
  sgRNA
  mm62808_Klre1
agccatcaggagaaggcaca

SEQ ID NO: 6098 - DNA, 20 bp, Artificial Sequence
  sgRNA
  mm62809_Klre1
cagacccagttctctggaca

SEQ ID NO: 6099 - DNA, 20 bp, Artificial Sequence
  sgRNA
  mm62810_Klre1
aattgtcatccattgagcag

SEQ ID NO: 6100 - DNA, 20 bp, Artificial Sequence
  sgRNA
  mm62811_Klre1
ctcacactttgtggtaaaag

SEQ ID NO: 6101 - DNA, 20 bp, Artificial Sequence
  sgRNA
  mm62820_Plxna4
gaaggaacattatctctcgg

SEQ ID NO: 6102 - DNA, 20 bp, Artificial Sequence
  sgRNA
  mm62821_Plxna4
gccacactcgaaatccgggt

SEQ ID NO: 6103 - DNA, 20 bp, Artificial Sequence
  sgRNA
  mm62822_Plxna4
acatgatgtagagttgctcg

SEQ ID NO: 6104 - DNA, 20 bp, Artificial Sequence
  sgRNA
  mm62823_Plxna4
cattggctgtgagcgcaatg

SEQ ID NO: 6105 - DNA, 20 bp, Artificial Sequence
  sgRNA
  mm62844_Gp6
cgatataaatccacatctgg

SEQ ID NO: 6106 - DNA, 20 bp, Artificial Sequence
  sgRNA
  mm62845_Gp6
tgatgatggggaaattggcc

SEQ ID NO: 6107 - DNA, 20 bp, Artificial Sequence
  sgRNA
  mm62846_Gp6
ccagtaaccacaagcactag

SEQ ID NO: 6108 - DNA, 20 bp, Artificial Sequence
  sgRNA
  mm62847_Gp6
ttagctcaagctggtcactt

SEQ ID NO: 6109 - DNA, 20 bp, Artificial Sequence
  sgRNA
  mm62872_Fkrp
gctggacttgaccttcgccg

SEQ ID NO: 6110 - DNA, 20 bp, Artificial Sequence
  sgRNA
  mm62873_Fkrp
ccaatggcagaagtccggcg

SEQ ID NO: 6111 - DNA, 20 bp, Artificial Sequence
  sgRNA
  mm62874_Fkrp
ccatccaaagcgtcgcagcg

SEQ ID NO: 6112 - DNA, 20 bp, Artificial Sequence
  sgRNA
  mm62875_Fkrp
cacaaactcggtggctacgt

SEQ ID NO: 6113 - DNA, 20 bp, Artificial Sequence
  sgRNA
  mm62880_Mill2
aggaagcgaggtatctctgg

SEQ ID NO: 6114 - DNA, 20 bp, Artificial Sequence
  sgRNA
  mm62881_Mill2
tgtcagagcccattctctgg

SEQ ID NO: 6115 - DNA, 20 bp, Artificial Sequence
  sgRNA
  mm62882_Mill2
cccttaatccagcatcccaa

SEQ ID NO: 6116 - DNA, 20 bp, Artificial Sequence
  sgRNA
  mm62883_Mill2
ctgctccttagagactcacg

SEQ ID NO: 6117 - DNA, 20 bp, Artificial Sequence
  sgRNA
  mm62980_Rgma
accatcgtggtgcgacaggt

SEQ ID NO: 6118 - DNA, 20 bp, Artificial Sequence
  sgRNA
  mm62981_Rgma
acagaactccggcacgtcgt

SEQ ID NO: 6119 - DNA, 20 bp, Artificial Sequence
  sgRNA
  mm62982_Rgma
gagggtcggccacaatccca

SEQ ID NO: 6120 - DNA, 20 bp, Artificial Sequence
  sgRNA
  mm62983_Rgma
aggtaattattgtcgatgag

SEQ ID NO: 6121 - DNA, 20 bp, Artificial Sequence
  sgRNA
  mm63056_5830411N06Rik
tcaggtgtcaaaacataccg

SEQ ID NO: 6122 - DNA, 20 bp, Artificial Sequence
  sgRNA
  mm63057_5830411N06Rik
ccttcaatcttacacccagg

SEQ ID NO: 6123 - DNA, 20 bp, Artificial Sequence
  sgRNA
  mm63058_5830411N06Rik
gccataagaccattcctgtg

SEQ ID NO: 6124 - DNA, 20 bp, Artificial Sequence
  sgRNA
  mm63059_5830411N06Rik
gtggtaccacactacaaatg

SEQ ID NO: 6125 - DNA, 20 bp, Artificial Sequence
  sgRNA
  mm63060_Tnfrsf26
actctgaaaactgtttggag

SEQ ID NO: 6126 - DNA, 20 bp, Artificial Sequence
  sgRNA
  mm63061_Tnfrsf26
gaactcaccaatcttacaca

SEQ ID NO: 6127 - DNA, 20 bp, Artificial Sequence
  sgRNA
  mm63062_Tnfrsf26
agtaggtgccctgcttacac

SEQ ID NO: 6128 - DNA, 20 bp, Artificial Sequence
  sgRNA
  mm63063_Tnfrsf26
tctcctggcatggattccgg

SEQ ID NO: 6129 - DNA, 20 bp, Artificial Sequence
  sgRNA
  mm63164_Pkd1l3
gcgacttcttcatcgtgccg

SEQ ID NO: 6130 - DNA, 20 bp, Artificial Sequence
  sgRNA
  mm63165_Pkd1l3
aagtggagcgtcattaggag

SEQ ID NO: 6131 - DNA, 20 bp, Artificial Sequence
  sgRNA
  mm63166_Pkd1l3
gctgacgagcagctccgaca

SEQ ID NO: 6132 - DNA, 20 bp, Artificial Sequence
  sgRNA
  mm63167_Pkd1l3
gttgttgttagacgtccaag

SEQ ID NO: 6133 - DNA, 20 bp, Artificial Sequence
  sgRNA
  mm63188_Sipa1l2
ttcagaacggttatccacgg

SEQ ID NO: 6134 - DNA, 20 bp, Artificial Sequence
  sgRNA
  mm63189_Sipa1l2
catcagtgatatcgatacgg

SEQ ID NO: 6135 - DNA, 20 bp, Artificial Sequence
  sgRNA
  mm63190_Sipa1l2
agttatcatccagccccacg

SEQ ID NO: 6136 - DNA, 20 bp, Artificial Sequence
  sgRNA
  mm63191_Sipa1l2
gtcgcagttcaactacaggg

SEQ ID NO: 6137 - DNA, 20 bp, Artificial Sequence
  sgRNA
  mm63220_Olfm2
gagagccattgtataccaca

SEQ ID NO: 6138 - DNA, 20 bp, Artificial Sequence
  sgRNA
  mm63221_Olfm2
ggacttgcaacagcgcgtga

SEQ ID NO: 6139 - DNA, 20 bp, Artificial Sequence
  sgRNA
  mm63222_Olfm2
cagtaaccctattaccatcc

SEQ ID NO: 6140 - DNA, 20 bp, Artificial Sequence
  sgRNA
  mm63223_Olfm2
gcagctttatacgtcagccc

SEQ ID NO: 6141 - DNA, 20 bp, Artificial Sequence
  sgRNA
  mm63308_Col6a6
tgcgtcatgagattccccgt

SEQ ID NO: 6142 - DNA, 20 bp, Artificial Sequence
  sgRNA
  mm63309_Col6a6
atgggcagcaggatcaacgc

SEQ ID NO: 6143 - DNA, 20 bp, Artificial Sequence
  sgRNA
  mm63310_Col6a6
tgaggctcaggacatagtaa

SEQ ID NO: 6144 - DNA, 20 bp, Artificial Sequence
  sgRNA
  mm63311_Col6a6
atgggtgggaataccaacac

SEQ ID NO: 6145 - DNA, 20 bp, Artificial Sequence
  sgRNA
  mm63388_Slitrk4
aagcaagaactatgccccat

SEQ ID NO: 6146 - DNA, 20 bp, Artificial Sequence
  sgRNA
  mm63389_Slitrk4
agatgatagaaattagacca

SEQ ID NO: 6147 - DNA, 20 bp, Artificial Sequence
  sgRNA
  mm63390_Slitrk4
ctttaatgctaccaagtcgc

SEQ ID NO: 6148 - DNA, 20 bp, Artificial Sequence
  sgRNA
  mm63391_Slitrk4
ttaatcaagtatattgaacg

SEQ ID NO: 6149 - DNA, 20 bp, Artificial Sequence
  sgRNA
  mm63392_Slitrk2
ctgactcacttagacctgag

SEQ ID NO: 6150 - DNA, 20 bp, Artificial Sequence
  sgRNA
  mm63393_Slitrk2
caaactggaggtattgcgag

SEQ ID NO: 6151 - DNA, 20 bp, Artificial Sequence
  sgRNA
  mm63394_Slitrk2
gaggttaatcaaagcatcaa

SEQ ID NO: 6152 - DNA, 20 bp, Artificial Sequence
  sgRNA
  mm63395_Slitrk2
ctgatagatgcgatactggg

SEQ ID NO: 6153 - DNA, 20 bp, Artificial Sequence
  sgRNA
  mm63404_Dkc1
tttactgcagcaataagtgg

SEQ ID NO: 6154 - DNA, 20 bp, Artificial Sequence
  sgRNA
  mm63405_Dkc1
tctctacccgaagtattcgt

SEQ ID NO: 6155 - DNA, 20 bp, Artificial Sequence
  sgRNA
  mm63406_Dkc1
tacgcatagtgtccgaatgt

SEQ ID NO: 6156 - DNA, 20 bp, Artificial Sequence
  sgRNA
  mm63407_Dkc1
atgatgtactcgatgctcag

SEQ ID NO: 6157 - DNA, 20 bp, Artificial Sequence
  sgRNA
  mm63428_Eda2r
ctaccgaaagacacgcattg

SEQ ID NO: 6158 - DNA, 20 bp, Artificial Sequence
  sgRNA
  mm63429_Eda2r
ccctggacaggagctctcga

SEQ ID NO: 6159 - DNA, 20 bp, Artificial Sequence
  sgRNA
  mm63430_Eda2r
acaagtgtggcttccctagg

SEQ ID NO: 6160 - DNA, 20 bp, Artificial Sequence
  sgRNA
  mm63431_Eda2r
acacactgaacctcggaaga

SEQ ID NO: 6161 - DNA, 20 bp, Artificial Sequence
  sgRNA
  mm63556_Atg9a
agataaacttgataagccgg

SEQ ID NO: 6162 - DNA, 20 bp, Artificial Sequence
  sgRNA
  mm63557_Atg9a
ctcggcttgctggtacactg

SEQ ID NO: 6163 - DNA, 20 bp, Artificial Sequence
  sgRNA
  mm63558_Atg9a
cttcatcccagaccagcaca

SEQ ID NO: 6164 - DNA, 20 bp, Artificial Sequence
  sgRNA
  mm63559_Atg9a
aggccgagtacaaacgtgga

SEQ ID NO: 6165 - DNA, 20 bp, Artificial Sequence
  sgRNA
  mm63620_Defb15
agaaatgcagcagggttaat

SEQ ID NO: 6166 - DNA, 20 bp, Artificial Sequence
  sgRNA
  mm63621_Defb15
gttctcttctttctggaccc

SEQ ID NO: 6167 - DNA, 20 bp, Artificial Sequence
  sgRNA
  mm63622_Defb15
cacagcacttcagattcttc

SEQ ID NO: 6168 - DNA, 20 bp, Artificial Sequence
  sgRNA
  mm63623_Defb15
gagaaatgcagcagggttaa

SEQ ID NO: 6169 - DNA, 20 bp, Artificial Sequence
  sgRNA
  mm63624_Defb13
cttctcattcaactttaccc

SEQ ID NO: 6170 - DNA, 20 bp, Artificial Sequence
  sgRNA
  mm63625_Defb13
taaagcactcagcttcacat

SEQ ID NO: 6171 - DNA, 20 bp, Artificial Sequence
  sgRNA
  mm63626_Defb13
cctggggcacattgtacaga

SEQ ID NO: 6172 - DNA, 20 bp, Artificial Sequence
  sgRNA
  mm63627_Defb13
ttcctctgtaaaaagatgaa

SEQ ID NO: 6173 - DNA, 20 bp, Artificial Sequence
  sgRNA
  mm63628_Defb35
caaaaaacaaaaaacgtctg

SEQ ID NO: 6174 - DNA, 20 bp, Artificial Sequence
  sgRNA
  mm63629_Defb35
gcagctctttcctggcacag

SEQ ID NO: 6175 - DNA, 20 bp, Artificial Sequence
  sgRNA
  mm63630_Defb35
ttgctgtgtgcgagacatgc

SEQ ID NO: 6176 - DNA, 20 bp, Artificial Sequence
  sgRNA
  mm63631_Defb35
gagacatgcaggctcggccg

SEQ ID NO: 6177 - DNA, 20 bp, Artificial Sequence
  sgRNA
  mm63652_Kcne2
tgagcacggtgaagtcgaag

SEQ ID NO: 6178 - DNA, 20 bp, Artificial Sequence
  sgRNA
  mm63653_Kcne2
cggcatgttctcgttcatcg

SEQ ID NO: 6179 - DNA, 20 bp, Artificial Sequence
  sgRNA
  mm63654_Kcne2
acatgccgatcatcaccatg

SEQ ID NO: 6180 - DNA, 20 bp, Artificial Sequence
  sgRNA
  mm63655_Kcne2
ttattacttatatggacagc

SEQ ID NO: 6181 - DNA, 20 bp, Artificial Sequence
  sgRNA
  mm63656_Vasn
tggggcagtcgatagtacgg

SEQ ID NO: 6182 - DNA, 20 bp, Artificial Sequence
  sgRNA
  mm63657_Vasn
agaccttatagtaggtactg

SEQ ID NO: 6183 - DNA, 20 bp, Artificial Sequence
  sgRNA
  mm63658_Vasn
tattgcccagatacggcccg

SEQ ID NO: 6184 - DNA, 20 bp, Artificial Sequence
  sgRNA
  mm63659_Vasn
acatggttctcacgcaccca

SEQ ID NO: 6185 - DNA, 20 bp, Artificial Sequence
  sgRNA
  mm63668_Otoa
tgctacttcaggcatcgcgg

SEQ ID NO: 6186 - DNA, 20 bp, Artificial Sequence
  sgRNA
  mm63669_Otoa
gaaggcatttcatggcggtg

SEQ ID NO: 6187 - DNA, 20 bp, Artificial Sequence
  sgRNA
  mm63670_Otoa
gagctgaagtctggtcatag

SEQ ID NO: 6188 - DNA, 20 bp, Artificial Sequence
  sgRNA
  mm63671_Otoa
gctgttccagctttgacgtg

SEQ ID NO: 6189 - DNA, 20 bp, Artificial Sequence
  sgRNA
  mm63692_Fcgr4
acttgatagaattgtcctcg

SEQ ID NO: 6190 - DNA, 20 bp, Artificial Sequence
  sgRNA
  mm63693_Fcgr4
tatggacctctagttgcact

SEQ ID NO: 6191 - DNA, 20 bp, Artificial Sequence
  sgRNA
  mm63694_Fcgr4
gcaaaacagacctgtacgga

SEQ ID NO: 6192 - DNA, 20 bp, Artificial Sequence
  sgRNA
  mm63695_Fcgr4
ggtgaacctagaccccaagt

SEQ ID NO: 6193 - DNA, 20 bp, Artificial Sequence
  sgRNA
  mm63732_Defb19
tgggtaacagaggattctgt

SEQ ID NO: 6194 - DNA, 20 bp, Artificial Sequence
  sgRNA
  mm63733_Defb19
gcaacggaactggtcgtgtc

SEQ ID NO: 6195 - DNA, 20 bp, Artificial Sequence
  sgRNA
  mm63734_Defb19
ttacccatgcattgaaggat

SEQ ID NO: 6196 - DNA, 20 bp, Artificial Sequence
  sgRNA
  mm63735_Defb19
cagttccgttgccacaagta

SEQ ID NO: 6197 - DNA, 20 bp, Artificial Sequence
  sgRNA
  mm63740_Emilin2
ctccccgacttacaccaggg

SEQ ID NO: 6198 - DNA, 20 bp, Artificial Sequence
  sgRNA
  mm63741_Emilin2
tgaatcactccgaatgtacg

SEQ ID NO: 6199 - DNA, 20 bp, Artificial Sequence
  sgRNA
  mm63742_Emilin2
cggagtgatagagctgatcg

SEQ ID NO: 6200 - DNA, 20 bp, Artificial Sequence
  sgRNA
  mm63743_Emilin2
gctggatctccagtccaccg

SEQ ID NO: 6201 - DNA, 20 bp, Artificial Sequence
  sgRNA
  mm63876_Cables2
gggtatatacctctgcaccg

SEQ ID NO: 6202 - DNA, 20 bp, Artificial Sequence
  sgRNA
  mm63877_Cables2
tctgcctacaggaagcgacg

SEQ ID NO: 6203 - DNA, 20 bp, Artificial Sequence
  sgRNA
  mm63878_Cables2
gtataaccagagcattagta

SEQ ID NO: 6204 - DNA, 20 bp, Artificial Sequence
  sgRNA
  mm63879_Cables2
aagcagaggcacccatccgg

SEQ ID NO: 6205 - DNA, 20 bp, Artificial Sequence
  sgRNA
  mm63884_Tpcn1
agaaacacgaggtaactcca

SEQ ID NO: 6206 - DNA, 20 bp, Artificial Sequence
  sgRNA
  mm63885_Tpcn1
cctcgatgaactgcaccacg

SEQ ID NO: 6207 - DNA, 20 bp, Artificial Sequence
  sgRNA
  mm63886_Tpcn1
caagccccggatgagtgcaa

SEQ ID NO: 6208 - DNA, 20 bp, Artificial Sequence
  sgRNA
  mm63887_Tpcn1
ctgggagatgaattatcaag

SEQ ID NO: 6209 - DNA, 20 bp, Artificial Sequence
  sgRNA
  mm63896_Nod2
ccgacccatcgtaagtactg

SEQ ID NO: 6210 - DNA, 20 bp, Artificial Sequence
  sgRNA
  mm63897_Nod2
agatgccgacaccatactgg

SEQ ID NO: 6211 - DNA, 20 bp, Artificial Sequence
  sgRNA
  mm63898_Nod2
gcagagtctggactgacgtg

SEQ ID NO: 6212 - DNA, 20 bp, Artificial Sequence
  sgRNA
  mm63899_Nod2
gttgtagagtctcctcacaa

SEQ ID NO: 6213 - DNA, 20 bp, Artificial Sequence
  sgRNA
  mm67724_Cadm4
gtggatcgcaaggacgacgg

SEQ ID NO: 6214 - DNA, 20 bp, Artificial Sequence
  sgRNA
  mm67725_Cadm4
gagcgtggcgatctgatggt

SEQ ID NO: 6215 - DNA, 20 bp, Artificial Sequence
  sgRNA
  mm67726_Cadm4
tcgtcattcagaacccagcc

SEQ ID NO: 6216 - DNA, 20 bp, Artificial Sequence
  sgRNA
  mm67727_Cadm4
acagaccgagaatgtgactg

SEQ ID NO: 6217 - DNA, 20 bp, Artificial Sequence
  sgRNA
  mm67784_Ly6g5b
gctgtccacagccccgtacg

SEQ ID NO: 6218 - DNA, 20 bp, Artificial Sequence
  sgRNA
  mm67785_Ly6g5b
cagaaatgcagcctagcgaa

SEQ ID NO: 6219 - DNA, 20 bp, Artificial Sequence
  sgRNA
  mm67786_Ly6g5b
tagatggtgatcaccataca

SEQ ID NO: 6220 - DNA, 20 bp, Artificial Sequence
  sgRNA
  mm67787_Ly6g5b
agcaccagagcaccctgcgt

SEQ ID NO: 6221 - DNA, 20 bp, Artificial Sequence
  sgRNA
  mm67788_Defb36
ctcgtgtcccagctcactcc

SEQ ID NO: 6222 - DNA, 20 bp, Artificial Sequence
  sgRNA
  mm67789_Defb36
gagtgagctgggacacgagc

SEQ ID NO: 6223 - DNA, 20 bp, Artificial Sequence
  sgRNA
  mm67790_Defb36
cagaaatgctggaatctcca

SEQ ID NO: 6224 - DNA, 20 bp, Artificial Sequence
  sgRNA
  mm67791_Defb36
ccgccaccgatgctccagga

SEQ ID NO: 6225 - DNA, 20 bp, Artificial Sequence
  sgRNA
  mm67816_Mill1
gggtgacaaccaaagactgg

SEQ ID NO: 6226 - DNA, 20 bp, Artificial Sequence
  sgRNA
  mm67817_Mill1
gaccttcaggaactatccag

SEQ ID NO: 6227 - DNA, 20 bp, Artificial Sequence
  sgRNA
  mm67818_Mill1
ctcatcatcgaagtatctca

SEQ ID NO: 6228 - DNA, 20 bp, Artificial Sequence
  sgRNA
  mm67819_Mill1
gaagactctcacatggacag

SEQ ID NO: 6229 - DNA, 20 bp, Artificial Sequence
  sgRNA
  mm67820_Rps15a
ctcaccgtgcttcatcatca

SEQ ID NO: 6230 - DNA, 20 bp, Artificial Sequence
  sgRNA
  mm67821_Rps15a
cctcacaggaaggttgaaca

SEQ ID NO: 6231 - DNA, 20 bp, Artificial Sequence
  sgRNA
  mm67822_Rps15a
ctttagaacatggcctgatg

SEQ ID NO: 6232 - DNA, 20 bp, Artificial Sequence
  sgRNA
  mm67823_Rps15a
atcaacaacgctgagaagag

SEQ ID NO: 6233 - DNA, 20 bp, Artificial Sequence
  sgRNA
  mm67896_Rab11fip4
ccacgcgtagaaagccgtcg

SEQ ID NO: 6234 - DNA, 20 bp, Artificial Sequence
  sgRNA
  mm67897_Rab11fip4
cgcctctcttatcagcaacg

SEQ ID NO: 6235 - DNA, 20 bp, Artificial Sequence
  sgRNA
  mm67898_Rab11fip4
ggcatgtcgcatcttccttg

SEQ ID NO: 6236 - DNA, 20 bp, Artificial Sequence
  sgRNA
  mm67899_Rab11fip4
gaacgacagcctgacgagcg

SEQ ID NO: 6237 - DNA, 20 bp, Artificial Sequence
  sgRNA
  mm67932_Mgat5b
ggagccagcgtacaaccacg

SEQ ID NO: 6238 - DNA, 20 bp, Artificial Sequence
  sgRNA
  mm67933_Mgat5b
tctcatagtacacggtaccg

SEQ ID NO: 6239 - DNA, 20 bp, Artificial Sequence
  sgRNA
  mm67934_Mgat5b
ggcagccttggtccactgtg

SEQ ID NO: 6240 - DNA, 20 bp, Artificial Sequence
  sgRNA
  mm67935_Mgat5b
tggcctggatcctttcaatg

SEQ ID NO: 6241 - DNA, 20 bp, Artificial Sequence
  sgRNA
  mm67960_Serpina5
aaggctaaagagtcctcggt

SEQ ID NO: 6242 - DNA, 20 bp, Artificial Sequence
  sgRNA
  mm67961_Serpina5
atttaccactatcatgacat

SEQ ID NO: 6243 - DNA, 20 bp, Artificial Sequence
  sgRNA
  mm67962_Serpina5
gacccccaaaaggaccacac

SEQ ID NO: 6244 - DNA, 20 bp, Artificial Sequence
  sgRNA
  mm67963_Serpina5
aactcatagacacgctcaag

SEQ ID NO: 6245 - DNA, 20 bp, Artificial Sequence
  sgRNA
  mm67988_Slc38a9
gagacttgaccattgcccaa

SEQ ID NO: 6246 - DNA, 20 bp, Artificial Sequence
  sgRNA
  mm67989_Slc38a9
tactcacatagtaactaagc

SEQ ID NO: 6247 - DNA, 20 bp, Artificial Sequence
  sgRNA
  mm67990_Slc38a9
ttcacattgacaatgttggt

SEQ ID NO: 6248 - DNA, 20 bp, Artificial Sequence
  sgRNA
  mm67991_Slc38a9
tgttcgcttaggattccatc

SEQ ID NO: 6249 - DNA, 20 bp, Artificial Sequence
  sgRNA
  mm68028_Egflam
cggtcacacaacgtcccggt

SEQ ID NO: 6250 - DNA, 20 bp, Artificial Sequence
  sgRNA
  mm68029_Egflam
gtgtcaatgactacgcctgg

SEQ ID NO: 6251 - DNA, 20 bp, Artificial Sequence
  sgRNA
  mm68030_Egflam
agagcaacagggacaaaccg

SEQ ID NO: 6252 - DNA, 20 bp, Artificial Sequence
  sgRNA
  mm68031_Egflam
cacagagtaggactgaattg

SEQ ID NO: 6253 - DNA, 20 bp, Artificial Sequence
  sgRNA
  mm68100_Scube3
cgagtgccgcttaaacaacg

SEQ ID NO: 6254 - DNA, 20 bp, Artificial Sequence
  sgRNA
  mm68101_Scube3
ctgcaagtccggctacacgg

SEQ ID NO: 6255 - DNA, 20 bp, Artificial Sequence
  sgRNA
  mm68102_Scube3
ttgacgtggcagccgcaccg

SEQ ID NO: 6256 - DNA, 20 bp, Artificial Sequence
  sgRNA
  mm68103_Scube3
gaatgtagcatcaataaggg

SEQ ID NO: 6257 - DNA, 20 bp, Artificial Sequence
  sgRNA
  mm68124_Ltbp1
gggtaccggatgtcacggag

SEQ ID NO: 6258 - DNA, 20 bp, Artificial Sequence
  sgRNA
  mm68125_Ltbp1
ccacactggtcgcatcaagg

SEQ ID NO: 6259 - DNA, 20 bp, Artificial Sequence
  sgRNA
  mm68126_Ltbp1
gggcagtgcagaaataccga

SEQ ID NO: 6260 - DNA, 20 bp, Artificial Sequence
  sgRNA
  mm68127_Ltbp1
atgaatagttgaaacccctg

SEQ ID NO: 6261 - DNA, 20 bp, Artificial Sequence
  sgRNA
  mm68176_Dpp10
tacagtgctccagtaaaccg

SEQ ID NO: 6262 - DNA, 20 bp, Artificial Sequence
  sgRNA
  mm68177_Dpp10
gagaacatactttaaatctg

SEQ ID NO: 6263 - DNA, 20 bp, Artificial Sequence
  sgRNA
  mm68178_Dpp10
agaaacaagactgtcactag

SEQ ID NO: 6264 - DNA, 20 bp, Artificial Sequence
  sgRNA
  mm68179_Dpp10
tggtagattcacagagtgtg

SEQ ID NO: 6265 - DNA, 20 bp, Artificial Sequence
  sgRNA
  mm68184_Nfasc
cgagcggtaccgaaccagtg

SEQ ID NO: 6266 - DNA, 20 bp, Artificial Sequence
  sgRNA
  mm68185_Nfasc
ggaaaacctagaccccgtcg

SEQ ID NO: 6267 - DNA, 20 bp, Artificial Sequence
  sgRNA
  mm68186_Nfasc
tgccactccgaagatcgtca

SEQ ID NO: 6268 - DNA, 20 bp, Artificial Sequence
  sgRNA
  mm68187_Nfasc
tgatcctttataaccggaca

SEQ ID NO: 6269 - DNA, 20 bp, Artificial Sequence
  sgRNA
  mm68236_Acvr1c
gactaagagacacaacgtgg

SEQ ID NO: 6270 - DNA, 20 bp, Artificial Sequence
  sgRNA
  mm68237_Acvr1c
tgagagatcttggttccgtg

SEQ ID NO: 6271 - DNA, 20 bp, Artificial Sequence
  sgRNA
  mm68238_Acvr1c
cctgagcatttagttccggg

SEQ ID NO: 6272 - DNA, 20 bp, Artificial Sequence
  sgRNA
  mm68239_Acvr1c
cgtaggaaaaggtcggtttg

SEQ ID NO: 6273 - DNA, 20 bp, Artificial Sequence
  sgRNA
  mm68240_Rtn4rl2
tgcagagcataggacagctg

SEQ ID NO: 6274 - DNA, 20 bp, Artificial Sequence
  sgRNA
  mm68241_Rtn4rl2
gaactcgagcgccggcaggt

SEQ ID NO: 6275 - DNA, 20 bp, Artificial Sequence
  sgRNA
  mm68242_Rtn4rl2
cacccaggatgacttgttcg

SEQ ID NO: 6276 - DNA, 20 bp, Artificial Sequence
  sgRNA
  mm68243_Rtn4rl2
ctcacggagcacgtgttccg

SEQ ID NO: 6277 - DNA, 20 bp, Artificial Sequence
  sgRNA
  mm68244_Muc15
tcatttcattaccatttgcg

SEQ ID NO: 6278 - DNA, 20 bp, Artificial Sequence
  sgRNA
  mm68245_Muc15
gggaggaacagaatatgtgg

SEQ ID NO: 6279 - DNA, 20 bp, Artificial Sequence
  sgRNA
  mm68246_Muc15
gaatgttcggagacctgtaa

SEQ ID NO: 6280 - DNA, 20 bp, Artificial Sequence
  sgRNA
  mm68247_Muc15
aaggttgtagataaattcaa

SEQ ID NO: 6281 - DNA, 20 bp, Artificial Sequence
  sgRNA
  mm68260_Slc28a2
tcttgagcaaagatacacac

SEQ ID NO: 6282 - DNA, 20 bp, Artificial Sequence
  sgRNA
  mm68261_Slc28a2
tggacaaggcaagtgcacaa

SEQ ID NO: 6283 - DNA, 20 bp, Artificial Sequence
  sgRNA
  mm68262_Slc28a2
agagagtcctacgaacaccc

SEQ ID NO: 6284 - DNA, 20 bp, Artificial Sequence
  sgRNA
  mm68263_Slc28a2
tggttcctgcaaattaccat

SEQ ID NO: 6285 - DNA, 20 bp, Artificial Sequence
  sgRNA
  mm68264_Slc4a11
atccaaaagcaatggtcggt

SEQ ID NO: 6286 - DNA, 20 bp, Artificial Sequence
  sgRNA
  mm68265_Slc4a11
agcggtttagcatagttcgg

SEQ ID NO: 6287 - DNA, 20 bp, Artificial Sequence
  sgRNA
  mm68266_Slc4a11
ctgctgtcagataccatcca

SEQ ID NO: 6288 - DNA, 20 bp, Artificial Sequence
  sgRNA
  mm68267_Slc4a11
ggctggcgttgagtgcagtg

SEQ ID NO: 6289 - DNA, 20 bp, Artificial Sequence
  sgRNA
  mm68300_Lrig2
ttgcgccatatggtggacat

SEQ ID NO: 6290 - DNA, 20 bp, Artificial Sequence
  sgRNA
  mm68301_Lrig2
actggagagattgaatttag

SEQ ID NO: 6291 - DNA, 20 bp, Artificial Sequence
  sgRNA
  mm68302_Lrig2
acagatactcaagggactca

SEQ ID NO: 6292 - DNA, 20 bp, Artificial Sequence
  sgRNA
  mm68303_Lrig2
agcacattctaatcttgcca

SEQ ID NO: 6293 - DNA, 20 bp, Artificial Sequence
  sgRNA
  mm68464_Megf8
gatgtgtccctagtctaccg

SEQ ID NO: 6294 - DNA, 20 bp, Artificial Sequence
  sgRNA
  mm68465_Megf8
gaattgcaacgcccacaccg

SEQ ID NO: 6295 - DNA, 20 bp, Artificial Sequence
  sgRNA
  mm68466_Megf8
cacacccttactgcccgtcg

SEQ ID NO: 6296 - DNA, 20 bp, Artificial Sequence
  sgRNA
  mm68467_Megf8
tgttctaggaaactacatgg

SEQ ID NO: 6297 - DNA, 20 bp, Artificial Sequence
  sgRNA
  mm68472_Chsy1
ggtgtaaggtgatcgctcgg

SEQ ID NO: 6298 - DNA, 20 bp, Artificial Sequence
  sgRNA
  mm68473_Chsy1
gcgtgtgaaccccatgtacg

SEQ ID NO: 6299 - DNA, 20 bp, Artificial Sequence
  sgRNA
  mm68474_Chsy1
aagagaaagttcctgtcgcg

SEQ ID NO: 6300 - DNA, 20 bp, Artificial Sequence
  sgRNA
  mm68475_Chsy1
caagtacgagtggtttatga

SEQ ID NO: 6301 - DNA, 20 bp, Artificial Sequence
  sgRNA
  mm68572_Fat3
gtgacaatcagacctgaccg

SEQ ID NO: 6302 - DNA, 20 bp, Artificial Sequence
  sgRNA
  mm68573_Fat3
caaagtaaccgagattgtag

SEQ ID NO: 6303 - DNA, 20 bp, Artificial Sequence
  sgRNA
  mm68574_Fat3
acgagacaatcataatggag

SEQ ID NO: 6304 - DNA, 20 bp, Artificial Sequence
  sgRNA
  mm68575_Fat3
acttctggtgtatcagattg

SEQ ID NO: 6305 - DNA, 20 bp, Artificial Sequence
  sgRNA
  mm68584_Amica1
tatgactccaacatgcgtag

SEQ ID NO: 6306 - DNA, 20 bp, Artificial Sequence
  sgRNA
  mm68585_Amica1
tacacttgcagcatctacgt

SEQ ID NO: 6307 - DNA, 20 bp, Artificial Sequence
  sgRNA
  mm68586_Amica1
ccaaccttagcgtgcctacg

SEQ ID NO: 6308 - DNA, 20 bp, Artificial Sequence
  sgRNA
  mm68587_Amica1
gtgggtgaatcagtcttgat

SEQ ID NO: 6309 - DNA, 20 bp, Artificial Sequence
  sgRNA
  mm68600_Myo9a
tttatcaagagcataatgaa

SEQ ID NO: 6310 - DNA, 20 bp, Artificial Sequence
  sgRNA
  mm68601_Myo9a
actatataaagacttagcca

SEQ ID NO: 6311 - DNA, 20 bp, Artificial Sequence
  sgRNA
  mm68602_Myo9a
catgcttaaagcgattccgt

SEQ ID NO: 6312 - DNA, 20 bp, Artificial Sequence
  sgRNA
  mm68603_Myo9a
ccgaagctgtcttagtacca

SEQ ID NO: 6313 - DNA, 20 bp, Artificial Sequence
  sgRNA
  mm68608_Ephb1
gtgttgtagcctgtcctgcg

SEQ ID NO: 6314 - DNA, 20 bp, Artificial Sequence
  sgRNA
  mm68609_Ephb1
gatagatgtctcattcacga

SEQ ID NO: 6315 - DNA, 20 bp, Artificial Sequence
  sgRNA
  mm68610_Ephb1
cagcacgtatcgatgggcta

SEQ ID NO: 6316 - DNA, 20 bp, Artificial Sequence
  sgRNA
  mm68611_Ephb1
tcatccaataaggctcccca

SEQ ID NO: 6317 - DNA, 20 bp, Artificial Sequence
  sgRNA
  mm68700_Cd200r2
acagacactatggtgtacac

SEQ ID NO: 6318 - DNA, 20 bp, Artificial Sequence
  sgRNA
  mm68701_Cd200r2
tgaagtaacctactttctcg

SEQ ID NO: 6319 - DNA, 20 bp, Artificial Sequence
  sgRNA
  mm68702_Cd200r2
tcctgaccttcagatcagtg

SEQ ID NO: 6320 - DNA, 20 bp, Artificial Sequence
  sgRNA
  mm68703_Cd200r2
tgtgagataacaacacctga

SEQ ID NO: 6321 - DNA, 20 bp, Artificial Sequence
  sgRNA
  mm68776_Lppr1
aagtgatagaaaaagctcgg

SEQ ID NO: 6322 - DNA, 20 bp, Artificial Sequence
  sgRNA
  mm68777_Lppr1
gtatttcataaagtcaacaa

SEQ ID NO: 6323 - DNA, 20 bp, Artificial Sequence
  sgRNA
  mm68778_Lppr1
acttaatgaagccttacccg

SEQ ID NO: 6324 - DNA, 20 bp, Artificial Sequence
  sgRNA
  mm68779_Lppr1
tgatgatccttcggagtaag

SEQ ID NO: 6325 - DNA, 20 bp, Artificial Sequence
  sgRNA
  mm68796_Lrrc4b
cacaggcacatccatgacgt

SEQ ID NO: 6326 - DNA, 20 bp, Artificial Sequence
  sgRNA
  mm68797_Lrrc4b
cacggccgacacgttaagcg

SEQ ID NO: 6327 - DNA, 20 bp, Artificial Sequence
  sgRNA
  mm68798_Lrrc4b
cctggtgcgaaagatcgagg

SEQ ID NO: 6328 - DNA, 20 bp, Artificial Sequence
  sgRNA
  mm68799_Lrrc4b
gaggctggagtacatatctg

SEQ ID NO: 6329 - DNA, 20 bp, Artificial Sequence
  sgRNA
  mm68856_Pigs
accataatgccaccccagcg

SEQ ID NO: 6330 - DNA, 20 bp, Artificial Sequence
  sgRNA
  mm68857_Pigs
gggcgacctggactatgcga

SEQ ID NO: 6331 - DNA, 20 bp, Artificial Sequence
  sgRNA
  mm68858_Pigs
gatctctcgctcatgcacaa

SEQ ID NO: 6332 - DNA, 20 bp, Artificial Sequence
  sgRNA
  mm68859_Pigs
ctacctaagctggacttgag

SEQ ID NO: 6333 - DNA, 20 bp, Artificial Sequence
  sgRNA
  mm69064_Tlr13
aatattcggactctcaacca

SEQ ID NO: 6334 - DNA, 20 bp, Artificial Sequence
  sgRNA
  mm69065_Tlr13
agtaattgggagcttagaca

SEQ ID NO: 6335 - DNA, 20 bp, Artificial Sequence
  sgRNA
  mm69066_Tlr13
aactttgtgaggttaatcag

SEQ ID NO: 6336 - DNA, 20 bp, Artificial Sequence
  sgRNA
  mm69067_Tlr13
tcaatttggaagatcgacga

SEQ ID NO: 6337 - DNA, 20 bp, Artificial Sequence
  sgRNA
  mm69068_Pcdh19
gctcgctattgaccgacagg

SEQ ID NO: 6338 - DNA, 20 bp, Artificial Sequence
  sgRNA
  mm69069_Pcdh19
gagccgagttggacaccacg

SEQ ID NO: 6339 - DNA, 20 bp, Artificial Sequence
  sgRNA
  mm69070_Pcdh19
ttggcctggaaataaagacg

SEQ ID NO: 6340 - DNA, 20 bp, Artificial Sequence
  sgRNA
  mm69071_Pcdh19
gttctcattaaaggtacgag

SEQ ID NO: 6341 - DNA, 20 bp, Artificial Sequence
  sgRNA
  mm69332_Rpl17
ttaccttaaagtgaacacga

SEQ ID NO: 6342 - DNA, 20 bp, Artificial Sequence
  sgRNA
  mm69333_Rpl17
gagaatctacgtctaaaccc

SEQ ID NO: 6343 - DNA, 20 bp, Artificial Sequence
  sgRNA
  mm69334_Rpl17
tggagttggtaggtgcgccc

SEQ ID NO: 6344 - DNA, 20 bp, Artificial Sequence
  sgRNA
  mm69335_Rpl17
agcaatgtgtgccattccgg

SEQ ID NO: 6345 - DNA, 20 bp, Artificial Sequence
  sgRNA
  mm69424_Dpep2
caagcacccaatgacccttg

SEQ ID NO: 6346 - DNA, 20 bp, Artificial Sequence
  sgRNA
  mm69425_Dpep2
agaaacttcgaagcacagcg

SEQ ID NO: 6347 - DNA, 20 bp, Artificial Sequence
  sgRNA
  mm69426_Dpep2
ttacgtaccatgccagacgc

SEQ ID NO: 6348 - DNA, 20 bp, Artificial Sequence
  sgRNA
  mm69427_Dpep2
aggagttcccgcttatagat

SEQ ID NO: 6349 - DNA, 20 bp, Artificial Sequence
  sgRNA
  mm69456_Itga11
caacgtgaccagatacgctg

SEQ ID NO: 6350 - DNA, 20 bp, Artificial Sequence
  sgRNA
  mm69457_Itga11
ccaaagtaggagcctatctg

SEQ ID NO: 6351 - DNA, 20 bp, Artificial Sequence
  sgRNA
  mm69458_Itga11
ttaaggtaggactctcggtg

SEQ ID NO: 6352 - DNA, 20 bp, Artificial Sequence
  sgRNA
  mm69459_Itga11
tggcgttgatttgaactaca

SEQ ID NO: 6353 - DNA, 20 bp, Artificial Sequence
  sgRNA
  mm69472_Nrcam
ggacgtatacttgtgtcgca

SEQ ID NO: 6354 - DNA, 20 bp, Artificial Sequence
  sgRNA
  mm69473_Nrcam
gccggaggtaatccaatcgg

SEQ ID NO: 6355 - DNA, 20 bp, Artificial Sequence
  sgRNA
  mm69474_Nrcam
cattagtttaccgtaaatgg

SEQ ID NO: 6356 - DNA, 20 bp, Artificial Sequence
  sgRNA
  mm69475_Nrcam
gctgatgtgagaatccgagg

SEQ ID NO: 6357 - DNA, 20 bp, Artificial Sequence
  sgRNA
  mm69516_Defb20
gcaacgtagaaggctactgt

SEQ ID NO: 6358 - DNA, 20 bp, Artificial Sequence
  sgRNA
  mm69517_Defb20
taggaagaaatgcagattag

SEQ ID NO: 6359 - DNA, 20 bp, Artificial Sequence
  sgRNA
  mm69518_Defb20
ttagtggagatatctgagat

SEQ ID NO: 6360 - DNA, 20 bp, Artificial Sequence
  sgRNA
  mm69519_Defb20
gtgccacaaacagcaaaaca

SEQ ID NO: 6361 - DNA, 20 bp, Artificial Sequence
  sgRNA
  mm69588_Podxl2
gctatagttctgaacccccg

SEQ ID NO: 6362 - DNA, 20 bp, Artificial Sequence
  sgRNA
  mm69589_Podxl2
cttacctgagtagagtccca

SEQ ID NO: 6363 - DNA, 20 bp, Artificial Sequence
  sgRNA
  mm69590_Podxl2
tcctgcagaggcatatgcca

SEQ ID NO: 6364 - DNA, 20 bp, Artificial Sequence
  sgRNA
  mm69591_Podxl2
tgggactgaggtccccagtg

SEQ ID NO: 6365 - DNA, 20 bp, Artificial Sequence
  sgRNA
  mm69636_Smo
gaactccaatcgctaccctg

SEQ ID NO: 6366 - DNA, 20 bp, Artificial Sequence
  sgRNA
  mm69637_Smo
tcagaacccgctgttcaccg

SEQ ID NO: 6367 - DNA, 20 bp, Artificial Sequence
  sgRNA
  mm69638_Smo
caagtgtgagaatgaccgag

SEQ ID NO: 6368 - DNA, 20 bp, Artificial Sequence
  sgRNA
  mm69639_Smo
gtagatggagactccgtgag

SEQ ID NO: 6369 - DNA, 20 bp, Artificial Sequence
  sgRNA
  mm69676_Rc3h2
gtttctcagctaatcccacg

SEQ ID NO: 6370 - DNA, 20 bp, Artificial Sequence
  sgRNA
  mm69677_Rc3h2
agaattcattcgatctcgag

SEQ ID NO: 6371 - DNA, 20 bp, Artificial Sequence
  sgRNA
  mm69678_Rc3h2
agtggcaaaaaaatgcgtag

SEQ ID NO: 6372 - DNA, 20 bp, Artificial Sequence
  sgRNA
  mm69679_Rc3h2
gccgagatttacgacaacaa

SEQ ID NO: 6373 - DNA, 20 bp, Artificial Sequence
  sgRNA
  mm69784_Casc4
tcaagcggctagaatacgag

SEQ ID NO: 6374 - DNA, 20 bp, Artificial Sequence
  sgRNA
  mm69785_Casc4
ctgaagcagaacgtggcggg

SEQ ID NO: 6375 - DNA, 20 bp, Artificial Sequence
  sgRNA
  mm69786_Casc4
aggcctggggaagagatgcg

SEQ ID NO: 6376 - DNA, 20 bp, Artificial Sequence
  sgRNA
  mm69787_Casc4
atggggaagatgattgcttg

SEQ ID NO: 6377 - DNA, 20 bp, Artificial Sequence
  sgRNA
  mm69796_Sidt1
tttcgatcgcgtctacagcg

SEQ ID NO: 6378 - DNA, 20 bp, Artificial Sequence
  sgRNA
  mm69797_Sidt1
ttgtgcttgtccatcatgtg

SEQ ID NO: 6379 - DNA, 20 bp, Artificial Sequence
  sgRNA
  mm69798_Sidt1
cccgcggctacagataccaa

SEQ ID NO: 6380 - DNA, 20 bp, Artificial Sequence
  sgRNA
  mm69799_Sidt1
gaacggagacaactgaacac

SEQ ID NO: 6381 - DNA, 20 bp, Artificial Sequence
  sgRNA
  mm69808_Nceh1
tagatgacgctgcgtcgcag

SEQ ID NO: 6382 - DNA, 20 bp, Artificial Sequence
  sgRNA
  mm69809_Nceh1
tacctaaccatgacatgacg

SEQ ID NO: 6383 - DNA, 20 bp, Artificial Sequence
  sgRNA
  mm69810_Nceh1
attcttcaggctggcaacgt

SEQ ID NO: 6384 - DNA, 20 bp, Artificial Sequence
  sgRNA
  mm69811_Nceh1
tcactcaatagaaacgatga

SEQ ID NO: 6385 - DNA, 20 bp, Artificial Sequence
  sgRNA
  mm70116_Lmbrd2
gctccattccagtatgaccg

SEQ ID NO: 6386 - DNA, 20 bp, Artificial Sequence
  sgRNA
  mm70117_Lmbrd2
tcaagtacaaccacccactg

SEQ ID NO: 6387 - DNA, 20 bp, Artificial Sequence
  sgRNA
  mm70118_Lmbrd2
taccattctaaatgcaaacg

SEQ ID NO: 6388 - DNA, 20 bp, Artificial Sequence
  sgRNA
  mm70119_Lmbrd2
gatagacaaaaccacagcaa

SEQ ID NO: 6389 - DNA, 20 bp, Artificial Sequence
  sgRNA
  mm70120_Cachd1
cctaccgttcatgagggcgt

SEQ ID NO: 6390 - DNA, 20 bp, Artificial Sequence
  sgRNA
  mm70121_Cachd1
tcccaaccggatgattgatg

SEQ ID NO: 6391 - DNA, 20 bp, Artificial Sequence
  sgRNA
  mm70122_Cachd1
tgggtgttgctatgtaacgg

SEQ ID NO: 6392 - DNA, 20 bp, Artificial Sequence
  sgRNA
  mm70123_Cachd1
tgggtatcgacttcacactg

SEQ ID NO: 6393 - DNA, 20 bp, Artificial Sequence
  sgRNA
  mm70132_Tmem104
tggaaatgactcttgcggcg

SEQ ID NO: 6394 - DNA, 20 bp, Artificial Sequence
  sgRNA
  mm70133_Tmem104
tggtattcgtaggcttcatg

SEQ ID NO: 6395 - DNA, 20 bp, Artificial Sequence
  sgRNA
  mm70134_Tmem104
tcagccaagacaactacgag

SEQ ID NO: 6396 - DNA, 20 bp, Artificial Sequence
  sgRNA
  mm70135_Tmem104
acccccaagaagttggctag

SEQ ID NO: 6397 - DNA, 20 bp, Artificial Sequence
  sgRNA
  mm70164_Islr2
aagattacggtactaaggcg

SEQ ID NO: 6398 - DNA, 20 bp, Artificial Sequence
  sgRNA
  mm70165_Islr2
gcagcgcgctcaagttacga

SEQ ID NO: 6399 - DNA, 20 bp, Artificial Sequence
  sgRNA
  mm70166_Islr2
atggttagacacatagcgag

SEQ ID NO: 6400 - DNA, 20 bp, Artificial Sequence
  sgRNA
  mm70167_Islr2
cacccgtaaggacgttgagt

SEQ ID NO: 6401 - DNA, 20 bp, Artificial Sequence
  sgRNA
  mm70276_Tmem117
agctgggacaaactgaaccg

SEQ ID NO: 6402 - DNA, 20 bp, Artificial Sequence
  sgRNA
  mm70277_Tmem117
acatcgtcatccacgaccca

SEQ ID NO: 6403 - DNA, 20 bp, Artificial Sequence
  sgRNA
  mm70278_Tmem117
tctggaagaaaggcaacgtg

SEQ ID NO: 6404 - DNA, 20 bp, Artificial Sequence
  sgRNA
  mm70279_Tmem117
atatactgtccatattcatg

SEQ ID NO: 6405 - DNA, 20 bp, Artificial Sequence
  sgRNA
  mm70292_Slc26a9
ttgtgggggagatccgacaa

SEQ ID NO: 6406 - DNA, 20 bp, Artificial Sequence
  sgRNA
  mm70293_Slc26a9
gggtctggaagatcacaacc

SEQ ID NO: 6407 - DNA, 20 bp, Artificial Sequence
  sgRNA
  mm70294_Slc26a9
agagagcgcagcaaatgacg

SEQ ID NO: 6408 - DNA, 20 bp, Artificial Sequence
  sgRNA
  mm70295_Slc26a9
ttctagactcacaaagacga

SEQ ID NO: 6409 - DNA, 20 bp, Artificial Sequence
  sgRNA
  mm70324_Mdga2
ttactacaaggatctgacaa

SEQ ID NO: 6410 - DNA, 20 bp, Artificial Sequence
  sgRNA
  mm70325_Mdga2
aaagttatgatgggaccctg

SEQ ID NO: 6411 - DNA, 20 bp, Artificial Sequence
  sgRNA
  mm70326_Mdga2
gcattcttggaaatccgtca

SEQ ID NO: 6412 - DNA, 20 bp, Artificial Sequence
  sgRNA
  mm70327_Mdga2
ttagtatgtgttacaactgg

SEQ ID NO: 6413 - DNA, 20 bp, Artificial Sequence
  sgRNA
  mm70336_Pkn1
gctcaagctggacaacacag

SEQ ID NO: 6414 - DNA, 20 bp, Artificial Sequence
  sgRNA
  mm70337_Pkn1
cagtaagtctaggcgtcgag

SEQ ID NO: 6415 - DNA, 20 bp, Artificial Sequence
  sgRNA
  mm70338_Pkn1
atgatccagacctatagcaa

SEQ ID NO: 6416 - DNA, 20 bp, Artificial Sequence
  sgRNA
  mm70339_Pkn1
aaagtcgcccctgacacttg

SEQ ID NO: 6417 - DNA, 20 bp, Artificial Sequence
  sgRNA
  mm70372_Negr1
agatgaacctgcattgtccg

SEQ ID NO: 6418 - DNA, 20 bp, Artificial Sequence
  sgRNA
  mm70373_Negr1
aatgtggaaatggaaactcg

SEQ ID NO: 6419 - DNA, 20 bp, Artificial Sequence
  sgRNA
  mm70374_Negr1
ttatggaattacaagggacc

SEQ ID NO: 6420 - DNA, 20 bp, Artificial Sequence
  sgRNA
  mm70375_Negr1
cagagcctgtcatttcctgg

SEQ ID NO: 6421 - DNA, 20 bp, Artificial Sequence
  sgRNA
  mm70396_Cdh10
ataaaaacgtggatccacat

SEQ ID NO: 6422 - DNA, 20 bp, Artificial Sequence
  sgRNA
  mm70397_Cdh10
aagccactgatgctgacacg

SEQ ID NO: 6423 - DNA, 20 bp, Artificial Sequence
  sgRNA
  mm70398_Cdh10
tgattatcaatatgtaggca

SEQ ID NO: 6424 - DNA, 20 bp, Artificial Sequence
  sgRNA
  mm70399_Cdh10
tgagataattcacgatcaag

SEQ ID NO: 6425 - DNA, 20 bp, Artificial Sequence
  sgRNA
  mm70404_Itgb8
ccagataataaagatccacg

SEQ ID NO: 6426 - DNA, 20 bp, Artificial Sequence
  sgRNA
  mm70405_Itgb8
acatgaatgtatccatgggg

SEQ ID NO: 6427 - DNA, 20 bp, Artificial Sequence
  sgRNA
  mm70406_Itgb8
atttcagaacacaatagatg

SEQ ID NO: 6428 - DNA, 20 bp, Artificial Sequence
  sgRNA
  mm70407_Itgb8
atgaaaacatgtgatatcat

SEQ ID NO: 6429 - DNA, 20 bp, Artificial Sequence
  sgRNA
  mm70428_Lrrn4
gagtggtgactcccgcggcg

SEQ ID NO: 6430 - DNA, 20 bp, Artificial Sequence
  sgRNA
  mm70429_Lrrn4
caaaaactgaatgatcgaag

SEQ ID NO: 6431 - DNA, 20 bp, Artificial Sequence
  sgRNA
  mm70430_Lrrn4
attaggctcaaggatatgtg

SEQ ID NO: 6432 - DNA, 20 bp, Artificial Sequence
  sgRNA
  mm70431_Lrrn4
cgcccaggaggcattcgcgg

SEQ ID NO: 6433 - DNA, 20 bp, Artificial Sequence
  sgRNA
  mm70512_Tmem26
ctcaccctcaagttcaagcg

SEQ ID NO: 6434 - DNA, 20 bp, Artificial Sequence
  sgRNA
  mm70513_Tmem26
taatattaatcattggacgg

SEQ ID NO: 6435 - DNA, 20 bp, Artificial Sequence
  sgRNA
  mm70514_Tmem26
ccagaccggttcacatacca

SEQ ID NO: 6436 - DNA, 20 bp, Artificial Sequence
  sgRNA
  mm70515_Tmem26
gtgcatttcaagaagccaca

SEQ ID NO: 6437 - DNA, 20 bp, Artificial Sequence
  sgRNA
  mm70732_Mslnl
ggcaagcagccaccacactg

SEQ ID NO: 6438 - DNA, 20 bp, Artificial Sequence
  sgRNA
  mm70733_Mslnl
gcttactgtcatgcagactg

SEQ ID NO: 6439 - DNA, 20 bp, Artificial Sequence
  sgRNA
  mm70734_Mslnl
tccactggcctatttcagcg

SEQ ID NO: 6440 - DNA, 20 bp, Artificial Sequence
  sgRNA
  mm70735_Mslnl
gcagggagatcctgtgtccg

SEQ ID NO: 6441 - DNA, 20 bp, Artificial Sequence
  sgRNA
  mm70760_Treml2
gaaccgccggaacttagttg

SEQ ID NO: 6442 - DNA, 20 bp, Artificial Sequence
  sgRNA
  mm70761_Treml2
caaggtagtccgtatcacca

SEQ ID NO: 6443 - DNA, 20 bp, Artificial Sequence
  sgRNA
  mm70762_Treml2
cgtgacaaatccatccatgg

SEQ ID NO: 6444 - DNA, 20 bp, Artificial Sequence
  sgRNA
  mm70763_Treml2
tacagtttcatcgataccag

SEQ ID NO: 6445 - DNA, 20 bp, Artificial Sequence
  sgRNA
  mm70792_Pkd2l1
tcagtacaataacatgaacg

SEQ ID NO: 6446 - DNA, 20 bp, Artificial Sequence
  sgRNA
  mm70793_Pkd2l1
cgtgcgcaatgactcctgtg

SEQ ID NO: 6447 - DNA, 20 bp, Artificial Sequence
  sgRNA
  mm70794_Pkd2l1
cacacagacagatgtccacg

SEQ ID NO: 6448 - DNA, 20 bp, Artificial Sequence
  sgRNA
  mm70795_Pkd2l1
gatccgctatgtgaataact

SEQ ID NO: 6449 - DNA, 20 bp, Artificial Sequence
  sgRNA
  mm70836_Tnn
aattgatggaccaaccaatg

SEQ ID NO: 6450 - DNA, 20 bp, Artificial Sequence
  sgRNA
  mm70837_Tnn
gggtgtctgccagtgccacg

SEQ ID NO: 6451 - DNA, 20 bp, Artificial Sequence
  sgRNA
  mm70838_Tnn
ggctgacatcgacaggtatg

SEQ ID NO: 6452 - DNA, 20 bp, Artificial Sequence
  sgRNA
  mm70839_Tnn
cagcacacctatgacatcac

SEQ ID NO: 6453 - DNA, 20 bp, Artificial Sequence
  sgRNA
  mm70916_Fat4
gacatcgtggacgatcgagg

SEQ ID NO: 6454 - DNA, 20 bp, Artificial Sequence
  sgRNA
  mm70917_Fat4
cagttatctcatcactaccg

SEQ ID NO: 6455 - DNA, 20 bp, Artificial Sequence
  sgRNA
  mm70918_Fat4
gggatgtcgaaagagtacac

SEQ ID NO: 6456 - DNA, 20 bp, Artificial Sequence
  sgRNA
  mm70919_Fat4
attagatcctatgtccgcgt

SEQ ID NO: 6457 - DNA, 20 bp, Artificial Sequence
  sgRNA
  mm70960_Tmem67
tcacaaatgttggttcgcag

SEQ ID NO: 6458 - DNA, 20 bp, Artificial Sequence
  sgRNA
  mm70961_Tmem67
attgattgggaacggccgaa

SEQ ID NO: 6459 - DNA, 20 bp, Artificial Sequence
  sgRNA
  mm70962_Tmem67
ttgctacccagatttcactg

SEQ ID NO: 6460 - DNA, 20 bp, Artificial Sequence
  sgRNA
  mm70963_Tmem67
gctgcttcctatgatatacg

SEQ ID NO: 6461 - DNA, 20 bp, Artificial Sequence
  sgRNA
  mm71032_Slc5a6
cttacttaatcccagagatg

SEQ ID NO: 6462 - DNA, 20 bp, Artificial Sequence
  sgRNA
  mm71033_Slc5a6
caaacatgaccagaccaatg

SEQ ID NO: 6463 - DNA, 20 bp, Artificial Sequence
  sgRNA
  mm71034_Slc5a6
gcagttcaccaacggtatgg

SEQ ID NO: 6464 - DNA, 20 bp, Artificial Sequence
  sgRNA
  mm71035_Slc5a6
atcctataggtgatatacat

SEQ ID NO: 6465 - DNA, 20 bp, Artificial Sequence
  sgRNA
  mm71088_Sdk1
tgtgaaatcatatccgaggg

SEQ ID NO: 6466 - DNA, 20 bp, Artificial Sequence
  sgRNA
  mm71089_Sdk1
aatgaggcaagtgaacatcg

SEQ ID NO: 6467 - DNA, 20 bp, Artificial Sequence
  sgRNA
  mm71090_Sdk1
tgtgcgaggcgacactccgg

SEQ ID NO: 6468 - DNA, 20 bp, Artificial Sequence
  sgRNA
  mm71091_Sdk1
gaaggtgtgaggactaccgc

SEQ ID NO: 6469 - DNA, 20 bp, Artificial Sequence
  sgRNA
  mm71096_Pon2
aggtgaaatattgatcccgt

SEQ ID NO: 6470 - DNA, 20 bp, Artificial Sequence
  sgRNA
  mm71097_Pon2
gacatacttgaacctacact

SEQ ID NO: 6471 - DNA, 20 bp, Artificial Sequence
  sgRNA
  mm71098_Pon2
gcggttcctagcgctcaggt

SEQ ID NO: 6472 - DNA, 20 bp, Artificial Sequence
  sgRNA
  mm71099_Pon2
atctcaaagacgagagaccg

SEQ ID NO: 6473 - DNA, 20 bp, Artificial Sequence
  sgRNA
  mm71100_Thsd7a
ctgtaggggatgtgacatcg

SEQ ID NO: 6474 - DNA, 20 bp, Artificial Sequence
  sgRNA
  mm71101_Thsd7a
catctgtgtgcgagtcaacg

SEQ ID NO: 6475 - DNA, 20 bp, Artificial Sequence
  sgRNA
  mm71102_Thsd7a
tgtgcgttatatttgtcaca

SEQ ID NO: 6476 - DNA, 20 bp, Artificial Sequence
  sgRNA
  mm71103_Thsd7a
cgcgaaaagccttataacgg

SEQ ID NO: 6477 - DNA, 20 bp, Artificial Sequence
  sgRNA
  mm71176_Bsph1
atttcacttctatacaagaa

SEQ ID NO: 6478 - DNA, 20 bp, Artificial Sequence
  sgRNA
  mm71177_Bsph1
atttcaatctgaaacacaag

SEQ ID NO: 6479 - DNA, 20 bp, Artificial Sequence
  sgRNA
  mm71178_Bsph1
gattattatgcaccaactat

SEQ ID NO: 6480 - DNA, 20 bp, Artificial Sequence
  sgRNA
  mm71179_Bsph1
cacagtatttccagtaacct

SEQ ID NO: 6481 - DNA, 20 bp, Artificial Sequence
  sgRNA
  mm71320_Slc9a9
cacttaccctatgaccacac

SEQ ID NO: 6482 - DNA, 20 bp, Artificial Sequence
  sgRNA
  mm71321_Slc9a9
tgttgactagtagagttgat

SEQ ID NO: 6483 - DNA, 20 bp, Artificial Sequence
  sgRNA
  mm71322_Slc9a9
gagtgtactgaatgatgcgg

SEQ ID NO: 6484 - DNA, 20 bp, Artificial Sequence
  sgRNA
  mm71323_Slc9a9
atccgatgacagattgttgt

SEQ ID NO: 6485 - DNA, 20 bp, Artificial Sequence
  sgRNA
  mm71352_Il1rapl1
ttgaaaatggaaacggacgt

SEQ ID NO: 6486 - DNA, 20 bp, Artificial Sequence
  sgRNA
  mm71353_Il1rapl1
aatttcatgccgagacatag

SEQ ID NO: 6487 - DNA, 20 bp, Artificial Sequence
  sgRNA
  mm71354_Il1rapl1
ccagtggaatcaagagactg

SEQ ID NO: 6488 - DNA, 20 bp, Artificial Sequence
  sgRNA
  mm71355_Il1rapl1
caacattactacaggacagt

SEQ ID NO: 6489 - DNA, 20 bp, Artificial Sequence
  sgRNA
  mm71544_Cd59b
tattatgagccgattagacg

SEQ ID NO: 6490 - DNA, 20 bp, Artificial Sequence
  sgRNA
  mm71545_Cd59b
atgctacaactgtttagacc

SEQ ID NO: 6491 - DNA, 20 bp, Artificial Sequence
  sgRNA
  mm71546_Cd59b
ggcaagtgtatcaacagtgt

SEQ ID NO: 6492 - DNA, 20 bp, Artificial Sequence
  sgRNA
  mm71547_Cd59b
ttgatacacttgccttcctg

SEQ ID NO: 6493 - DNA, 20 bp, Artificial Sequence
  sgRNA
  mm71592_Ust
caagtgtggcagtcgtaccg

SEQ ID NO: 6494 - DNA, 20 bp, Artificial Sequence
  sgRNA
  mm71593_Ust
gaataaatagggctgttcgg

SEQ ID NO: 6495 - DNA, 20 bp, Artificial Sequence
  sgRNA
  mm71594_Ust
tagacagaaatctactgacg

SEQ ID NO: 6496 - DNA, 20 bp, Artificial Sequence
  sgRNA
  mm71595_Ust
acaggccttaccttactagg

SEQ ID NO: 6497 - DNA, 20 bp, Artificial Sequence
  sgRNA
  mm71692_Gjd3
tcgaccgtgtgcggacaagg

SEQ ID NO: 6498 - DNA, 20 bp, Artificial Sequence
  sgRNA
  mm71693_Gjd3
gaacaccgcacctcccaccg

SEQ ID NO: 6499 - DNA, 20 bp, Artificial Sequence
  sgRNA
  mm71694_Gjd3
gagtagatgacgaacagcac

SEQ ID NO: 6500 - DNA, 20 bp, Artificial Sequence
  sgRNA
  mm71695_Gjd3
gtgtgtaacacgttgcagcc

SEQ ID NO: 6501 - DNA, 20 bp, Artificial Sequence
  sgRNA
  mm71816_Defb34
agaaatgcagcaggattaat

SEQ ID NO: 6502 - DNA, 20 bp, Artificial Sequence
  sgRNA
  mm71817_Defb34
aagaacttgttgctctctgc

SEQ ID NO: 6503 - DNA, 20 bp, Artificial Sequence
  sgRNA
  mm71818_Defb34
tctttgctgttctcttcttt

SEQ ID NO: 6504 - DNA, 20 bp, Artificial Sequence
  sgRNA
  mm71819_Defb34
aaaaaaaaaaaatgcattct

SEQ ID NO: 6505 - DNA, 20 bp, Artificial Sequence
  sgRNA
  mm71888_Lrrc24
tcccaccgggaatccctccg

SEQ ID NO: 6506 - DNA, 20 bp, Artificial Sequence
  sgRNA
  mm71889_Lrrc24
agtctactagaagtatctgg

SEQ ID NO: 6507 - DNA, 20 bp, Artificial Sequence
  sgRNA
  mm71890_Lrrc24
gcttgaggcttaccatcgcg

SEQ ID NO: 6508 - DNA, 20 bp, Artificial Sequence
  sgRNA
  mm71891_Lrrc24
gaggtccagtagggctaagg

SEQ ID NO: 6509 - DNA, 20 bp, Artificial Sequence
  sgRNA
  mm71892_Raet1e
gagcacttcacgtcacacca

SEQ ID NO: 6510 - DNA, 20 bp, Artificial Sequence
  sgRNA
  mm71893_Raet1e
tcctggcacaaatcgttcag

SEQ ID NO: 6511 - DNA, 20 bp, Artificial Sequence
  sgRNA
  mm71894_Raet1e
gaactcaccatccagcccgt

SEQ ID NO: 6512 - DNA, 20 bp, Artificial Sequence
  sgRNA
  mm71895_Raet1e
tctacacagagaatatgagc

SEQ ID NO: 6513 - DNA, 20 bp, Artificial Sequence
  sgRNA
  mm71948_Tmem102
ctgcctggggtggaaaacga

SEQ ID NO: 6514 - DNA, 20 bp, Artificial Sequence
  sgRNA
  mm71949_Tmem102
aagccaagtcccaaagccgt

SEQ ID NO: 6515 - DNA, 20 bp, Artificial Sequence
  sgRNA
  mm71950_Tmem102
gctcttcgacttgatcccgg

SEQ ID NO: 6516 - DNA, 20 bp, Artificial Sequence
  sgRNA
  mm71951_Tmem102
gtgccatccagagaaaacac

SEQ ID NO: 6517 - DNA, 20 bp, Artificial Sequence
  sgRNA
  mm72092_Tmem106c
cagccaactcacgttctctg

SEQ ID NO: 6518 - DNA, 20 bp, Artificial Sequence
  sgRNA
  mm72093_Tmem106c
tgatgccgttatcgtccacg

SEQ ID NO: 6519 - DNA, 20 bp, Artificial Sequence
  sgRNA
  mm72094_Tmem106c
cacataggggaactgagcga

SEQ ID NO: 6520 - DNA, 20 bp, Artificial Sequence
  sgRNA
  mm72095_Tmem106c
gaactccaacttctatcctg

SEQ ID NO: 6521 - DNA, 20 bp, Artificial Sequence
  sgRNA
  mm72404_Gpr176
tgtagatcagaacatacacc

SEQ ID NO: 6522 - DNA, 20 bp, Artificial Sequence
  sgRNA
  mm72405_Gpr176
ggtgctcaaattcctacaca

SEQ ID NO: 6523 - DNA, 20 bp, Artificial Sequence
  sgRNA
  mm72406_Gpr176
ccggtggtgcaactgcacca

SEQ ID NO: 6524 - DNA, 20 bp, Artificial Sequence
  sgRNA
  mm72407_Gpr176
agtctggtagacaaccaggg

SEQ ID NO: 6525 - DNA, 20 bp, Artificial Sequence
  sgRNA
  mm72448_Dpy19l4
catcatgaaagtgtacgtcg

SEQ ID NO: 6526 - DNA, 20 bp, Artificial Sequence
  sgRNA
  mm72449_Dpy19l4
aaggcgccgtcattcgagag

SEQ ID NO: 6527 - DNA, 20 bp, Artificial Sequence
  sgRNA
  mm72450_Dpy19l4
aagattcaaggtcaccggca

SEQ ID NO: 6528 - DNA, 20 bp, Artificial Sequence
  sgRNA
  mm72451_Dpy19l4
gttacaagttggcttatgag

SEQ ID NO: 6529 - DNA, 20 bp, Artificial Sequence
  sgRNA
  mm72628_Clec4b2
ggcatcccagaataagagtg

SEQ ID NO: 6530 - DNA, 20 bp, Artificial Sequence
  sgRNA
  mm72629_Clec4b2
tgagattggaatggtatgtg

SEQ ID NO: 6531 - DNA, 20 bp, Artificial Sequence
  sgRNA
  mm72630_Clec4b2
ctgctttagtgaaggaacta

SEQ ID NO: 6532 - DNA, 20 bp, Artificial Sequence
  sgRNA
  mm72631_Clec4b2
ctggtccctgagactctgga

SEQ ID NO: 6533 - DNA, 20 bp, Artificial Sequence
  sgRNA
  mm73048_Fndc5
gctcttcaagaccccacgcg

SEQ ID NO: 6534 - DNA, 20 bp, Artificial Sequence
  sgRNA
  mm73049_Fndc5
gatgctccggttcattcagg

SEQ ID NO: 6535 - DNA, 20 bp, Artificial Sequence
  sgRNA
  mm73050_Fndc5
caggacatcccagctgacca

SEQ ID NO: 6536 - DNA, 20 bp, Artificial Sequence
  sgRNA
  mm73051_Fndc5
gccggacggtcacgttcaca

SEQ ID NO: 6537 - DNA, 20 bp, Artificial Sequence
  sgRNA
  mm73304_Tas2r118
ttggaaggtatcagtcgtct

SEQ ID NO: 6538 - DNA, 20 bp, Artificial Sequence
  sgRNA
  mm73305_Tas2r118
tgttaaatatcacatccaga

SEQ ID NO: 6539 - DNA, 20 bp, Artificial Sequence
  sgRNA
  mm73306_Tas2r118
ctttcaaagactgtcaccgg

SEQ ID NO: 6540 - DNA, 20 bp, Artificial Sequence
  sgRNA
  mm73307_Tas2r118
aattgtgcaaagttgcacaa

SEQ ID NO: 6541 - DNA, 20 bp, Artificial Sequence
  sgRNA
  mm73472_Defb21
ggtaatatttgcatgatcca

SEQ ID NO: 6542 - DNA, 20 bp, Artificial Sequence
  sgRNA
  mm73473_Defb21
tctacctcccaagagccatg

SEQ ID NO: 6543 - DNA, 20 bp, Artificial Sequence
  sgRNA
  mm73474_Defb21
tggggtagaagagcaaggac

SEQ ID NO: 6544 - DNA, 20 bp, Artificial Sequence
  sgRNA
  mm73475_Defb21
cttctaccccaagtgacacc

SEQ ID NO: 6545 - DNA, 20 bp, Artificial Sequence
  sgRNA
  mm73820_Itprip
ataaacaagtggcaccgtag

SEQ ID NO: 6546 - DNA, 20 bp, Artificial Sequence
  sgRNA
  mm73821_Itprip
actgtatccggagcaccacg

SEQ ID NO: 6547 - DNA, 20 bp, Artificial Sequence
  sgRNA
  mm73822_Itprip
tcaaaatcaagttccgctcg

SEQ ID NO: 6548 - DNA, 20 bp, Artificial Sequence
  sgRNA
  mm73823_Itprip
gttgcgacagaaccatcagg

SEQ ID NO: 6549 - DNA, 20 bp, Artificial Sequence
  sgRNA
  mm73860_Gnptab
tgtttgcaatggacgcgtgg

SEQ ID NO: 6550 - DNA, 20 bp, Artificial Sequence
  sgRNA
  mm73861_Gnptab
tctgcccatgccaatcgacg

SEQ ID NO: 6551 - DNA, 20 bp, Artificial Sequence
  sgRNA
  mm73862_Gnptab
aggagtgaaatatttacccg

SEQ ID NO: 6552 - DNA, 20 bp, Artificial Sequence
  sgRNA
  mm73863_Gnptab
catgctggaccgtttaaggg

SEQ ID NO: 6553 - DNA, 20 bp, Artificial Sequence
  sgRNA
  mm73900_Dnaic2
acagccaaccaagttcatgg

SEQ ID NO: 6554 - DNA, 20 bp, Artificial Sequence
  sgRNA
  mm73901_Dnaic2
ggcgttaatcatgtcgaggg

SEQ ID NO: 6555 - DNA, 20 bp, Artificial Sequence
  sgRNA
  mm73902_Dnaic2
caacgccatcgacatctacg

SEQ ID NO: 6556 - DNA, 20 bp, Artificial Sequence
  sgRNA
  mm73903_Dnaic2
gaactacgactcctacatct

SEQ ID NO: 6557 - DNA, 20 bp, Artificial Sequence
  sgRNA
  mm74076_Defb45
taggttacctggaatgacct

SEQ ID NO: 6558 - DNA, 20 bp, Artificial Sequence
  sgRNA
  mm74077_Defb45
agacttccagcatctttcag

SEQ ID NO: 6559 - DNA, 20 bp, Artificial Sequence
  sgRNA
  mm74078_Defb45
gaagactgcggtgttaacta

SEQ ID NO: 6560 - DNA, 20 bp, Artificial Sequence
  sgRNA
  mm74079_Defb45
gaaagatgctggaagtcttt

SEQ ID NO: 6561 - DNA, 20 bp, Artificial Sequence
  sgRNA
  mm74188_Lrrc8b
cagtggcggaacagtcagtg

SEQ ID NO: 6562 - DNA, 20 bp, Artificial Sequence
  sgRNA
  mm74189_Lrrc8b
cgtgtaccattcgtccctgg

SEQ ID NO: 6563 - DNA, 20 bp, Artificial Sequence
  sgRNA
  mm74190_Lrrc8b
caagctcgtgaaaaactcgc

SEQ ID NO: 6564 - DNA, 20 bp, Artificial Sequence
  sgRNA
  mm74191_Lrrc8b
aggtcgttctggatccggag

SEQ ID NO: 6565 - DNA, 20 bp, Artificial Sequence
  sgRNA
  mm74625_Defb22
gcaacgagcaaatgtcccat

SEQ ID NO: 6566 - DNA, 20 bp, Artificial Sequence
  sgRNA
  mm74626_Defb22
ataatcttgtcacagcaggt

SEQ ID NO: 6567 - DNA, 20 bp, Artificial Sequence
  sgRNA
  mm74627_Defb22
ttcaaaattagtggtcactg

SEQ ID NO: 6568 - DNA, 20 bp, Artificial Sequence
  sgRNA
  mm74628_Defb22
aaaaagtgtgcaaacacatt

SEQ ID NO: 6569 - DNA, 20 bp, Artificial Sequence
  sgRNA
  mm74793_Iqgap2
cacaagttaacactgcgttg

SEQ ID NO: 6570 - DNA, 20 bp, Artificial Sequence
  sgRNA
  mm74794_Iqgap2
ggtcacatcagattacatcc

SEQ ID NO: 6571 - DNA, 20 bp, Artificial Sequence
  sgRNA
  mm74795_Iqgap2
aaacaacagatgtctacgat

SEQ ID NO: 6572 - DNA, 20 bp, Artificial Sequence
  sgRNA
  mm74796_Iqgap2
agaaacagaacacatcggtg

SEQ ID NO: 6573 - DNA, 20 bp, Artificial Sequence
  sgRNA
  mm74857_Gal3st3
tagacgccgcagcagcacga

SEQ ID NO: 6574 - DNA, 20 bp, Artificial Sequence
  sgRNA
  mm74858_Gal3st3
attgtcgcctccaaggtcgt

SEQ ID NO: 6575 - DNA, 20 bp, Artificial Sequence
  sgRNA
  mm74859_Gal3st3
gctgaaaagcgactcgaaca

SEQ ID NO: 6576 - DNA, 20 bp, Artificial Sequence
  sgRNA
  mm74860_Gal3st3
ccacaggaaaattctgctgt

SEQ ID NO: 6577 - DNA, 20 bp, Artificial Sequence
  sgRNA
  mm74909_Defb28
agagcttattgtgtcccgag

SEQ ID NO: 6578 - DNA, 20 bp, Artificial Sequence
  sgRNA
  mm74910_Defb28
tttccccaagccataaaagc

SEQ ID NO: 6579 - DNA, 20 bp, Artificial Sequence
  sgRNA
  mm74911_Defb28
gaaatgcaggcgcatatgca

SEQ ID NO: 6580 - DNA, 20 bp, Artificial Sequence
  sgRNA
  mm74912_Defb28
ccacaaggacagctaaggtc

SEQ ID NO: 6581 - DNA, 20 bp, Artificial Sequence
  sgRNA
  mm75020_Pilrb2
aattcagcaagatcaaacgg

SEQ ID NO: 6582 - DNA, 20 bp, Artificial Sequence
  sgRNA
  mm75021_Pilrb2
cttcccctggaagttagcca

SEQ ID NO: 6583 - DNA, 20 bp, Artificial Sequence
  sgRNA
  mm75022_Pilrb2
ctcatgtatgaaaggcatgg

SEQ ID NO: 6584 - DNA, 20 bp, Artificial Sequence
  sgRNA
  mm75023_Pilrb2
ccttaaagttcaggattctg

SEQ ID NO: 6585 - DNA, 20 bp, Artificial Sequence
  sgRNA
  mm75028_Cyp2w1
ctggtcaatgagactcagca

SEQ ID NO: 6586 - DNA, 20 bp, Artificial Sequence
  sgRNA
  mm75029_Cyp2w1
agcttctacataactctgcg

SEQ ID NO: 6587 - DNA, 20 bp, Artificial Sequence
  sgRNA
  mm75030_Cyp2w1
cccagatggattgtgaacat

SEQ ID NO: 6588 - DNA, 20 bp, Artificial Sequence
  sgRNA
  mm75031_Cyp2w1
tgtgcaacagccatccatgg

SEQ ID NO: 6589 - DNA, 20 bp, Artificial Sequence
  sgRNA
  mm76081_Defb23
atgtcctcatccggtatgtg

SEQ ID NO: 6590 - DNA, 20 bp, Artificial Sequence
  sgRNA
  mm76082_Defb23
accgtgaaaagatgcttagt

SEQ ID NO: 6591 - DNA, 20 bp, Artificial Sequence
  sgRNA
  mm76083_Defb23
aacgaaaaagaattccacag

SEQ ID NO: 6592 - DNA, 20 bp, Artificial Sequence
  sgRNA
  mm76084_Defb23
ctgagactgaagcatgagac

SEQ ID NO: 6593 - DNA, 20 bp, Artificial Sequence
  sgRNA
  mm76137_Cd101
gagatgggtgtgttgcacgg

SEQ ID NO: 6594 - DNA, 20 bp, Artificial Sequence
  sgRNA
  mm76138_Cd101
agaccaccggaaatcctgcg

SEQ ID NO: 6595 - DNA, 20 bp, Artificial Sequence
  sgRNA
  mm76139_Cd101
tgccgagcagcgtactgtgt

SEQ ID NO: 6596 - DNA, 20 bp, Artificial Sequence
  sgRNA
  mm76140_Cd101
ggtgtatcggtgtacagtgg

SEQ ID NO: 6597 - DNA, 20 bp, Artificial Sequence
  sgRNA
  mm76373_Defb26
cagagtccgatgtcaagaag

SEQ ID NO: 6598 - DNA, 20 bp, Artificial Sequence
  sgRNA
  mm76374_Defb26
ttgctaactcaggggaacaa

SEQ ID NO: 6599 - DNA, 20 bp, Artificial Sequence
  sgRNA
  mm76375_Defb26
cgggtcgctgatgaattcac

SEQ ID NO: 6600 - DNA, 20 bp, Artificial Sequence
  sgRNA
  mm76376_Defb26
actcttgttacagtgtgtat

SEQ ID NO: 6601 - DNA, 20 bp, Artificial Sequence
  sgRNA
  mm76377_Defb43
cagaggaactatggataaca

SEQ ID NO: 6602 - DNA, 20 bp, Artificial Sequence
  sgRNA
  mm76378_Defb43
ttgaacagtcctgattctca

SEQ ID NO: 6603 - DNA, 20 bp, Artificial Sequence
  sgRNA
  mm76379_Defb43
ttgttatccatagttcctct

SEQ ID NO: 6604 - DNA, 20 bp, Artificial Sequence
  sgRNA
  mm76380_Defb43
caaggtgaggacccccagga

SEQ ID NO: 6605 - DNA, 20 bp, Artificial Sequence
  sgRNA
  mm76381_Defb25
aaagtggattctgctcattg

SEQ ID NO: 6606 - DNA, 20 bp, Artificial Sequence
  sgRNA
  mm76382_Defb25
tacctggtggtacatgactc

SEQ ID NO: 6607 - DNA, 20 bp, Artificial Sequence
  sgRNA
  mm76383_Defb25
cacacacaagggttacctgg

SEQ ID NO: 6608 - DNA, 20 bp, Artificial Sequence
  sgRNA
  mm76384_Defb25
atccggacacaggtgcatga

SEQ ID NO: 6609 - DNA, 20 bp, Artificial Sequence
  sgRNA
  mm76401_Tctn1
cccacagcccactaaatacg

SEQ ID NO: 6610 - DNA, 20 bp, Artificial Sequence
  sgRNA
  mm76402_Tctn1
gtacccaccgtccgtgaccg

SEQ ID NO: 6611 - DNA, 20 bp, Artificial Sequence
  sgRNA
  mm76403_Tctn1
atgagtttaaagtcacggtg

SEQ ID NO: 6612 - DNA, 20 bp, Artificial Sequence
  sgRNA
  mm76404_Tctn1
gagaccgatacattacagac

SEQ ID NO: 6613 - DNA, 20 bp, Artificial Sequence
  sgRNA
  mm77059_Fcrl6
gctgtaaagttggattcttg

SEQ ID NO: 6614 - DNA, 20 bp, Artificial Sequence
  sgRNA
  mm77060_Fcrl6
gaatgagtaaaagattggaa

SEQ ID NO: 6615 - DNA, 20 bp, Artificial Sequence
  sgRNA
  mm77061_Fcrl6
agaaatcctagggaaacccc

SEQ ID NO: 6616 - DNA, 20 bp, Artificial Sequence
  sgRNA
  mm77062_Fcrl6
acaaccatgtcattcaagac

SEQ ID NO: 6617 - DNA, 20 bp, Artificial Sequence
  sgRNA
  mm77174_Btnl1
cagctcgcatgcacatccga

SEQ ID NO: 6618 - DNA, 20 bp, Artificial Sequence
  sgRNA
  mm77175_Btnl1
gtgcagatgccggaatacag

SEQ ID NO: 6619 - DNA, 20 bp, Artificial Sequence
  sgRNA
  mm77176_Btnl1
agaaaaccaagacacttctg

SEQ ID NO: 6620 - DNA, 20 bp, Artificial Sequence
  sgRNA
  mm77177_Btnl1
aggggcagagcctaaacctg

SEQ ID NO: 6621 - DNA, 20 bp, Artificial Sequence
  sgRNA
  mm77704_Ccl21b
gcttccggggtaagaacctg

SEQ ID NO: 6622 - DNA, 20 bp, Artificial Sequence
  sgRNA
  mm77705_Ccl21b
gagccaggaccaggctaagg

SEQ ID NO: 6623 - DNA, 20 bp, Artificial Sequence
  sgRNA
  mm77706_Ccl21b
attccctacagtattgtccg

SEQ ID NO: 6624 - DNA, 20 bp, Artificial Sequence
  sgRNA
  mm77707_Ccl21b
ctctgcatcccctggaccca

SEQ ID NO: 6625 - DNA, 20 bp, Artificial Sequence
  sgRNA
  mm77945_Tigit
cctatcatacgtatcctggt

SEQ ID NO: 6626 - DNA, 20 bp, Artificial Sequence
  sgRNA
  mm77946_Tigit
caggcacgatagatacaaag

SEQ ID NO: 6627 - DNA, 20 bp, Artificial Sequence
  sgRNA
  mm77947_Tigit
tctctgacaatgaatgacac

SEQ ID NO: 6628 - DNA, 20 bp, Artificial Sequence
  sgRNA
  mm77948_Tigit
ccatttatagtgttgacctg

SEQ ID NO: 6629 - DNA, 20 bp, Artificial Sequence
  sgRNA
  BRDN0000737505
aaaaagtccgcgattacgtc

SEQ ID NO: 6630 - DNA, 20 bp, Artificial Sequence
  sgRNA
  BRDN0000737693
aaaacggctcgatcggtgat

SEQ ID NO: 6631 - DNA, 20 bp, Artificial Sequence
  sgRNA
  BRDN0000737637
aaaacgtaattataccgagc

SEQ ID NO: 6632 - DNA, 20 bp, Artificial Sequence
  sgRNA
  BRDN0000738185
aaaattgcaccttcccggcc

SEQ ID NO: 6633 - DNA, 20 bp, Artificial Sequence
  sgRNA
  BRDN0000737801
aaacccccgcgcggagcgtc

SEQ ID NO: 6634 - DNA, 20 bp, Artificial Sequence
  sgRNA
  BRDN0000737467
aaacctagcgtagattcggc

SEQ ID NO: 6635 - DNA, 20 bp, Artificial Sequence
  sgRNA
  BRDN0000737848
aaacgaggctgttcgtacac

SEQ ID NO: 6636 - DNA, 20 bp, Artificial Sequence
  sgRNA
  BRDN0000737609
aaactcatacgtagcgaatc

SEQ ID NO: 6637 - DNA, 20 bp, Artificial Sequence
  sgRNA
  BRDN0000737434
aaactcccgtgtcaaccgat

SEQ ID NO: 6638 - DNA, 20 bp, Artificial Sequence
  sgRNA
  BRDN0000738254
aaagacgtgcattcagcgag

SEQ ID NO: 6639 - DNA, 20 bp, Artificial Sequence
  sgRNA
  BRDN0000737777
aacatgttaagtcgcgttat

SEQ ID NO: 6640 - DNA, 20 bp, Artificial Sequence
  sgRNA
  BRDN0000737611
aaccagcatttgaccgcgct

SEQ ID NO: 6641 - DNA, 20 bp, Artificial Sequence
  sgRNA
  BRDN0000737528
aaccccggctgtcatcgccg

SEQ ID NO: 6642 - DNA, 20 bp, Artificial Sequence
  sgRNA
  BRDN0000738228
aacccgccggaacaatcagc

SEQ ID NO: 6643 - DNA, 20 bp, Artificial Sequence
  sgRNA
  BRDN0000737727
aaccggctgcgcgtttgcaa

SEQ ID NO: 6644 - DNA, 20 bp, Artificial Sequence
  sgRNA
  BRDN0000737483
aaccgtactgcgaggagcat

SEQ ID NO: 6645 - DNA, 20 bp, Artificial Sequence
  sgRNA
  BRDN0000737872
aacctcgtctcatgtacgaa

SEQ ID NO: 6646 - DNA, 20 bp, Artificial Sequence
  sgRNA
  BRDN0000737516
aacgccccggatttcgttga

SEQ ID NO: 6647 - DNA, 20 bp, Artificial Sequence
  sgRNA
  BRDN0000737844
aacggctgcgcccgcggcaa

SEQ ID NO: 6648 - DNA, 20 bp, Artificial Sequence
  sgRNA
  BRDN0000737412
aacgggcgcaataccctttt

SEQ ID NO: 6649 - DNA, 20 bp, Artificial Sequence
  sgRNA
  BRDN0000737631
aacggtagcgtacccgtgaa

SEQ ID NO: 6650 - DNA, 20 bp, Artificial Sequence
  sgRNA
  BRDN0000737750
aacggtcaaatccgtgaggg

SEQ ID NO: 6651 - DNA, 20 bp, Artificial Sequence
  sgRNA
  BRDN0000737875
aacgtcaccaacctcgatcc

SEQ ID NO: 6652 - DNA, 20 bp, Artificial Sequence
  sgRNA
  BRDN0000738229
aacgttatagcttcgtctct

SEQ ID NO: 6653 - DNA, 20 bp, Artificial Sequence
  sgRNA
  BRDN0000737806
aactaactcactacgcacga

SEQ ID NO: 6654 - DNA, 20 bp, Artificial Sequence
  sgRNA
  BRDN0000738366
aactcctcatcgtacgctaa

SEQ ID NO: 6655 - DNA, 20 bp, Artificial Sequence
  sgRNA
  BRDN0000737593
aactcgcgtgggaagtccgg

SEQ ID NO: 6656 - DNA, 20 bp, Artificial Sequence
  sgRNA
  BRDN0000738128
aacttatacgtaatctgatc

SEQ ID NO: 6657 - DNA, 20 bp, Artificial Sequence
  sgRNA
  BRDN0000738307
aagactcctacgtatcgagc

SEQ ID NO: 6658 - DNA, 20 bp, Artificial Sequence
  sgRNA
  BRDN0000737391
aagcacaagaacggtccgcc

SEQ ID NO: 6659 - DNA, 20 bp, Artificial Sequence
  sgRNA
  BRDN0000737912
aagcagcgactactcgacgc

SEQ ID NO: 6660 - DNA, 20 bp, Artificial Sequence
  sgRNA
  BRDN0000738101
aagcctaacggagctcgcgg

SEQ ID NO: 6661 - DNA, 20 bp, Artificial Sequence
  sgRNA
  BRDN0000738296
aagcctacttcaccggtcgg

SEQ ID NO: 6662 - DNA, 20 bp, Artificial Sequence
  sgRNA
  BRDN0000738095
aagcgagccgcagaccgttt

SEQ ID NO: 6663 - DNA, 20 bp, Artificial Sequence
  sgRNA
  BRDN0000737714
aagcgtaccccactcgttaa

SEQ ID NO: 6664 - DNA, 20 bp, Artificial Sequence
  sgRNA
  BRDN0000738016
aagcgtgagattcaccgccg

SEQ ID NO: 6665 - DNA, 20 bp, Artificial Sequence
  sgRNA
  BRDN0000737416
aaggccttaacacgtcgacc

SEQ ID NO: 6666 - DNA, 20 bp, Artificial Sequence
  sgRNA
  BRDN0000737993
aaggcgtaaacgagtacacg

SEQ ID NO: 6667 - DNA, 20 bp, Artificial Sequence
  sgRNA
  BRDN0000738351
aagggtaagtacagtatcgt

SEQ ID NO: 6668 - DNA, 20 bp, Artificial Sequence
  sgRNA
  BRDN0000738301
aagtccccttcgggaactcc

SEQ ID NO: 6669 - DNA, 20 bp, Artificial Sequence
  sgRNA
  BRDN0000737395
aagtctatgcggggctcgta

SEQ ID NO: 6670 - DNA, 20 bp, Artificial Sequence
  sgRNA
  BRDN0000737589
aataagcctacccggcgaga

SEQ ID NO: 6671 - DNA, 20 bp, Artificial Sequence
  sgRNA
  BRDN0000738249
aataccgtaccgactcagtg

SEQ ID NO: 6672 - DNA, 20 bp, Artificial Sequence
  sgRNA
  BRDN0000737888
aataggaactccgcacccga

SEQ ID NO: 6673 - DNA, 20 bp, Artificial Sequence
  sgRNA
  BRDN0000738271
aatcaaccgtgatagtctcg

SEQ ID NO: 6674 - DNA, 20 bp, Artificial Sequence
  sgRNA
  BRDN0000737634
aatcaccgacaacgtaagac

SEQ ID NO: 6675 - DNA, 20 bp, Artificial Sequence
  sgRNA
  BRDN0000737454
aatgaagcaccgattgcgga

SEQ ID NO: 6676 - DNA, 20 bp, Artificial Sequence
  sgRNA
  BRDN0000737646
aatgagcgtctctcgatcgc

SEQ ID NO: 6677 - DNA, 20 bp, Artificial Sequence
  sgRNA
  BRDN0000737994
aatgagcttcgagttcgtct

SEQ ID NO: 6678 - DNA, 20 bp, Artificial Sequence
  sgRNA
  BRDN0000738027
aatgctgcgtacgataaccg

SEQ ID NO: 6679 - DNA, 20 bp, Artificial Sequence
  sgRNA
  BRDN0000738315
aattctgagattccgcggct

SEQ ID NO: 6680 - DNA, 20 bp, Artificial Sequence
  sgRNA
  BRDN0000737773
aattgtctgatcgcgccata

SEQ ID NO: 6681 - DNA, 20 bp, Artificial Sequence
  sgRNA
  BRDN0000737873
aattttttcggaatctagcg

SEQ ID NO: 6682 - DNA, 20 bp, Artificial Sequence
  sgRNA
  BRDN0000738210
acaacaattactggccgcga

SEQ ID NO: 6683 - DNA, 20 bp, Artificial Sequence
  sgRNA
  BRDN0000737517
acaacacgccgacacgtcta

SEQ ID NO: 6684 - DNA, 20 bp, Artificial Sequence
  sgRNA
  BRDN0000737828
acaattcggtttatgcgcgt

SEQ ID NO: 6685 - DNA, 20 bp, Artificial Sequence
  sgRNA
  BRDN0000738158
acacaaactggtcgtagatg

SEQ ID NO: 6686 - DNA, 20 bp, Artificial Sequence
  sgRNA
  BRDN0000737857
acacccgtgtatgcaccggg

SEQ ID NO: 6687 - DNA, 20 bp, Artificial Sequence
  sgRNA
  BRDN0000737608
acacgaccgaccggtggaat

SEQ ID NO: 6688 - DNA, 20 bp, Artificial Sequence
  sgRNA
  BRDN0000737566
acacgtcttcggctatacgc

SEQ ID NO: 6689 - DNA, 20 bp, Artificial Sequence
  sgRNA
  BRDN0000737823
acagaccgaataaccgacga

SEQ ID NO: 6690 - DNA, 20 bp, Artificial Sequence
  sgRNA
  BRDN0000738188
acagagtcgtgtgccgaacg

SEQ ID NO: 6691 - DNA, 20 bp, Artificial Sequence
  sgRNA
  BRDN0000737471
acagcaggggccgcgaataa

SEQ ID NO: 6692 - DNA, 20 bp, Artificial Sequence
  sgRNA
  BRDN0000737464
acagcggcctaatacttcgc

SEQ ID NO: 6693 - DNA, 20 bp, Artificial Sequence
  sgRNA
  BRDN0000737400
accaacgctacgatcccgga

SEQ ID NO: 6694 - DNA, 20 bp, Artificial Sequence
  sgRNA
  BRDN0000738102
accaataacgggtacaagtc

SEQ ID NO: 6695 - DNA, 20 bp, Artificial Sequence
  sgRNA
  BRDN0000738242
accaccgtgccggggacgcg

SEQ ID NO: 6696 - DNA, 20 bp, Artificial Sequence
  sgRNA
  BRDN0000737537
accaggactgccgcgtgagg

SEQ ID NO: 6697 - DNA, 20 bp, Artificial Sequence
  sgRNA
  BRDN0000737842
accaggcgcggaccgcacat

SEQ ID NO: 6698 - DNA, 20 bp, Artificial Sequence
  sgRNA
  BRDN0000737640
accatacggggtcttgtcga

SEQ ID NO: 6699 - DNA, 20 bp, Artificial Sequence
  sgRNA
  BRDN0000738161
accatagtttcaacctgcgg

SEQ ID NO: 6700 - DNA, 20 bp, Artificial Sequence
  sgRNA
  BRDN0000738072
accatccgatattacgagca

SEQ ID NO: 6701 - DNA, 20 bp, Artificial Sequence
  sgRNA
  BRDN0000737717
accatgatgtcaccgccgca

SEQ ID NO: 6702 - DNA, 20 bp, Artificial Sequence
  sgRNA
  BRDN0000738377
acccacgtatgtactcggga

SEQ ID NO: 6703 - DNA, 20 bp, Artificial Sequence
  sgRNA
  BRDN0000738349
acccagattcgcattcggat

SEQ ID NO: 6704 - DNA, 20 bp, Artificial Sequence
  sgRNA
  BRDN0000737629
acccatccccgcgtccgaga

SEQ ID NO: 6705 - DNA, 20 bp, Artificial Sequence
  sgRNA
  BRDN0000737387
acccatcgggtgcgatatgg

SEQ ID NO: 6706 - DNA, 20 bp, Artificial Sequence
  sgRNA
  BRDN0000737767
acccgcatatgccgcctaag

SEQ ID NO: 6707 - DNA, 20 bp, Artificial Sequence
  sgRNA
  BRDN0000737574
accctagcctcatcgcgacc

SEQ ID NO: 6708 - DNA, 20 bp, Artificial Sequence
  sgRNA
  BRDN0000738174
accgcacgttctcgcagaga

SEQ ID NO: 6709 - DNA, 20 bp, Artificial Sequence
  sgRNA
  BRDN0000738035
accgcgcatcattgacggtg

SEQ ID NO: 6710 - DNA, 20 bp, Artificial Sequence
  sgRNA
  BRDN0000737552
accggactgcgatatgccgt

SEQ ID NO: 6711 - DNA, 20 bp, Artificial Sequence
  sgRNA
  BRDN0000737561
accggatgtgggcgcctctc

SEQ ID NO: 6712 - DNA, 20 bp, Artificial Sequence
  sgRNA
  BRDN0000737545
accggtcgaagtctgggatt

SEQ ID NO: 6713 - DNA, 20 bp, Artificial Sequence
  sgRNA
  BRDN0000737786
accggttcagccgccggaac

SEQ ID NO: 6714 - DNA, 20 bp, Artificial Sequence
  sgRNA
  BRDN0000738288
accgtacaagactcgctcca

SEQ ID NO: 6715 - DNA, 20 bp, Artificial Sequence
  sgRNA
  BRDN0000737804
accgtctctattatacggca

SEQ ID NO: 6716 - DNA, 20 bp, Artificial Sequence
  sgRNA
  BRDN0000738362
accgtctgatgttcccggct

SEQ ID NO: 6717 - DNA, 20 bp, Artificial Sequence
  sgRNA
  BRDN0000737869
accgttgtttccgtcgaaac

SEQ ID NO: 6718 - DNA, 20 bp, Artificial Sequence
  sgRNA
  BRDN0000737881
acctcgtgcaaatcggtggc

SEQ ID NO: 6719 - DNA, 20 bp, Artificial Sequence
  sgRNA
  BRDN0000738216
accttgtgttcgacggtagg

SEQ ID NO: 6720 - DNA, 20 bp, Artificial Sequence
  sgRNA
  BRDN0000738135
acgacgagagatacttaggc

SEQ ID NO: 6721 - DNA, 20 bp, Artificial Sequence
  sgRNA
  BRDN0000737964
acgacgtccgctgtgtgtat

SEQ ID NO: 6722 - DNA, 20 bp, Artificial Sequence
  sgRNA
  BRDN0000738118
acgaggagaagtcgagtatt

SEQ ID NO: 6723 - DNA, 20 bp, Artificial Sequence
  sgRNA
  BRDN0000738086
acgcaagcggaacgcgtcta

SEQ ID NO: 6724 - DNA, 20 bp, Artificial Sequence
  sgRNA
  BRDN0000738048
acgcacccatacaggcgctt

SEQ ID NO: 6725 - DNA, 20 bp, Artificial Sequence
  sgRNA
  BRDN0000737488
acgcgaagtgtcgcagagtg

SEQ ID NO: 6726 - DNA, 20 bp, Artificial Sequence
  sgRNA
  BRDN0000737521
acgctatagtgtacgtctaa

SEQ ID NO: 6727 - DNA, 20 bp, Artificial Sequence
  sgRNA
  BRDN0000738184
acgctcttggcagataatcg

SEQ ID NO: 6728 - DNA, 20 bp, Artificial Sequence
  sgRNA
  BRDN0000737748
acgctgttcgtaaccgcggg

SEQ ID NO: 6729 - DNA, 20 bp, Artificial Sequence
  sgRNA
  BRDN0000737641
acggaacccgatcggaacgg

SEQ ID NO: 6730 - DNA, 20 bp, Artificial Sequence
  sgRNA
  BRDN0000737818
acggattgctgacgctatca

SEQ ID NO: 6731 - DNA, 20 bp, Artificial Sequence
  sgRNA
  BRDN0000738217
acgggtcaacttcttgccgc

SEQ ID NO: 6732 - DNA, 20 bp, Artificial Sequence
  sgRNA
  BRDN0000737441
acggtcccaacgagcgccgg

SEQ ID NO: 6733 - DNA, 20 bp, Artificial Sequence
  sgRNA
  BRDN0000737473
acggtccctctcgggtcaat

SEQ ID NO: 6734 - DNA, 20 bp, Artificial Sequence
  sgRNA
  BRDN0000737845
acggtcgagcacggttatga

SEQ ID NO: 6735 - DNA, 20 bp, Artificial Sequence
  sgRNA
  BRDN0000737878
acgtcgatgcttatccgtct

SEQ ID NO: 6736 - DNA, 20 bp, Artificial Sequence
  sgRNA
  BRDN0000737612
acgtcggtctagagttaagt

SEQ ID NO: 6737 - DNA, 20 bp, Artificial Sequence
  sgRNA
  BRDN0000737383
acgtgtaaggcgaacgcctt

SEQ ID NO: 6738 - DNA, 20 bp, Artificial Sequence
  sgRNA
  BRDN0000737995
acgtgttctcgtacttagct

SEQ ID NO: 6739 - DNA, 20 bp, Artificial Sequence
  sgRNA
  BRDN0000738032
acgttgcagctcgcgtttcg

SEQ ID NO: 6740 - DNA, 20 bp, Artificial Sequence
  sgRNA
  BRDN0000738335
actaaggagtcccggtccga

SEQ ID NO: 6741 - DNA, 20 bp, Artificial Sequence
  sgRNA
  BRDN0000737743
actagctccataacgtgtac

SEQ ID NO: 6742 - DNA, 20 bp, Artificial Sequence
  sgRNA
  BRDN0000737856
actcacctcgcacgatcgta

SEQ ID NO: 6743 - DNA, 20 bp, Artificial Sequence
  sgRNA
  BRDN0000737548
actcgacctaacgtcgatgt

SEQ ID NO: 6744 - DNA, 20 bp, Artificial Sequence
  sgRNA
  BRDN0000737825
actcgcgaaaccgtacatga

SEQ ID NO: 6745 - DNA, 20 bp, Artificial Sequence
  sgRNA
  BRDN0000737651
actgcgcgtataggacgcaa

SEQ ID NO: 6746 - DNA, 20 bp, Artificial Sequence
  sgRNA
  BRDN0000737753
actgtcccattgtacgacgg

SEQ ID NO: 6747 - DNA, 20 bp, Artificial Sequence
  sgRNA
  BRDN0000737901
acttcccgcggttccgttga

SEQ ID NO: 6748 - DNA, 20 bp, Artificial Sequence
  sgRNA
  BRDN0000737757
acttgtatacgacggctaga

SEQ ID NO: 6749 - DNA, 20 bp, Artificial Sequence
  sgRNA
  BRDN0000737705
actttacatcatgtcgtcgt

SEQ ID NO: 6750 - DNA, 20 bp, Artificial Sequence
  sgRNA
  BRDN0000737402
agaaaggcacgtgcgacgtc

SEQ ID NO: 6751 - DNA, 20 bp, Artificial Sequence
  sgRNA
  BRDN0000738130
agaaatccagtcccgcctaa

SEQ ID NO: 6752 - DNA, 20 bp, Artificial Sequence
  sgRNA
  BRDN0000738092
agacctcgttagccgtagct

SEQ ID NO: 6753 - DNA, 20 bp, Artificial Sequence
  sgRNA
  BRDN0000737749
agacgttgatttaccggcca

SEQ ID NO: 6754 - DNA, 20 bp, Artificial Sequence
  sgRNA
  BRDN0000738338
agactcgtgtgccacgagga

SEQ ID NO: 6755 - DNA, 20 bp, Artificial Sequence
  sgRNA
  BRDN0000738090
agaggcggagcaatactcgc

SEQ ID NO: 6756 - DNA, 20 bp, Artificial Sequence
  sgRNA
  BRDN0000738041
agatagcgcaatcccgcatg

SEQ ID NO: 6757 - DNA, 20 bp, Artificial Sequence
  sgRNA
  BRDN0000737827
agattctcgcgtaaccagag

SEQ ID NO: 6758 - DNA, 20 bp, Artificial Sequence
  sgRNA
  BRDN0000737915
agcacgcgcacaagagccgc

SEQ ID NO: 6759 - DNA, 20 bp, Artificial Sequence
  sgRNA
  BRDN0000737423
agcactaggatcgcggcctt

SEQ ID NO: 6760 - DNA, 20 bp, Artificial Sequence
  sgRNA
  BRDN0000737591
agcagttcgggtaacgccca

SEQ ID NO: 6761 - DNA, 20 bp, Artificial Sequence
  sgRNA
  BRDN0000737759
agcatggagtcaacgtccgc

SEQ ID NO: 6762 - DNA, 20 bp, Artificial Sequence
  sgRNA
  BRDN0000737607
agccgcgccgcaaagctttt

SEQ ID NO: 6763 - DNA, 20 bp, Artificial Sequence
  sgRNA
  BRDN0000737472
agccgggctttccgtcaagc

SEQ ID NO: 6764 - DNA, 20 bp, Artificial Sequence
  sgRNA
  BRDN0000737493
agcctagtcgcgctaatatt

SEQ ID NO: 6765 - DNA, 20 bp, Artificial Sequence
  sgRNA
  BRDN0000737874
agcgagtgtccgtgacgttc

SEQ ID NO: 6766 - DNA, 20 bp, Artificial Sequence
  sgRNA
  BRDN0000738164
agcgatgttcacgcacagcg

SEQ ID NO: 6767 - DNA, 20 bp, Artificial Sequence
  sgRNA
  BRDN0000738344
agcgccataggacgccaaac

SEQ ID NO: 6768 - DNA, 20 bp, Artificial Sequence
  sgRNA
  BRDN0000737585
agcgcgtaaggcgtagttac

SEQ ID NO: 6769 - DNA, 20 bp, Artificial Sequence
  sgRNA
  BRDN0000738152
agcgtatcttatgtaccgct

SEQ ID NO: 6770 - DNA, 20 bp, Artificial Sequence
  sgRNA
  BRDN0000738208
agcgtccacgcgtctatgga

SEQ ID NO: 6771 - DNA, 20 bp, Artificial Sequence
  sgRNA
  BRDN0000738224
agcgtgtcgagaacggcttg

SEQ ID NO: 6772 - DNA, 20 bp, Artificial Sequence
  sgRNA
  BRDN0000738300
agcgttcgcagctggtcaac

SEQ ID NO: 6773 - DNA, 20 bp, Artificial Sequence
  sgRNA
  BRDN0000737831
agctatccccacgttcgcgg

SEQ ID NO: 6774 - DNA, 20 bp, Artificial Sequence
  sgRNA
  BRDN0000737448
agcttagatcgtgcgtcgta

SEQ ID NO: 6775 - DNA, 20 bp, Artificial Sequence
  sgRNA
  BRDN0000738143
aggactatccgcgggattag

SEQ ID NO: 6776 - DNA, 20 bp, Artificial Sequence
  sgRNA
  BRDN0000737765
aggcagcccgcgttagagat

SEQ ID NO: 6777 - DNA, 20 bp, Artificial Sequence
  sgRNA
  BRDN0000738049
aggccccgagacgcgccaca

SEQ ID NO: 6778 - DNA, 20 bp, Artificial Sequence
  sgRNA
  BRDN0000738181
agggcaatcgcgtgcccaac

SEQ ID NO: 6779 - DNA, 20 bp, Artificial Sequence
  sgRNA
  BRDN0000737830
agggttaggctgacccgcga

SEQ ID NO: 6780 - DNA, 20 bp, Artificial Sequence
  sgRNA
  BRDN0000737891
aggtccgctggcgcaatggg

SEQ ID NO: 6781 - DNA, 20 bp, Artificial Sequence
  sgRNA
  BRDN0000738193
aggtcgtggacccgcatgta

SEQ ID NO: 6782 - DNA, 20 bp, Artificial Sequence
  sgRNA
  BRDN0000737504
aggtgcgtgtcaaccggtag

SEQ ID NO: 6783 - DNA, 20 bp, Artificial Sequence
  sgRNA
  BRDN0000737905
agtacactacatcgacttcg

SEQ ID NO: 6784 - DNA, 20 bp, Artificial Sequence
  sgRNA
  BRDN0000738245
agtacagccgacgagtgcga

SEQ ID NO: 6785 - DNA, 20 bp, Artificial Sequence
  sgRNA
  BRDN0000737695
agtagacgctatgttcgcgc

SEQ ID NO: 6786 - DNA, 20 bp, Artificial Sequence
  sgRNA
  BRDN0000738196
agtagagtcgcgaacgctac

SEQ ID NO: 6787 - DNA, 20 bp, Artificial Sequence
  sgRNA
  BRDN0000738153
agtcactaggcgctctcgcg

SEQ ID NO: 6788 - DNA, 20 bp, Artificial Sequence
  sgRNA
  BRDN0000738030
agtcagctccggggtatacg

SEQ ID NO: 6789 - DNA, 20 bp, Artificial Sequence
  sgRNA
  BRDN0000737530
agtcatcctctatgcgcgta

SEQ ID NO: 6790 - DNA, 20 bp, Artificial Sequence
  sgRNA
  BRDN0000738256
agtcccacgtttgccgtcaa

SEQ ID NO: 6791 - DNA, 20 bp, Artificial Sequence
  sgRNA
  BRDN0000738047
agtccggtcgaaatctgtat

SEQ ID NO: 6792 - DNA, 20 bp, Artificial Sequence
  sgRNA
  BRDN0000738083
agtgccgggggtgtataccg

SEQ ID NO: 6793 - DNA, 20 bp, Artificial Sequence
  sgRNA
  BRDN0000737942
agtgtcacggcaaagtcgag

SEQ ID NO: 6794 - DNA, 20 bp, Artificial Sequence
  sgRNA
  BRDN0000738046
agttaagcgcgtatctacgt

SEQ ID NO: 6795 - DNA, 20 bp, Artificial Sequence
  sgRNA
  BRDN0000738113
agttaagctccaatcgtctg

SEQ ID NO: 6796 - DNA, 20 bp, Artificial Sequence
  sgRNA
  BRDN0000737741
agtttacgtggtccgatgtc

SEQ ID NO: 6797 - DNA, 20 bp, Artificial Sequence
  sgRNA
  BRDN0000737614
ataaagtcccaggtgcgcgc

SEQ ID NO: 6798 - DNA, 20 bp, Artificial Sequence
  sgRNA
  BRDN0000738236
ataacttactcgttacgact

SEQ ID NO: 6799 - DNA, 20 bp, Artificial Sequence
  sgRNA
  BRDN0000738376
ataacttatgcgcttcgggg

SEQ ID NO: 6800 - DNA, 20 bp, Artificial Sequence
  sgRNA
  BRDN0000738163
ataatgcgcgcgaatactta

SEQ ID NO: 6801 - DNA, 20 bp, Artificial Sequence
  sgRNA
  BRDN0000738058
atacctccgctacaccgtct

SEQ ID NO: 6802 - DNA, 20 bp, Artificial Sequence
  sgRNA
  BRDN0000738292
atacgcatagatcggtaagc

SEQ ID NO: 6803 - DNA, 20 bp, Artificial Sequence
  sgRNA
  BRDN0000737899
atacgcgtgatgaccttatg

SEQ ID NO: 6804 - DNA, 20 bp, Artificial Sequence
  sgRNA
  BRDN0000737397
atagatgtctacgcgccgtt

SEQ ID NO: 6805 - DNA, 20 bp, Artificial Sequence
  sgRNA
  BRDN0000738232
atagcccggtttgcccgtct

SEQ ID NO: 6806 - DNA, 20 bp, Artificial Sequence
  sgRNA
  BRDN0000737826
ataggcgcacgggctactcc

SEQ ID NO: 6807 - DNA, 20 bp, Artificial Sequence
  sgRNA
  BRDN0000738260
atatcgaatgatgtccgcat

SEQ ID NO: 6808 - DNA, 20 bp, Artificial Sequence
  sgRNA
  BRDN0000737736
atatgagcccgacctctcga

SEQ ID NO: 6809 - DNA, 20 bp, Artificial Sequence
  sgRNA
  BRDN0000737871
atatgctcgacccatcgtcc

SEQ ID NO: 6810 - DNA, 20 bp, Artificial Sequence
  sgRNA
  BRDN0000737619
atattgtcccatacgatcgg

SEQ ID NO: 6811 - DNA, 20 bp, Artificial Sequence
  sgRNA
  BRDN0000737866
atcacacgttaaacggggcg

SEQ ID NO: 6812 - DNA, 20 bp, Artificial Sequence
  sgRNA
  BRDN0000737832
atcatgccttcgcattaacc

SEQ ID NO: 6813 - DNA, 20 bp, Artificial Sequence
  sgRNA
  BRDN0000738329
atccacgctccgcggtactt

SEQ ID NO: 6814 - DNA, 20 bp, Artificial Sequence
  sgRNA
  BRDN0000737962
atccccccgacttagggatt

SEQ ID NO: 6815 - DNA, 20 bp, Artificial Sequence
  sgRNA
  BRDN0000737715
atccgagatctgcgaattat

SEQ ID NO: 6816 - DNA, 20 bp, Artificial Sequence
  sgRNA
  BRDN0000738203
atccgggcatagcgtttaaa

SEQ ID NO: 6817 - DNA, 20 bp, Artificial Sequence
  sgRNA
  BRDN0000737699
atccgtaccaaacacgctac

SEQ ID NO: 6818 - DNA, 20 bp, Artificial Sequence
  sgRNA
  BRDN0000737850
atcgagcaccgagttgtgat

SEQ ID NO: 6819 - DNA, 20 bp, Artificial Sequence
  sgRNA
  BRDN0000738155
atcgatattgataaacgcga

SEQ ID NO: 6820 - DNA, 20 bp, Artificial Sequence
  sgRNA
  BRDN0000737623
atcgcaggtctacgcagagt

SEQ ID NO: 6821 - DNA, 20 bp, Artificial Sequence
  sgRNA
  BRDN0000737980
atcgcctagcccaagcgacg

SEQ ID NO: 6822 - DNA, 20 bp, Artificial Sequence
  sgRNA
  BRDN0000737926
atcgcggcgcgttaaggcag

SEQ ID NO: 6823 - DNA, 20 bp, Artificial Sequence
  sgRNA
  BRDN0000738258
atcgctaatttacgaaggcg

SEQ ID NO: 6824 - DNA, 20 bp, Artificial Sequence
  sgRNA
  BRDN0000738219
atcgtaaattacacgtacag

SEQ ID NO: 6825 - DNA, 20 bp, Artificial Sequence
  sgRNA
  BRDN0000738322
atcttaaccagcgcatcccg

SEQ ID NO: 6826 - DNA, 20 bp, Artificial Sequence
  sgRNA
  BRDN0000738247
atgacacttacggtactcgt

SEQ ID NO: 6827 - DNA, 20 bp, Artificial Sequence
  sgRNA
  BRDN0000738319
atgacctcttcgttcgagag

SEQ ID NO: 6828 - DNA, 20 bp, Artificial Sequence
  sgRNA
  BRDN0000738263
atgatgtgatccttcgccga

SEQ ID NO: 6829 - DNA, 20 bp, Artificial Sequence
  sgRNA
  BRDN0000737975
atgccaatgccgttgttagc

SEQ ID NO: 6830 - DNA, 20 bp, Artificial Sequence
  sgRNA
  BRDN0000738286
atggacccttcagtgcggta

SEQ ID NO: 6831 - DNA, 20 bp, Artificial Sequence
  sgRNA
  BRDN0000738201
atgggaaagcccacgacaat

SEQ ID NO: 6832 - DNA, 20 bp, Artificial Sequence
  sgRNA
  BRDN0000737603
atggtggctgtactcgtaac

SEQ ID NO: 6833 - DNA, 20 bp, Artificial Sequence
  sgRNA
  BRDN0000737972
atgtgtatgaagcccgtcat

SEQ ID NO: 6834 - DNA, 20 bp, Artificial Sequence
  sgRNA
  BRDN0000737720
atgtgtcatagcggcgtagg

SEQ ID NO: 6835 - DNA, 20 bp, Artificial Sequence
  sgRNA
  BRDN0000737694
atgttacgtacgtgatctcc

SEQ ID NO: 6836 - DNA, 20 bp, Artificial Sequence
  sgRNA
  BRDN0000738167
atgttgcagcgctgtacgcc

SEQ ID NO: 6837 - DNA, 20 bp, Artificial Sequence
  sgRNA
  BRDN0000737382
atgttgcagttcggctcgat

SEQ ID NO: 6838 - DNA, 20 bp, Artificial Sequence
  sgRNA
  BRDN0000738053
attaggtgactggaacacgt

SEQ ID NO: 6839 - DNA, 20 bp, Artificial Sequence
  sgRNA
  BRDN0000737798
attatagcagccccccgaat

SEQ ID NO: 6840 - DNA, 20 bp, Artificial Sequence
  sgRNA
  BRDN0000737404
attattcctccggatgacga

SEQ ID NO: 6841 - DNA, 20 bp, Artificial Sequence
  sgRNA
  BRDN0000738218
attcagtgtaccggtcaaat

SEQ ID NO: 6842 - DNA, 20 bp, Artificial Sequence
  sgRNA
  BRDN0000737643
attccgtttgcagcgagacc

SEQ ID NO: 6843 - DNA, 20 bp, Artificial Sequence
  sgRNA
  BRDN0000737793
attcggaccgttatctcacc

SEQ ID NO: 6844 - DNA, 20 bp, Artificial Sequence
  sgRNA
  BRDN0000737417
attcgtgcatcgcggggttt

SEQ ID NO: 6845 - DNA, 20 bp, Artificial Sequence
  sgRNA
  BRDN0000737386
attgttcgaccgtctacggg

SEQ ID NO: 6846 - DNA, 20 bp, Artificial Sequence
  sgRNA
  BRDN0000737688
atttgaatgctcccgtcgac

SEQ ID NO: 6847 - DNA, 20 bp, Artificial Sequence
  sgRNA
  BRDN0000737951
atttgcccgtccatacgcgg

SEQ ID NO: 6848 - DNA, 20 bp, Artificial Sequence
  sgRNA
  BRDN0000738036
caaacgaggccacgtacgtg

SEQ ID NO: 6849 - DNA, 20 bp, Artificial Sequence
  sgRNA
  BRDN0000738264
caaagtaactatctcgtcga

SEQ ID NO: 6850 - DNA, 20 bp, Artificial Sequence
  sgRNA
  BRDN0000738220
caacacgtgcgagcgaactg

SEQ ID NO: 6851 - DNA, 20 bp, Artificial Sequence
  sgRNA
  BRDN0000737460
caaccgtgcgatgcgcgcta

SEQ ID NO: 6852 - DNA, 20 bp, Artificial Sequence
  sgRNA
  BRDN0000737809
caacctgcctagcgacccgc

SEQ ID NO: 6853 - DNA, 20 bp, Artificial Sequence
  sgRNA
  BRDN0000737470
caacgatcaggcgtgttatc

SEQ ID NO: 6854 - DNA, 20 bp, Artificial Sequence
  sgRNA
  BRDN0000737689
caacggtcacgctagaataa

SEQ ID NO: 6855 - DNA, 20 bp, Artificial Sequence
  sgRNA
  BRDN0000737666
caagagttaacctcgaccgg

SEQ ID NO: 6856 - DNA, 20 bp, Artificial Sequence
  sgRNA
  BRDN0000737932
caaggatcgtgccgtgattt

SEQ ID NO: 6857 - DNA, 20 bp, Artificial Sequence
  sgRNA
  BRDN0000738207
caaggggtggtcattgcgac

SEQ ID NO: 6858 - DNA, 20 bp, Artificial Sequence
  sgRNA
  BRDN0000738096
caatacaccgttaaccctct

SEQ ID NO: 6859 - DNA, 20 bp, Artificial Sequence
  sgRNA
  BRDN0000737628
caatatctaagcgctaacga

SEQ ID NO: 6860 - DNA, 20 bp, Artificial Sequence
  sgRNA
  BRDN0000737990
caatatgcacgtagcctcgt

SEQ ID NO: 6861 - DNA, 20 bp, Artificial Sequence
  sgRNA
  BRDN0000737723
caatattcgacctacgctcc

SEQ ID NO: 6862 - DNA, 20 bp, Artificial Sequence
  sgRNA
  BRDN0000737943
caatggcgtctgccgttcag

SEQ ID NO: 6863 - DNA, 20 bp, Artificial Sequence
  sgRNA
  BRDN0000737950
cacaacgcctaccagcggac

SEQ ID NO: 6864 - DNA, 20 bp, Artificial Sequence
  sgRNA
  BRDN0000737769
cacaatacgcggcagaggtc

SEQ ID NO: 6865 - DNA, 20 bp, Artificial Sequence
  sgRNA
  BRDN0000738103
cacacgccgcgggccgtgag

SEQ ID NO: 6866 - DNA, 20 bp, Artificial Sequence
  sgRNA
  BRDN0000737507
caccccgtagcaacgataaa

SEQ ID NO: 6867 - DNA, 20 bp, Artificial Sequence
  sgRNA
  BRDN0000737459
cacccgactcggccgtaaag

SEQ ID NO: 6868 - DNA, 20 bp, Artificial Sequence
  sgRNA
  BRDN0000737763
caccgctgccctagtaccgg

SEQ ID NO: 6869 - DNA, 20 bp, Artificial Sequence
  sgRNA
  BRDN0000738342
cacctattcccctccgcaac

SEQ ID NO: 6870 - DNA, 20 bp, Artificial Sequence
  sgRNA
  BRDN0000737418
cacctcgcgtcatatcacta

SEQ ID NO: 6871 - DNA, 20 bp, Artificial Sequence
  sgRNA
  BRDN0000738156
cacctttcgaggtaacaccg

SEQ ID NO: 6872 - DNA, 20 bp, Artificial Sequence
  sgRNA
  BRDN0000738367
cacgaataactacaggttgc

SEQ ID NO: 6873 - DNA, 20 bp, Artificial Sequence
  sgRNA
  BRDN0000737882
cacgcaggagcggcgacact

SEQ ID NO: 6874 - DNA, 20 bp, Artificial Sequence
  sgRNA
  BRDN0000738065
cacgccttcgtcaaccctat

SEQ ID NO: 6875 - DNA, 20 bp, Artificial Sequence
  sgRNA
  BRDN0000738062
cacggcaggcatctcgtcta

SEQ ID NO: 6876 - DNA, 20 bp, Artificial Sequence
  sgRNA
  BRDN0000738262
cacgggcagcgatctagttg

SEQ ID NO: 6877 - DNA, 20 bp, Artificial Sequence
  sgRNA
  BRDN0000737621
cacgtaagacgctccactta

SEQ ID NO: 6878 - DNA, 20 bp, Artificial Sequence
  sgRNA
  BRDN0000737849
cacgtatacttaggtcagcg

SEQ ID NO: 6879 - DNA, 20 bp, Artificial Sequence
  sgRNA
  BRDN0000737635
cactcagcggttggacgccc

SEQ ID NO: 6880 - DNA, 20 bp, Artificial Sequence
  sgRNA
  BRDN0000737998
cagaaactcttaccgagcgc

SEQ ID NO: 6881 - DNA, 20 bp, Artificial Sequence
  sgRNA
  BRDN0000737946
cagcaccacgcgtcgtgcgg

SEQ ID NO: 6882 - DNA, 20 bp, Artificial Sequence
  sgRNA
  BRDN0000737392
cagccaccgcaccggcgtaa

SEQ ID NO: 6883 - DNA, 20 bp, Artificial Sequence
  sgRNA
  BRDN0000738148
cagcgactctgatcggcgta

SEQ ID NO: 6884 - DNA, 20 bp, Artificial Sequence
  sgRNA
  BRDN0000737557
cagctcaccctgcgtacggt

SEQ ID NO: 6885 - DNA, 20 bp, Artificial Sequence
  sgRNA
  BRDN0000737779
cagctgaccgttaatcgata

SEQ ID NO: 6886 - DNA, 20 bp, Artificial Sequence
  sgRNA
  BRDN0000737527
cagggacgtagccgccgtta

SEQ ID NO: 6887 - DNA, 20 bp, Artificial Sequence
  sgRNA
  BRDN0000738154
caggtttcccctagtcgaat

SEQ ID NO: 6888 - DNA, 20 bp, Artificial Sequence
  sgRNA
  BRDN0000737963
cagtgccggtagcggcacgg

SEQ ID NO: 6889 - DNA, 20 bp, Artificial Sequence
  sgRNA
  BRDN0000737478
catacccgcgccgtgactcc

SEQ ID NO: 6890 - DNA, 20 bp, Artificial Sequence
  sgRNA
  BRDN0000738241
catacccggtgtttcctagc

SEQ ID NO: 6891 - DNA, 20 bp, Artificial Sequence
  sgRNA
  BRDN0000737834
catactgttatcgacccgca

SEQ ID NO: 6892 - DNA, 20 bp, Artificial Sequence
  sgRNA
  BRDN0000737802
catagatccgcgattgtacg

SEQ ID NO: 6893 - DNA, 20 bp, Artificial Sequence
  sgRNA
  BRDN0000737751
catagcaacgcccaaactcg

SEQ ID NO: 6894 - DNA, 20 bp, Artificial Sequence
  sgRNA
  BRDN0000737877
catatactcttgcgctagac

SEQ ID NO: 6895 - DNA, 20 bp, Artificial Sequence
  sgRNA
  BRDN0000737701
catatgcctataaccggcgg

SEQ ID NO: 6896 - DNA, 20 bp, Artificial Sequence
  sgRNA
  BRDN0000737684
catatgctcgacggtataaa

SEQ ID NO: 6897 - DNA, 20 bp, Artificial Sequence
  sgRNA
  BRDN0000738042
catcagcccattatgactcg

SEQ ID NO: 6898 - DNA, 20 bp, Artificial Sequence
  sgRNA
  BRDN0000738105
catcccccgactacgactac

SEQ ID NO: 6899 - DNA, 20 bp, Artificial Sequence
  sgRNA
  BRDN0000737632
catcgagggtaaacgccatt

SEQ ID NO: 6900 - DNA, 20 bp, Artificial Sequence
  sgRNA
  BRDN0000738230
catcgccgacgatcctctgg

SEQ ID NO: 6901 - DNA, 20 bp, Artificial Sequence
  sgRNA
  BRDN0000737645
catcggctatgtcggggaca

SEQ ID NO: 6902 - DNA, 20 bp, Artificial Sequence
  sgRNA
  BRDN0000738033
catcggtagtcactacgccc

SEQ ID NO: 6903 - DNA, 20 bp, Artificial Sequence
  sgRNA
  BRDN0000737469
catcgtaacacacgtacgag

SEQ ID NO: 6904 - DNA, 20 bp, Artificial Sequence
  sgRNA
  BRDN0000737510
catctatgagacgtgcgtac

SEQ ID NO: 6905 - DNA, 20 bp, Artificial Sequence
  sgRNA
  BRDN0000737653
catgcccgtctgcgccgcat

SEQ ID NO: 6906 - DNA, 20 bp, Artificial Sequence
  sgRNA
  BRDN0000738302
catgggaccccccctcacgt

SEQ ID NO: 6907 - DNA, 20 bp, Artificial Sequence
  sgRNA
  BRDN0000737562
cattacgtgtcgagctccgg

SEQ ID NO: 6908 - DNA, 20 bp, Artificial Sequence
  sgRNA
  BRDN0000737476
cattcggtccgttcatctcg

SEQ ID NO: 6909 - DNA, 20 bp, Artificial Sequence
  sgRNA
  BRDN0000737961
cattctctgacgaatgcgcc

SEQ ID NO: 6910 - DNA, 20 bp, Artificial Sequence
  sgRNA
  BRDN0000737679
cattgtagactcgtacggat

SEQ ID NO: 6911 - DNA, 20 bp, Artificial Sequence
  sgRNA
  BRDN0000738001
catttccggggtccgatgca

SEQ ID NO: 6912 - DNA, 20 bp, Artificial Sequence
  sgRNA
  BRDN0000738299
ccaacatcggggcgcataat

SEQ ID NO: 6913 - DNA, 20 bp, Artificial Sequence
  sgRNA
  BRDN0000737934
ccaacccggcatcgtccgct

SEQ ID NO: 6914 - DNA, 20 bp, Artificial Sequence
  sgRNA
  BRDN0000738269
ccaacctaaggcaatacggt

SEQ ID NO: 6915 - DNA, 20 bp, Artificial Sequence
  sgRNA
  BRDN0000738265
ccaaggcgcacgctacgtgg

SEQ ID NO: 6916 - DNA, 20 bp, Artificial Sequence
  sgRNA
  BRDN0000737859
ccagcggacggcgaactcca

SEQ ID NO: 6917 - DNA, 20 bp, Artificial Sequence
  sgRNA
  BRDN0000737983
ccagctaacgttttagtacg

SEQ ID NO: 6918 - DNA, 20 bp, Artificial Sequence
  sgRNA
  BRDN0000737644
ccatcggttcgacttaccgc

SEQ ID NO: 6919 - DNA, 20 bp, Artificial Sequence
  sgRNA
  BRDN0000737929
ccattagtacgaacattgcg

SEQ ID NO: 6920 - DNA, 20 bp, Artificial Sequence
  sgRNA
  BRDN0000737639
cccacttaataacgccgctt

SEQ ID NO: 6921 - DNA, 20 bp, Artificial Sequence
  sgRNA
  BRDN0000737697
cccatcattcgcgctgacgt

SEQ ID NO: 6922 - DNA, 20 bp, Artificial Sequence
  sgRNA
  BRDN0000738231
cccattcaacaccgtttgta

SEQ ID NO: 6923 - DNA, 20 bp, Artificial Sequence
  sgRNA
  BRDN0000737913
cccctataggcgcgctaagg

SEQ ID NO: 6924 - DNA, 20 bp, Artificial Sequence
  sgRNA
  BRDN0000737570
ccccttcgatatccgatgac

SEQ ID NO: 6925 - DNA, 20 bp, Artificial Sequence
  sgRNA
  BRDN0000737492
cccgcctggcgattcacggg

SEQ ID NO: 6926 - DNA, 20 bp, Artificial Sequence
  sgRNA
  BRDN0000737907
cccggcagactaactagcgc

SEQ ID NO: 6927 - DNA, 20 bp, Artificial Sequence
  sgRNA
  BRDN0000738160
cccgggtacaccaatagcca

SEQ ID NO: 6928 - DNA, 20 bp, Artificial Sequence
  sgRNA
  BRDN0000738282
cccggtcggggatactaact

SEQ ID NO: 6929 - DNA, 20 bp, Artificial Sequence
  sgRNA
  BRDN0000738169
cccgtaggggtcgtggtttt

SEQ ID NO: 6930 - DNA, 20 bp, Artificial Sequence
  sgRNA
  BRDN0000737861
ccctaaaccatagtttcgcc

SEQ ID NO: 6931 - DNA, 20 bp, Artificial Sequence
  sgRNA
  BRDN0000737862
ccctagctcggttagagaat

SEQ ID NO: 6932 - DNA, 20 bp, Artificial Sequence
  sgRNA
  BRDN0000737401
ccctatatgcgagatccata

SEQ ID NO: 6933 - DNA, 20 bp, Artificial Sequence
  sgRNA
  BRDN0000738015
ccctcggttgagcagcgcga

SEQ ID NO: 6934 - DNA, 20 bp, Artificial Sequence
  sgRNA
  BRDN0000737812
ccctgatgtgctatacgcgc

SEQ ID NO: 6935 - DNA, 20 bp, Artificial Sequence
  sgRNA
  BRDN0000737837
cccttaaagtgacggacgaa

SEQ ID NO: 6936 - DNA, 20 bp, Artificial Sequence
  sgRNA
  BRDN0000738289
ccgaccgtgtgagagtacgt

SEQ ID NO: 6937 - DNA, 20 bp, Artificial Sequence
  sgRNA
  BRDN0000737781
ccgactgccgagctaggcgt

SEQ ID NO: 6938 - DNA, 20 bp, Artificial Sequence
  sgRNA
  BRDN0000738209
ccgagaggtactccaattcg

SEQ ID NO: 6939 - DNA, 20 bp, Artificial Sequence
  sgRNA
  BRDN0000737914
ccgagatggctcggatagac

SEQ ID NO: 6940 - DNA, 20 bp, Artificial Sequence
  sgRNA
  BRDN0000738106
ccgagcaccctatttatcta

SEQ ID NO: 6941 - DNA, 20 bp, Artificial Sequence
  sgRNA
  BRDN0000737711
ccgagccgaattgggcgtgt

SEQ ID NO: 6942 - DNA, 20 bp, Artificial Sequence
  sgRNA
  BRDN0000738357
ccgataccattgtcaccaat

SEQ ID NO: 6943 - DNA, 20 bp, Artificial Sequence
  sgRNA
  BRDN0000738115
ccgcaccgcagtcatggtaa

SEQ ID NO: 6944 - DNA, 20 bp, Artificial Sequence
  sgRNA
  BRDN0000737519
ccgcccctgcgaactgcgtt

SEQ ID NO: 6945 - DNA, 20 bp, Artificial Sequence
  sgRNA
  BRDN0000737892
ccgcccgggtgtgagttgag

SEQ ID NO: 6946 - DNA, 20 bp, Artificial Sequence
  sgRNA
  BRDN0000737879
ccgcgcattaacgatcagta

SEQ ID NO: 6947 - DNA, 20 bp, Artificial Sequence
  sgRNA
  BRDN0000737385
ccgcgccgttagggaacgag

SEQ ID NO: 6948 - DNA, 20 bp, Artificial Sequence
  sgRNA
  BRDN0000738120
ccgcgtgacgcaatcccttg

SEQ ID NO: 6949 - DNA, 20 bp, Artificial Sequence
  sgRNA
  BRDN0000737745
ccgcttgggcgctattaatt

SEQ ID NO: 6950 - DNA, 20 bp, Artificial Sequence
  sgRNA
  BRDN0000737761
ccggacttgttatacttgat

SEQ ID NO: 6951 - DNA, 20 bp, Artificial Sequence
  sgRNA
  BRDN0000738043
ccggagcgcgttgcagttct

SEQ ID NO: 6952 - DNA, 20 bp, Artificial Sequence
  sgRNA
  BRDN0000737722
ccggatcggctacgctacgg

SEQ ID NO: 6953 - DNA, 20 bp, Artificial Sequence
  sgRNA
  BRDN0000738006
ccggcgctgcggtcggcttg

SEQ ID NO: 6954 - DNA, 20 bp, Artificial Sequence
  sgRNA
  BRDN0000737605
ccggcttgaataccgtgcgg

SEQ ID NO: 6955 - DNA, 20 bp, Artificial Sequence
  sgRNA
  BRDN0000738002
ccgggcgccgtatcccctac

SEQ ID NO: 6956 - DNA, 20 bp, Artificial Sequence
  sgRNA
  BRDN0000737556
ccggtttataaattacgtgg

SEQ ID NO: 6957 - DNA, 20 bp, Artificial Sequence
  sgRNA
  BRDN0000737463
ccgtatacgtatctatgccg

SEQ ID NO: 6958 - DNA, 20 bp, Artificial Sequence
  sgRNA
  BRDN0000737626
ccgtcgagcaatcccgccaa

SEQ ID NO: 6959 - DNA, 20 bp, Artificial Sequence
  sgRNA
  BRDN0000738039
ccgtgatttcggtagcgtac

SEQ ID NO: 6960 - DNA, 20 bp, Artificial Sequence
  sgRNA
  BRDN0000737982
ccgttcaattatgctggcgt

SEQ ID NO: 6961 - DNA, 20 bp, Artificial Sequence
  sgRNA
  BRDN0000737433
ccgttctgacgacgctaaag

SEQ ID NO: 6962 - DNA, 20 bp, Artificial Sequence
  sgRNA
  BRDN0000737450
ccgtttcgcctattggtgcg

SEQ ID NO: 6963 - DNA, 20 bp, Artificial Sequence
  sgRNA
  BRDN0000738133
cctaactcgaagtctcgtca

SEQ ID NO: 6964 - DNA, 20 bp, Artificial Sequence
  sgRNA
  BRDN0000738000
cctactaacgacgagtcaaa

SEQ ID NO: 6965 - DNA, 20 bp, Artificial Sequence
  sgRNA
  BRDN0000737880
cctattagtccggtttagtc

SEQ ID NO: 6966 - DNA, 20 bp, Artificial Sequence
  sgRNA
  BRDN0000738094
cctcaaatagcgaacgtcaa

SEQ ID NO: 6967 - DNA, 20 bp, Artificial Sequence
  sgRNA
  BRDN0000738358
cctccagtagcgtcattaac

SEQ ID NO: 6968 - DNA, 20 bp, Artificial Sequence
  sgRNA
  BRDN0000738327
cctccttcagttcgatctgg

SEQ ID NO: 6969 - DNA, 20 bp, Artificial Sequence
  sgRNA
  BRDN0000738324
cctgctattctcgcatgcga

SEQ ID NO: 6970 - DNA, 20 bp, Artificial Sequence
  sgRNA
  BRDN0000737976
ccttacggcggagaacgagt

SEQ ID NO: 6971 - DNA, 20 bp, Artificial Sequence
  sgRNA
  BRDN0000737394
ccttagaccgggtgtacctc

SEQ ID NO: 6972 - DNA, 20 bp, Artificial Sequence
  sgRNA
  BRDN0000737502
ccttcggattcgtaggctgg

SEQ ID NO: 6973 - DNA, 20 bp, Artificial Sequence
  sgRNA
  BRDN0000737594
ccttgtggcgtgccaaacga

SEQ ID NO: 6974 - DNA, 20 bp, Artificial Sequence
  sgRNA
  BRDN0000738014
cctttgatgggcgcgtactc

SEQ ID NO: 6975 - DNA, 20 bp, Artificial Sequence
  sgRNA
  BRDN0000737616
cgaaaccatacctccttcga

SEQ ID NO: 6976 - DNA, 20 bp, Artificial Sequence
  sgRNA
  BRDN0000738166
cgaaaggcccgactgcgtgg

SEQ ID NO: 6977 - DNA, 20 bp, Artificial Sequence
  sgRNA
  BRDN0000738004
cgaacttctaccgttgtgcg

SEQ ID NO: 6978 - DNA, 20 bp, Artificial Sequence
  sgRNA
  BRDN0000737768
cgaagtacacggttctctcg

SEQ ID NO: 6979 - DNA, 20 bp, Artificial Sequence
  sgRNA
  BRDN0000737583
cgaatcgggaaggcgcgtgt

SEQ ID NO: 6980 - DNA, 20 bp, Artificial Sequence
  sgRNA
  BRDN0000738223
cgaatgcacaggctcgcggt

SEQ ID NO: 6981 - DNA, 20 bp, Artificial Sequence
  sgRNA
  BRDN0000737491
cgaatgcgccggagaatatt

SEQ ID NO: 6982 - DNA, 20 bp, Artificial Sequence
  sgRNA
  BRDN0000737547
cgacacgatggtcatactac

SEQ ID NO: 6983 - DNA, 20 bp, Artificial Sequence
  sgRNA
  BRDN0000737481
cgacacttgggctgacgcgc

SEQ ID NO: 6984 - DNA, 20 bp, Artificial Sequence
  sgRNA
  BRDN0000737729
cgacgacccatttcggttat

SEQ ID NO: 6985 - DNA, 20 bp, Artificial Sequence
  sgRNA
  BRDN0000738297
cgacgaccttggattggcag

SEQ ID NO: 6986 - DNA, 20 bp, Artificial Sequence
  sgRNA
  BRDN0000737927
cgacggttgtgctgaggctt

SEQ ID NO: 6987 - DNA, 20 bp, Artificial Sequence
  sgRNA
  BRDN0000737698
cgactattgccgtccatctc

SEQ ID NO: 6988 - DNA, 20 bp, Artificial Sequence
  sgRNA
  BRDN0000738110
cgactccgggaatatccgtt

SEQ ID NO: 6989 - DNA, 20 bp, Artificial Sequence
  sgRNA
  BRDN0000737734
cgactcgcttaaccgtgcag

SEQ ID NO: 6990 - DNA, 20 bp, Artificial Sequence
  sgRNA
  BRDN0000737870
cgagacgaatccatcatgcg

SEQ ID NO: 6991 - DNA, 20 bp, Artificial Sequence
  sgRNA
  BRDN0000738287
cgagagaatcgtccgtcata

SEQ ID NO: 6992 - DNA, 20 bp, Artificial Sequence
  sgRNA
  BRDN0000738239
cgagcctcgtctttcatggg

SEQ ID NO: 6993 - DNA, 20 bp, Artificial Sequence
  sgRNA
  BRDN0000738009
cgagctcggcaaatttgatt

SEQ ID NO: 6994 - DNA, 20 bp, Artificial Sequence
  sgRNA
  BRDN0000737565
cgaggatgtacatacgtaaa

SEQ ID NO: 6995 - DNA, 20 bp, Artificial Sequence
  sgRNA
  BRDN0000738379
cgaggcttaacgccagattc

SEQ ID NO: 6996 - DNA, 20 bp, Artificial Sequence
  sgRNA
  BRDN0000737601
cgagtaattatttgcggtcg

SEQ ID NO: 6997 - DNA, 20 bp, Artificial Sequence
  sgRNA
  BRDN0000738082
cgagtatcagcatgtcgacg

SEQ ID NO: 6998 - DNA, 20 bp, Artificial Sequence
  sgRNA
  BRDN0000737948
cgatacgctatagaatagtc

SEQ ID NO: 6999 - DNA, 20 bp, Artificial Sequence
  sgRNA
  BRDN0000737947
cgatgtcgaaagtcggtcaa

SEQ ID NO: 7000 - DNA, 20 bp, Artificial Sequence
  sgRNA
  BRDN0000737610
cgattgacgttgggctctca

SEQ ID NO: 7001 - DNA, 20 bp, Artificial Sequence
  sgRNA
  BRDN0000738353
cgcacttctagtagctgtcg

SEQ ID NO: 7002 - DNA, 20 bp, Artificial Sequence
  sgRNA
  BRDN0000737821
cgcagagttcaaatccgcgc

SEQ ID NO: 7003 - DNA, 20 bp, Artificial Sequence
  sgRNA
  BRDN0000737744
cgcatagtgtaccgttgcgc

SEQ ID NO: 7004 - DNA, 20 bp, Artificial Sequence
  sgRNA
  BRDN0000738138
cgccaatggtggccgactcg

SEQ ID NO: 7005 - DNA, 20 bp, Artificial Sequence
  sgRNA
  BRDN0000738243
cgccagtataccacattcgt

SEQ ID NO: 7006 - DNA, 20 bp, Artificial Sequence
  sgRNA
  BRDN0000738079
cgcccctagttgtcccgccc

SEQ ID NO: 7007 - DNA, 20 bp, Artificial Sequence
  sgRNA
  BRDN0000737449
cgccggatgactggtggata

SEQ ID NO: 7008 - DNA, 20 bp, Artificial Sequence
  sgRNA
  BRDN0000738350
cgcctagtatcttcggggat

SEQ ID NO: 7009 - DNA, 20 bp, Artificial Sequence
  sgRNA
  BRDN0000738124
cgcgacgtacggctggagca

SEQ ID NO: 7010 - DNA, 20 bp, Artificial Sequence
  sgRNA
  BRDN0000737737
cgcgccgagggcctcgttac

SEQ ID NO: 7011 - DNA, 20 bp, Artificial Sequence
  sgRNA
  BRDN0000737617
cgcgcctacccttttaccgc

SEQ ID NO: 7012 - DNA, 20 bp, Artificial Sequence
  sgRNA
  BRDN0000737900
cgcgcgactgcagctaatct

SEQ ID NO: 7013 - DNA, 20 bp, Artificial Sequence
  sgRNA
  BRDN0000737911
cgcgcggatatttaaacttc

SEQ ID NO: 7014 - DNA, 20 bp, Artificial Sequence
  sgRNA
  BRDN0000737977
cgcgcggatcttccgtacaa

SEQ ID NO: 7015 - DNA, 20 bp, Artificial Sequence
  sgRNA
  BRDN0000737426
cgcgtatatgtcacacggca

SEQ ID NO: 7016 - DNA, 20 bp, Artificial Sequence
  sgRNA
  BRDN0000738252
cgctacagtaatcgcaacga

SEQ ID NO: 7017 - DNA, 20 bp, Artificial Sequence
  sgRNA
  BRDN0000737847
cgctccgtatcctctcataa

SEQ ID NO: 7018 - DNA, 20 bp, Artificial Sequence
  sgRNA
  BRDN0000737919
cgctcggtaaggtcgattgg

SEQ ID NO: 7019 - DNA, 20 bp, Artificial Sequence
  sgRNA
  BRDN0000737797
cgctcggtgacgtatacacg

SEQ ID NO: 7020 - DNA, 20 bp, Artificial Sequence
  sgRNA
  BRDN0000737442
cgcttcattgcccgaacgct

SEQ ID NO: 7021 - DNA, 20 bp, Artificial Sequence
  sgRNA
  BRDN0000737431
cgcttcgtctctcgcaaaca

SEQ ID NO: 7022 - DNA, 20 bp, Artificial Sequence
  sgRNA
  BRDN0000738122
cggaatacgccaaaacctat

SEQ ID NO: 7023 - DNA, 20 bp, Artificial Sequence
  sgRNA
  BRDN0000738221
cggacttaccgcagattata

SEQ ID NO: 7024 - DNA, 20 bp, Artificial Sequence
  sgRNA
  BRDN0000738199
cggatccggtacggtcagtt

SEQ ID NO: 7025 - DNA, 20 bp, Artificial Sequence
  sgRNA
  BRDN0000737928
cggatcctcccgtactatcc

SEQ ID NO: 7026 - DNA, 20 bp, Artificial Sequence
  sgRNA
  BRDN0000737978
cggcaagcgcattcctatgg

SEQ ID NO: 7027 - DNA, 20 bp, Artificial Sequence
  sgRNA
  BRDN0000737534
cggcaatgtgtggcgaccgc

SEQ ID NO: 7028 - DNA, 20 bp, Artificial Sequence
  sgRNA
  BRDN0000737544
cggccgtagtgacgaatgga

SEQ ID NO: 7029 - DNA, 20 bp, Artificial Sequence
  sgRNA
  BRDN0000737672
cggcgataacagcgacatcg

SEQ ID NO: 7030 - DNA, 20 bp, Artificial Sequence
  sgRNA
  BRDN0000737525
cgggcaatatgatcgtaggc

SEQ ID NO: 7031 - DNA, 20 bp, Artificial Sequence
  sgRNA
  BRDN0000737659
cgggcactaacccgatacac

SEQ ID NO: 7032 - DNA, 20 bp, Artificial Sequence
  sgRNA
  BRDN0000737789
cgggcggtaagagctctacg

SEQ ID NO: 7033 - DNA, 20 bp, Artificial Sequence
  sgRNA
  BRDN0000737388
cgggcgtcacctgctagtaa

SEQ ID NO: 7034 - DNA, 20 bp, Artificial Sequence
  sgRNA
  BRDN0000737733
cggggcgtacatgtgtggcc

SEQ ID NO: 7035 - DNA, 20 bp, Artificial Sequence
  sgRNA
  BRDN0000737829
cgggttatagatagtcgtcg

SEQ ID NO: 7036 - DNA, 20 bp, Artificial Sequence
  sgRNA
  BRDN0000737952
cggtaagatggttataccgt

SEQ ID NO: 7037 - DNA, 20 bp, Artificial Sequence
  sgRNA
  BRDN0000738318
cggtaaggtcggtctccatc

SEQ ID NO: 7038 - DNA, 20 bp, Artificial Sequence
  sgRNA
  BRDN0000738084
cggtaccacgccccacctcg

SEQ ID NO: 7039 - DNA, 20 bp, Artificial Sequence
  sgRNA
  BRDN0000737799
cggtcagtcgtcttcccgga

SEQ ID NO: 7040 - DNA, 20 bp, Artificial Sequence
  sgRNA
  BRDN0000738234
cggtcgattgtggagtaatg

SEQ ID NO: 7041 - DNA, 20 bp, Artificial Sequence
  sgRNA
  BRDN0000737624
cggtcgtgacagacctggtg

SEQ ID NO: 7042 - DNA, 20 bp, Artificial Sequence
  sgRNA
  BRDN0000737440
cggtgaggatccctcttgcg

SEQ ID NO: 7043 - DNA, 20 bp, Artificial Sequence
  sgRNA
  BRDN0000737523
cgtaaaccataacgttggtc

SEQ ID NO: 7044 - DNA, 20 bp, Artificial Sequence
  sgRNA
  BRDN0000737671
cgtaaccggagataatatta

SEQ ID NO: 7045 - DNA, 20 bp, Artificial Sequence
  sgRNA
  BRDN0000737772
cgtaccgacagtagtccaag

SEQ ID NO: 7046 - DNA, 20 bp, Artificial Sequence
  sgRNA
  BRDN0000737531
cgtacgggcgcgccgtccat

SEQ ID NO: 7047 - DNA, 20 bp, Artificial Sequence
  sgRNA
  BRDN0000738170
cgtagatgcctgctcgagca

SEQ ID NO: 7048 - DNA, 20 bp, Artificial Sequence
  sgRNA
  BRDN0000737752
cgtcaatgtgtccggacggt

SEQ ID NO: 7049 - DNA, 20 bp, Artificial Sequence
  sgRNA
  BRDN0000737633
cgtcaccgctagtaatgatg

SEQ ID NO: 7050 - DNA, 20 bp, Artificial Sequence
  sgRNA
  BRDN0000738309
cgtcatggcaagatcgataa

SEQ ID NO: 7051 - DNA, 20 bp, Artificial Sequence
  sgRNA
  BRDN0000738012
cgtcctcgcagcgtagactg

SEQ ID NO: 7052 - DNA, 20 bp, Artificial Sequence
  sgRNA
  BRDN0000738023
cgtcgaagatacgcaggctg

SEQ ID NO: 7053 - DNA, 20 bp, Artificial Sequence
  sgRNA
  BRDN0000738165
cgtcgatccctctatactgg

SEQ ID NO: 7054 - DNA, 20 bp, Artificial Sequence
  sgRNA
  BRDN0000738303
cgtcgcatgttgttgctcat

SEQ ID NO: 7055 - DNA, 20 bp, Artificial Sequence
  sgRNA
  BRDN0000738089
cgtgaatcgaccctcaataa

SEQ ID NO: 7056 - DNA, 20 bp, Artificial Sequence
  sgRNA
  BRDN0000737571
cgtgattcctaagcccccgc

SEQ ID NO: 7057 - DNA, 20 bp, Artificial Sequence
  sgRNA
  BRDN0000737569
cgtgcgttcgtaataaaagg

SEQ ID NO: 7058 - DNA, 20 bp, Artificial Sequence
  sgRNA
  BRDN0000738182
cgtgtagtcgggtcgcatgt

SEQ ID NO: 7059 - DNA, 20 bp, Artificial Sequence
  sgRNA
  BRDN0000738055
cgtgtgtttacagcccttac

SEQ ID NO: 7060 - DNA, 20 bp, Artificial Sequence
  sgRNA
  BRDN0000738146
cgtgtttggcggccaacttt

SEQ ID NO: 7061 - DNA, 20 bp, Artificial Sequence
  sgRNA
  BRDN0000738011
cgtgttttacctcgcttcga

SEQ ID NO: 7062 - DNA, 20 bp, Artificial Sequence
  sgRNA
  BRDN0000738078
cgttaataaacgcggtttca

SEQ ID NO: 7063 - DNA, 20 bp, Artificial Sequence
  sgRNA
  BRDN0000738052
cgttaatccaccgtatgggc

SEQ ID NO: 7064 - DNA, 20 bp, Artificial Sequence
  sgRNA
  BRDN0000737655
cgttacgtttcttgccagga

SEQ ID NO: 7065 - DNA, 20 bp, Artificial Sequence
  sgRNA
  BRDN0000738099
cgttagaccgaatctccggg

SEQ ID NO: 7066 - DNA, 20 bp, Artificial Sequence
  sgRNA
  BRDN0000738225
cgttatatctacactttgcg

SEQ ID NO: 7067 - DNA, 20 bp, Artificial Sequence
  sgRNA
  BRDN0000738008
cgttattgtacaccacgctc

SEQ ID NO: 7068 - DNA, 20 bp, Artificial Sequence
  sgRNA
  BRDN0000738272
cgttgcgaatccaccctatt

SEQ ID NO: 7069 - DNA, 20 bp, Artificial Sequence
  sgRNA
  BRDN0000738253
cgttgtttggagcccgtcca

SEQ ID NO: 7070 - DNA, 20 bp, Artificial Sequence
  sgRNA
  BRDN0000738025
ctaacagcgccgttatctac

SEQ ID NO: 7071 - DNA, 20 bp, Artificial Sequence
  sgRNA
  BRDN0000738205
ctaacgtggtagcactacaa

SEQ ID NO: 7072 - DNA, 20 bp, Artificial Sequence
  sgRNA
  BRDN0000738189
ctaagtcgactgtttcgacc

SEQ ID NO: 7073 - DNA, 20 bp, Artificial Sequence
  sgRNA
  BRDN0000737703
ctaatacacccggacggtac

SEQ ID NO: 7074 - DNA, 20 bp, Artificial Sequence
  sgRNA
  BRDN0000738310
ctaatacactccttctccgc

SEQ ID NO: 7075 - DNA, 20 bp, Artificial Sequence
  sgRNA
  BRDN0000738045
ctaattccaatatccgtctg

SEQ ID NO: 7076 - DNA, 20 bp, Artificial Sequence
  sgRNA
  BRDN0000738341
ctacccccgctgtgcaacgt

SEQ ID NO: 7077 - DNA, 20 bp, Artificial Sequence
  sgRNA
  BRDN0000737787
ctacccgtctattacgatct

SEQ ID NO: 7078 - DNA, 20 bp, Artificial Sequence
  sgRNA
  BRDN0000738056
ctaccggtcacgttgtgacc

SEQ ID NO: 7079 - DNA, 20 bp, Artificial Sequence
  sgRNA
  BRDN0000738333
ctacgagattcggctaagct

SEQ ID NO: 7080 - DNA, 20 bp, Artificial Sequence
  sgRNA
  BRDN0000737719
ctacgagggccgcgagcggt

SEQ ID NO: 7081 - DNA, 20 bp, Artificial Sequence
  sgRNA
  BRDN0000737853
ctacggataggcgcgggtga

SEQ ID NO: 7082 - DNA, 20 bp, Artificial Sequence
  sgRNA
  BRDN0000737852
ctacttgtgacgacctcgcg

SEQ ID NO: 7083 - DNA, 20 bp, Artificial Sequence
  sgRNA
  BRDN0000737754
ctatcggcccgcagtgatgg

SEQ ID NO: 7084 - DNA, 20 bp, Artificial Sequence
  sgRNA
  BRDN0000737814
ctattgggagcggcctctcg

SEQ ID NO: 7085 - DNA, 20 bp, Artificial Sequence
  sgRNA
  BRDN0000738222
ctcaaacctccgttaccccg

SEQ ID NO: 7086 - DNA, 20 bp, Artificial Sequence
  sgRNA
  BRDN0000737685
ctcatgtacgccttcgctac

SEQ ID NO: 7087 - DNA, 20 bp, Artificial Sequence
  sgRNA
  BRDN0000738151
ctcccatccccgtagcggcc

SEQ ID NO: 7088 - DNA, 20 bp, Artificial Sequence
  sgRNA
  BRDN0000737738
ctccgacgactacgcaagga

SEQ ID NO: 7089 - DNA, 20 bp, Artificial Sequence
  sgRNA
  BRDN0000737613
ctccggacgtgcatccgaga

SEQ ID NO: 7090 - DNA, 20 bp, Artificial Sequence
  sgRNA
  BRDN0000737657
ctcctcgaggctggctacgt

SEQ ID NO: 7091 - DNA, 20 bp, Artificial Sequence
  sgRNA
  BRDN0000737771
ctcgacccagtagtagacgg

SEQ ID NO: 7092 - DNA, 20 bp, Artificial Sequence
  sgRNA
  BRDN0000738064
ctcgatgccacggaaggcgg

SEQ ID NO: 7093 - DNA, 20 bp, Artificial Sequence
  sgRNA
  BRDN0000737683
ctcggacggcatacgacaat

SEQ ID NO: 7094 - DNA, 20 bp, Artificial Sequence
  sgRNA
  BRDN0000738313
ctcggagattcgttagaaga

SEQ ID NO: 7095 - DNA, 20 bp, Artificial Sequence
  sgRNA
  BRDN0000738235
ctcggatggtgtgttgaacc

SEQ ID NO: 7096 - DNA, 20 bp, Artificial Sequence
  sgRNA
  BRDN0000737558
ctcggctttacgatcgatca

SEQ ID NO: 7097 - DNA, 20 bp, Artificial Sequence
  sgRNA
  BRDN0000737398
ctcgggctattcagcgatag

SEQ ID NO: 7098 - DNA, 20 bp, Artificial Sequence
  sgRNA
  BRDN0000737553
ctcgtatagtattgcgtggt

SEQ ID NO: 7099 - DNA, 20 bp, Artificial Sequence
  sgRNA
  BRDN0000738348
ctcgtatcttttcccacggc

SEQ ID NO: 7100 - DNA, 20 bp, Artificial Sequence
  sgRNA
  BRDN0000738059
ctcgtcggctttcgtgctgc

SEQ ID NO: 7101 - DNA, 20 bp, Artificial Sequence
  sgRNA
  BRDN0000737542
ctcgtgaaacaagatccgac

SEQ ID NO: 7102 - DNA, 20 bp, Artificial Sequence
  sgRNA
  BRDN0000738363
ctcgtgaacctgttcgcgca

SEQ ID NO: 7103 - DNA, 20 bp, Artificial Sequence
  sgRNA
  BRDN0000737974
ctcgtgtcactcctcggttc

SEQ ID NO: 7104 - DNA, 20 bp, Artificial Sequence
  sgRNA
  BRDN0000738291
ctctaataaaccgcacaagc

SEQ ID NO: 7105 - DNA, 20 bp, Artificial Sequence
  sgRNA
  BRDN0000738081
ctctctgcgagtcgatgatt

SEQ ID NO: 7106 - DNA, 20 bp, Artificial Sequence
  sgRNA
  BRDN0000737706
ctgatcggtgcatatctcgg

SEQ ID NO: 7107 - DNA, 20 bp, Artificial Sequence
  sgRNA
  BRDN0000737579
ctgcacggcacgacatccaa

SEQ ID NO: 7108 - DNA, 20 bp, Artificial Sequence
  sgRNA
  BRDN0000738136
ctgcgtgtaacgtgttggga

SEQ ID NO: 7109 - DNA, 20 bp, Artificial Sequence
  sgRNA
  BRDN0000737923
ctgcttgaacgcctagacgg

SEQ ID NO: 7110 - DNA, 20 bp, Artificial Sequence
  sgRNA
  BRDN0000738337
ctggggccgctgaaccgccg

SEQ ID NO: 7111 - DNA, 20 bp, Artificial Sequence
  sgRNA
  BRDN0000738112
ctgtcttcaacgtctggccg

SEQ ID NO: 7112 - DNA, 20 bp, Artificial Sequence
  sgRNA
  BRDN0000737690
cttaagttcgcgacggaatg

SEQ ID NO: 7113 - DNA, 20 bp, Artificial Sequence
  sgRNA
  BRDN0000737539
cttatccataataggcggcg

SEQ ID NO: 7114 - DNA, 20 bp, Artificial Sequence
  sgRNA
  BRDN0000737776
cttatcgatttgggttcaac

SEQ ID NO: 7115 - DNA, 20 bp, Artificial Sequence
  sgRNA
  BRDN0000738375
cttcacgccttggaccgata

SEQ ID NO: 7116 - DNA, 20 bp, Artificial Sequence
  sgRNA
  BRDN0000737999
cttgaaaaaggggcgactat

SEQ ID NO: 7117 - DNA, 20 bp, Artificial Sequence
  sgRNA
  BRDN0000738159
cttgacacctcgtccgcatc

SEQ ID NO: 7118 - DNA, 20 bp, Artificial Sequence
  sgRNA
  BRDN0000737554
ctttagtcacgatatacgtc

SEQ ID NO: 7119 - DNA, 20 bp, Artificial Sequence
  sgRNA
  BRDN0000737437
ctttataccgcgcgtcggca

SEQ ID NO: 7120 - DNA, 20 bp, Artificial Sequence
  sgRNA
  BRDN0000737713
ctttattccgttgcatgtcg

SEQ ID NO: 7121 - DNA, 20 bp, Artificial Sequence
  sgRNA
  BRDN0000738040
ctttggcgtcgagaagcgca

SEQ ID NO: 7122 - DNA, 20 bp, Artificial Sequence
  sgRNA
  BRDN0000737885
gaaccacgagcgagcgtata

SEQ ID NO: 7123 - DNA, 20 bp, Artificial Sequence
  sgRNA
  BRDN0000738117
gaaccagtatctaacccgac

SEQ ID NO: 7124 - DNA, 20 bp, Artificial Sequence
  sgRNA
  BRDN0000737886
gaacccgggaaacacgtccg

SEQ ID NO: 7125 - DNA, 20 bp, Artificial Sequence
  sgRNA
  BRDN0000737668
gaaccggcgtgcgttagcgg

SEQ ID NO: 7126 - DNA, 20 bp, Artificial Sequence
  sgRNA
  BRDN0000738212
gaaccttcgcgcaacttaac

SEQ ID NO: 7127 - DNA, 20 bp, Artificial Sequence
  sgRNA
  BRDN0000737660
gaacgtaacggcatgcatca

SEQ ID NO: 7128 - DNA, 20 bp, Artificial Sequence
  sgRNA
  BRDN0000738378
gaactcgttaggccgtgaag

SEQ ID NO: 7129 - DNA, 20 bp, Artificial Sequence
  sgRNA
  BRDN0000737863
gaattgagccgcaactcggc

SEQ ID NO: 7130 - DNA, 20 bp, Artificial Sequence
  sgRNA
  BRDN0000738200
gacaatcgacacgccgcttc

SEQ ID NO: 7131 - DNA, 20 bp, Artificial Sequence
  sgRNA
  BRDN0000738018
gacagccggttgaccgggtc

SEQ ID NO: 7132 - DNA, 20 bp, Artificial Sequence
  sgRNA
  BRDN0000737811
gacagttgacgcgacggaga

SEQ ID NO: 7133 - DNA, 20 bp, Artificial Sequence
  sgRNA
  BRDN0000738285
gacagttggataaccgtgtc

SEQ ID NO: 7134 - DNA, 20 bp, Artificial Sequence
  sgRNA
  BRDN0000737403
gaccaaccttacggtaactc

SEQ ID NO: 7135 - DNA, 20 bp, Artificial Sequence
  sgRNA
  BRDN0000738034
gaccactatgtacttatcgc

SEQ ID NO: 7136 - DNA, 20 bp, Artificial Sequence
  sgRNA
  BRDN0000737533
gaccatacgcctcgtatgcc

SEQ ID NO: 7137 - DNA, 20 bp, Artificial Sequence
  sgRNA
  BRDN0000737991
gaccgacggtataccctact

SEQ ID NO: 7138 - DNA, 20 bp, Artificial Sequence
  sgRNA
  BRDN0000738187
gaccggccaacggtagcggc

SEQ ID NO: 7139 - DNA, 20 bp, Artificial Sequence
  sgRNA
  BRDN0000737439
gaccggtgtgtttacgcgtg

SEQ ID NO: 7140 - DNA, 20 bp, Artificial Sequence
  sgRNA
  BRDN0000738251
gaccgtcgggatccttaatt

SEQ ID NO: 7141 - DNA, 20 bp, Artificial Sequence
  sgRNA
  BRDN0000737419
gacctcgcaattgagcgctc

SEQ ID NO: 7142 - DNA, 20 bp, Artificial Sequence
  sgRNA
  BRDN0000737957
gacgaaaggtcctacgaagt

SEQ ID NO: 7143 - DNA, 20 bp, Artificial Sequence
  sgRNA
  BRDN0000738240
gacggtcccccctatgaaat

SEQ ID NO: 7144 - DNA, 20 bp, Artificial Sequence
  sgRNA
  BRDN0000738109
gacgtattggattcgcaacc

SEQ ID NO: 7145 - DNA, 20 bp, Artificial Sequence
  sgRNA
  BRDN0000737414
gacgtctaatttctggccgt

SEQ ID NO: 7146 - DNA, 20 bp, Artificial Sequence
  sgRNA
  BRDN0000738144
gactagcacgaactgcggtt

SEQ ID NO: 7147 - DNA, 20 bp, Artificial Sequence
  sgRNA
  BRDN0000737384
gactccgggtactaaatgtc

SEQ ID NO: 7148 - DNA, 20 bp, Artificial Sequence
  sgRNA
  BRDN0000738121
gacttcgacgagaaaacgtt

SEQ ID NO: 7149 - DNA, 20 bp, Artificial Sequence
  sgRNA
  BRDN0000738003
gagacccattatgatcctag

SEQ ID NO: 7150 - DNA, 20 bp, Artificial Sequence
  sgRNA
  BRDN0000737582
gagattaaattaacgccggc

SEQ ID NO: 7151 - DNA, 20 bp, Artificial Sequence
  sgRNA
  BRDN0000738325
gagattcgatactgcggtca

SEQ ID NO: 7152 - DNA, 20 bp, Artificial Sequence
  sgRNA
  BRDN0000737707
gagccccaacgcgcgaagca

SEQ ID NO: 7153 - DNA, 20 bp, Artificial Sequence
  sgRNA
  BRDN0000738063
gagcgccaagcgtgcgttga

SEQ ID NO: 7154 - DNA, 20 bp, Artificial Sequence
  sgRNA
  BRDN0000738067
gagcgcgggccagcgaacgt

SEQ ID NO: 7155 - DNA, 20 bp, Artificial Sequence
  sgRNA
  BRDN0000738087
gagcgtcccgtgatttaaag

SEQ ID NO: 7156 - DNA, 20 bp, Artificial Sequence
  sgRNA
  BRDN0000738179
gagctaatctgtagacgtcg

SEQ ID NO: 7157 - DNA, 20 bp, Artificial Sequence
  sgRNA
  BRDN0000738368
gaggacctaggttcccggat

SEQ ID NO: 7158 - DNA, 20 bp, Artificial Sequence
  sgRNA
  BRDN0000738360
gaggcgggctcttctatcgt

SEQ ID NO: 7159 - DNA, 20 bp, Artificial Sequence
  sgRNA
  BRDN0000737445
gaggcgtacttcggctctaa

SEQ ID NO: 7160 - DNA, 20 bp, Artificial Sequence
  sgRNA
  BRDN0000737627
gagtcgagttaataacgctc

SEQ ID NO: 7161 - DNA, 20 bp, Artificial Sequence
  sgRNA
  BRDN0000737599
gataagactccgcgagcttc

SEQ ID NO: 7162 - DNA, 20 bp, Artificial Sequence
  sgRNA
  BRDN0000737939
gatacgtgaggttgccggtg

SEQ ID NO: 7163 - DNA, 20 bp, Artificial Sequence
  sgRNA
  BRDN0000738317
gatagaacaacagcggtgca

SEQ ID NO: 7164 - DNA, 20 bp, Artificial Sequence
  sgRNA
  BRDN0000737484
gatatttaccggcgataaga

SEQ ID NO: 7165 - DNA, 20 bp, Artificial Sequence
  sgRNA
  BRDN0000738139
gatcactcccgaaagtagtg

SEQ ID NO: 7166 - DNA, 20 bp, Artificial Sequence
  sgRNA
  BRDN0000737867
gatcccctacgcttcaacct

SEQ ID NO: 7167 - DNA, 20 bp, Artificial Sequence
  sgRNA
  BRDN0000737755
gatcgagtgacacccacccg

SEQ ID NO: 7168 - DNA, 20 bp, Artificial Sequence
  sgRNA
  BRDN0000737421
gatcttaccactcgtcgtag

SEQ ID NO: 7169 - DNA, 20 bp, Artificial Sequence
  sgRNA
  BRDN0000738197
gatgcggacccacgttaagc

SEQ ID NO: 7170 - DNA, 20 bp, Artificial Sequence
  sgRNA
  BRDN0000737563
gatgcgggtggaaaacgtta

SEQ ID NO: 7171 - DNA, 20 bp, Artificial Sequence
  sgRNA
  BRDN0000737687
gatggccagtaacggcgtca

SEQ ID NO: 7172 - DNA, 20 bp, Artificial Sequence
  sgRNA
  BRDN0000737681
gattacggggttccgtaact

SEQ ID NO: 7173 - DNA, 20 bp, Artificial Sequence
  sgRNA
  BRDN0000737529
gattcattatcggcatacgg

SEQ ID NO: 7174 - DNA, 20 bp, Artificial Sequence
  sgRNA
  BRDN0000738316
gattccgtatagtaatcgag

SEQ ID NO: 7175 - DNA, 20 bp, Artificial Sequence
  sgRNA
  BRDN0000737648
gattgagaagccgcggtatc

SEQ ID NO: 7176 - DNA, 20 bp, Artificial Sequence
  sgRNA
  BRDN0000738194
gattggacggtcgcaggata

SEQ ID NO: 7177 - DNA, 20 bp, Artificial Sequence
  sgRNA
  BRDN0000738250
gatttctcgtatcggataac

SEQ ID NO: 7178 - DNA, 20 bp, Artificial Sequence
  sgRNA
  BRDN0000737564
gcaaaaagcggacacgcgac

SEQ ID NO: 7179 - DNA, 20 bp, Artificial Sequence
  sgRNA
  BRDN0000737497
gcaaataggtcggagcgtgt

SEQ ID NO: 7180 - DNA, 20 bp, Artificial Sequence
  sgRNA
  BRDN0000738140
gcaacccacggacggcaccg

SEQ ID NO: 7181 - DNA, 20 bp, Artificial Sequence
  sgRNA
  BRDN0000737908
gcaacggacagtcatcgaac

SEQ ID NO: 7182 - DNA, 20 bp, Artificial Sequence
  sgRNA
  BRDN0000738275
gcaatagtcgcacgggtgat

SEQ ID NO: 7183 - DNA, 20 bp, Artificial Sequence
  sgRNA
  BRDN0000737458
gcaattctgcaacgcacgtc

SEQ ID NO: 7184 - DNA, 20 bp, Artificial Sequence
  sgRNA
  BRDN0000737678
gcacctctagcgcgctcggc

SEQ ID NO: 7185 - DNA, 20 bp, Artificial Sequence
  sgRNA
  BRDN0000737989
gcacgaacccgttcgtatgg

SEQ ID NO: 7186 - DNA, 20 bp, Artificial Sequence
  sgRNA
  BRDN0000737489
gcagagcgtaatcggcatcg

SEQ ID NO: 7187 - DNA, 20 bp, Artificial Sequence
  sgRNA
  BRDN0000738180
gcagggttattccgcttcta

SEQ ID NO: 7188 - DNA, 20 bp, Artificial Sequence
  sgRNA
  BRDN0000738171
gcaggtaggctcgatacttg

SEQ ID NO: 7189 - DNA, 20 bp, Artificial Sequence
  sgRNA
  BRDN0000737858
gcataacggccgagcaccac

SEQ ID NO: 7190 - DNA, 20 bp, Artificial Sequence
  sgRNA
  BRDN0000738280
gcatgcgctcgcgtggactg

SEQ ID NO: 7191 - DNA, 20 bp, Artificial Sequence
  sgRNA
  BRDN0000738202
gcattaagacgcccacatat

SEQ ID NO: 7192 - DNA, 20 bp, Artificial Sequence
  sgRNA
  BRDN0000738137
gcattcccgcttacgtaatt

SEQ ID NO: 7193 - DNA, 20 bp, Artificial Sequence
  sgRNA
  BRDN0000737792
gcattcttgagctccgcgcc

SEQ ID NO: 7194 - DNA, 20 bp, Artificial Sequence
  sgRNA
  BRDN0000738162
gcattggtgctcgcgcgttc

SEQ ID NO: 7195 - DNA, 20 bp, Artificial Sequence
  sgRNA
  BRDN0000738142
gccacgacctgcgaataatt

SEQ ID NO: 7196 - DNA, 20 bp, Artificial Sequence
  sgRNA
  BRDN0000737625
gccactccgctcgttctaga

SEQ ID NO: 7197 - DNA, 20 bp, Artificial Sequence
  sgRNA
  BRDN0000738308
gccagcctcggtataactcg

SEQ ID NO: 7198 - DNA, 20 bp, Artificial Sequence
  sgRNA
  BRDN0000737509
gccatagccaatcgctagtt

SEQ ID NO: 7199 - DNA, 20 bp, Artificial Sequence
  sgRNA
  BRDN0000738134
gcccatgacgcgtgttagta

SEQ ID NO: 7200 - DNA, 20 bp, Artificial Sequence
  sgRNA
  BRDN0000737921
gcccgacctccacgtaaatc

SEQ ID NO: 7201 - DNA, 20 bp, Artificial Sequence
  sgRNA
  BRDN0000738215
gcccgagcggattcaccgcg

SEQ ID NO: 7202 - DNA, 20 bp, Artificial Sequence
  sgRNA
  BRDN0000737661
gcccgatagaattacccatt

SEQ ID NO: 7203 - DNA, 20 bp, Artificial Sequence
  sgRNA
  BRDN0000738066
gcccgttgtgagcggcatgc

SEQ ID NO: 7204 - DNA, 20 bp, Artificial Sequence
  sgRNA
  BRDN0000737662
gccctcgagctcacgatgag

SEQ ID NO: 7205 - DNA, 20 bp, Artificial Sequence
  sgRNA
  BRDN0000737931
gccgaatcgcgttattccaa

SEQ ID NO: 7206 - DNA, 20 bp, Artificial Sequence
  sgRNA
  BRDN0000737925
gccgaccaacgatgaccacg

SEQ ID NO: 7207 - DNA, 20 bp, Artificial Sequence
  sgRNA
  BRDN0000737893
gccgagaggcgtaagcgcga

SEQ ID NO: 7208 - DNA, 20 bp, Artificial Sequence
  sgRNA
  BRDN0000738281
gccgcaacgttagatgtata

SEQ ID NO: 7209 - DNA, 20 bp, Artificial Sequence
  sgRNA
  BRDN0000737490
gccgcgccataatatgccat

SEQ ID NO: 7210 - DNA, 20 bp, Artificial Sequence
  sgRNA
  BRDN0000737615
gccgctcttgataacgacgc

SEQ ID NO: 7211 - DNA, 20 bp, Artificial Sequence
  sgRNA
  BRDN0000737670
gccgtaagcgggccggttga

SEQ ID NO: 7212 - DNA, 20 bp, Artificial Sequence
  sgRNA
  BRDN0000738257
gccgttggaaaactccggcc

SEQ ID NO: 7213 - DNA, 20 bp, Artificial Sequence
  sgRNA
  BRDN0000737682
gcctatgtgaatcgcgaatt

SEQ ID NO: 7214 - DNA, 20 bp, Artificial Sequence
  sgRNA
  BRDN0000737836
gccttcctcgcagacccgac

SEQ ID NO: 7215 - DNA, 20 bp, Artificial Sequence
  sgRNA
  BRDN0000737997
gccttttccgcccgttcaag

SEQ ID NO: 7216 - DNA, 20 bp, Artificial Sequence
  sgRNA
  BRDN0000738365
gcgacaagcgttgagttcgc

SEQ ID NO: 7217 - DNA, 20 bp, Artificial Sequence
  sgRNA
  BRDN0000737485
gcgacgtgtatcgatcactc

SEQ ID NO: 7218 - DNA, 20 bp, Artificial Sequence
  sgRNA
  BRDN0000737935
gcgagcgctatcccggtgga

SEQ ID NO: 7219 - DNA, 20 bp, Artificial Sequence
  sgRNA
  BRDN0000737380
gcgaggtattcggctccgcg

SEQ ID NO: 7220 - DNA, 20 bp, Artificial Sequence
  sgRNA
  BRDN0000738031
gcgagttatttcgctatagg

SEQ ID NO: 7221 - DNA, 20 bp, Artificial Sequence
  sgRNA
  BRDN0000737981
gcgatcgccggtatagcttt

SEQ ID NO: 7222 - DNA, 20 bp, Artificial Sequence
  sgRNA
  BRDN0000738293
gcgattatcagtagtccacg

SEQ ID NO: 7223 - DNA, 20 bp, Artificial Sequence
  sgRNA
  BRDN0000738332
gcgcctagggttccgactca

SEQ ID NO: 7224 - DNA, 20 bp, Artificial Sequence
  sgRNA
  BRDN0000737425
gcgcgagggcaccgacaagt

SEQ ID NO: 7225 - DNA, 20 bp, Artificial Sequence
  sgRNA
  BRDN0000737843
gcgcgagtgccaaacgagtg

SEQ ID NO: 7226 - DNA, 20 bp, Artificial Sequence
  sgRNA
  BRDN0000738204
gcgcgcgtggatcacccgca

SEQ ID NO: 7227 - DNA, 20 bp, Artificial Sequence
  sgRNA
  BRDN0000737538
gcgcgtacatataaataggt

SEQ ID NO: 7228 - DNA, 20 bp, Artificial Sequence
  sgRNA
  BRDN0000738323
gcgctactcccaccgatgtt

SEQ ID NO: 7229 - DNA, 20 bp, Artificial Sequence
  sgRNA
  BRDN0000737965
gcgctcgaacaaacatggtc

SEQ ID NO: 7230 - DNA, 20 bp, Artificial Sequence
  sgRNA
  BRDN0000738328
gcgctcgttcgagacgatct

SEQ ID NO: 7231 - DNA, 20 bp, Artificial Sequence
  sgRNA
  BRDN0000737453
gcggatctgacggttactta

SEQ ID NO: 7232 - DNA, 20 bp, Artificial Sequence
  sgRNA
  BRDN0000737555
gcggcccgtgaccgttcaat

SEQ ID NO: 7233 - DNA, 20 bp, Artificial Sequence
  sgRNA
  BRDN0000738017
gcgggacccccggtatagtc

SEQ ID NO: 7234 - DNA, 20 bp, Artificial Sequence
  sgRNA
  BRDN0000737399
gcggttaccgcgaaaaccat

SEQ ID NO: 7235 - DNA, 20 bp, Artificial Sequence
  sgRNA
  BRDN0000737735
gcgtacctatcgataaacca

SEQ ID NO: 7236 - DNA, 20 bp, Artificial Sequence
  sgRNA
  BRDN0000737424
gcgtatctaccctaccgccg

SEQ ID NO: 7237 - DNA, 20 bp, Artificial Sequence
  sgRNA
  BRDN0000737742
gcgtgacgcgatcaaacggt

SEQ ID NO: 7238 - DNA, 20 bp, Artificial Sequence
  sgRNA
  BRDN0000738278
gcgtgacgtcccaccctgag

SEQ ID NO: 7239 - DNA, 20 bp, Artificial Sequence
  sgRNA
  BRDN0000738359
gcgtgagattcgttgctcga

SEQ ID NO: 7240 - DNA, 20 bp, Artificial Sequence
  sgRNA
  BRDN0000737572
gcgtgccatgggaggccgtt

SEQ ID NO: 7241 - DNA, 20 bp, Artificial Sequence
  sgRNA
  BRDN0000737949
gcgtggagttcgtcgctctt

SEQ ID NO: 7242 - DNA, 20 bp, Artificial Sequence
  sgRNA
  BRDN0000738355
gcgtggtactcacatcgcga

SEQ ID NO: 7243 - DNA, 20 bp, Artificial Sequence
  sgRNA
  BRDN0000738267
gctaaaaacaaccggcgcgg

SEQ ID NO: 7244 - DNA, 20 bp, Artificial Sequence
  sgRNA
  BRDN0000737710
gctaaacgtattttacgggc

SEQ ID NO: 7245 - DNA, 20 bp, Artificial Sequence
  sgRNA
  BRDN0000737708
gctaagattcatccgaacac

SEQ ID NO: 7246 - DNA, 20 bp, Artificial Sequence
  sgRNA
  BRDN0000738114
gctaatcggtactactccgg

SEQ ID NO: 7247 - DNA, 20 bp, Artificial Sequence
  sgRNA
  BRDN0000737456
gctacagatttgcgttcgag

SEQ ID NO: 7248 - DNA, 20 bp, Artificial Sequence
  sgRNA
  BRDN0000737909
gctagcgttcagcccgatgt

SEQ ID NO: 7249 - DNA, 20 bp, Artificial Sequence
  sgRNA
  BRDN0000737676
gctagttctcccgggcgaaa

SEQ ID NO: 7250 - DNA, 20 bp, Artificial Sequence
  sgRNA
  BRDN0000737967
gctattccgctcgtcaattt

SEQ ID NO: 7251 - DNA, 20 bp, Artificial Sequence
  sgRNA
  BRDN0000737930
gctcatactgatgaacgtcc

SEQ ID NO: 7252 - DNA, 20 bp, Artificial Sequence
  sgRNA
  BRDN0000738304
gctccaggtgcgagataggc

SEQ ID NO: 7253 - DNA, 20 bp, Artificial Sequence
  sgRNA
  BRDN0000738226
gctcgaaagtacgcttcctt

SEQ ID NO: 7254 - DNA, 20 bp, Artificial Sequence
  sgRNA
  BRDN0000737944
gctcgctgatgtgtaatccg

SEQ ID NO: 7255 - DNA, 20 bp, Artificial Sequence
  sgRNA
  BRDN0000737409
gctcggaccttttagacgtc

SEQ ID NO: 7256 - DNA, 20 bp, Artificial Sequence
  sgRNA
  BRDN0000737575
gctgattagacccggcgtaa

SEQ ID NO: 7257 - DNA, 20 bp, Artificial Sequence
  sgRNA
  BRDN0000737854
gcttacctactccgccccgc

SEQ ID NO: 7258 - DNA, 20 bp, Artificial Sequence
  sgRNA
  BRDN0000737815
gcttatcgtcatgcgggtga

SEQ ID NO: 7259 - DNA, 20 bp, Artificial Sequence
  sgRNA
  BRDN0000737785
gcttatcgttccgctacgat

SEQ ID NO: 7260 - DNA, 20 bp, Artificial Sequence
  sgRNA
  BRDN0000737746
gcttcattattaaccggcgt

SEQ ID NO: 7261 - DNA, 20 bp, Artificial Sequence
  sgRNA
  BRDN0000738119
gcttcgaccacgggtactgc

SEQ ID NO: 7262 - DNA, 20 bp, Artificial Sequence
  sgRNA
  BRDN0000738073
gcttcggaggctacgtagta

SEQ ID NO: 7263 - DNA, 20 bp, Artificial Sequence
  sgRNA
  BRDN0000737389
gcttctactcgcaacgtatt

SEQ ID NO: 7264 - DNA, 20 bp, Artificial Sequence
  sgRNA
  BRDN0000738116
gcttgaggcaacgcgactga

SEQ ID NO: 7265 - DNA, 20 bp, Artificial Sequence
  sgRNA
  BRDN0000737581
gcttgtaatctaaagacgcg

SEQ ID NO: 7266 - DNA, 20 bp, Artificial Sequence
  sgRNA
  BRDN0000737381
gctttcacggaggttcgacg

SEQ ID NO: 7267 - DNA, 20 bp, Artificial Sequence
  sgRNA
  BRDN0000737887
ggaaacgttacattcgacgc

SEQ ID NO: 7268 - DNA, 20 bp, Artificial Sequence
  sgRNA
  BRDN0000738019
ggaaactcttgctcgacacg

SEQ ID NO: 7269 - DNA, 20 bp, Artificial Sequence
  sgRNA
  BRDN0000737897
ggacactcgccgaccccact

SEQ ID NO: 7270 - DNA, 20 bp, Artificial Sequence
  sgRNA
  BRDN0000737526
ggaccaatgttaccgtaggt

SEQ ID NO: 7271 - DNA, 20 bp, Artificial Sequence
  sgRNA
  BRDN0000737479
ggacggatgggacgactagt

SEQ ID NO: 7272 - DNA, 20 bp, Artificial Sequence
  sgRNA
  BRDN0000737524
ggacgtagattagggcgtaa

SEQ ID NO: 7273 - DNA, 20 bp, Artificial Sequence
  sgRNA
  BRDN0000737457
ggactgaaaccgatagtatc

SEQ ID NO: 7274 - DNA, 20 bp, Artificial Sequence
  sgRNA
  BRDN0000737622
ggagtctcacgcaattagcg

SEQ ID NO: 7275 - DNA, 20 bp, Artificial Sequence
  sgRNA
  BRDN0000738176
ggagttcaagcgtaacttcg

SEQ ID NO: 7276 - DNA, 20 bp, Artificial Sequence
  sgRNA
  BRDN0000737945
ggatacatcggcgcgctagt

SEQ ID NO: 7277 - DNA, 20 bp, Artificial Sequence
  sgRNA
  BRDN0000737498
ggatagcccggttggtgcgt

SEQ ID NO: 7278 - DNA, 20 bp, Artificial Sequence
  sgRNA
  BRDN0000737764
ggatattcgcgcggtcttca

SEQ ID NO: 7279 - DNA, 20 bp, Artificial Sequence
  sgRNA
  BRDN0000737578
ggatcgatccgaggaacgtg

SEQ ID NO: 7280 - DNA, 20 bp, Artificial Sequence
  sgRNA
  BRDN0000738206
ggattcgtgcgggagatacg

SEQ ID NO: 7281 - DNA, 20 bp, Artificial Sequence
  sgRNA
  BRDN0000737620
ggattgacgagacgatatcg

SEQ ID NO: 7282 - DNA, 20 bp, Artificial Sequence
  sgRNA
  BRDN0000737966
ggcaacgcacgctgggttgt

SEQ ID NO: 7283 - DNA, 20 bp, Artificial Sequence
  sgRNA
  BRDN0000737954
ggcaccgcgtttattgcact

SEQ ID NO: 7284 - DNA, 20 bp, Artificial Sequence
  sgRNA
  BRDN0000737790
ggcaccgttcggaaaccgac

SEQ ID NO: 7285 - DNA, 20 bp, Artificial Sequence
  sgRNA
  BRDN0000738276
ggcagcctaatcagtcgagg

SEQ ID NO: 7286 - DNA, 20 bp, Artificial Sequence
  sgRNA
  BRDN0000738374
ggccagtgtggccgttacgc

SEQ ID NO: 7287 - DNA, 20 bp, Artificial Sequence
  sgRNA
  BRDN0000737606
ggcccaacgaaactagcgtg

SEQ ID NO: 7288 - DNA, 20 bp, Artificial Sequence
  sgRNA
  BRDN0000738356
ggcccgaagggtcacaagcg

SEQ ID NO: 7289 - DNA, 20 bp, Artificial Sequence
  sgRNA
  BRDN0000737817
ggcgctactgtaatgacggt

SEQ ID NO: 7290 - DNA, 20 bp, Artificial Sequence
  sgRNA
  BRDN0000738270
ggcgggttaggccccgtttt

SEQ ID NO: 7291 - DNA, 20 bp, Artificial Sequence
  sgRNA
  BRDN0000738371
ggcgtcgtaacaagaacttg

SEQ ID NO: 7292 - DNA, 20 bp, Artificial Sequence
  sgRNA
  BRDN0000737560
ggcttatagacgagactcga

SEQ ID NO: 7293 - DNA, 20 bp, Artificial Sequence
  sgRNA
  BRDN0000737573
ggctttacgtaaggagcgta

SEQ ID NO: 7294 - DNA, 20 bp, Artificial Sequence
  sgRNA
  BRDN0000737584
gggacgctcatcgagtgacg

SEQ ID NO: 7295 - DNA, 20 bp, Artificial Sequence
  sgRNA
  BRDN0000738238
gggcaacgtcatctggcgac

SEQ ID NO: 7296 - DNA, 20 bp, Artificial Sequence
  sgRNA
  BRDN0000737924
gggccggcactctgtcggac

SEQ ID NO: 7297 - DNA, 20 bp, Artificial Sequence
  sgRNA
  BRDN0000738022
gggcgcgtcatagacacacg

SEQ ID NO: 7298 - DNA, 20 bp, Artificial Sequence
  sgRNA
  BRDN0000737704
gggcgggacgtaatattatg

SEQ ID NO: 7299 - DNA, 20 bp, Artificial Sequence
  sgRNA
  BRDN0000738295
gggctagtgcgttgttacga

SEQ ID NO: 7300 - DNA, 20 bp, Artificial Sequence
  sgRNA
  BRDN0000737407
ggggatggccttacgtcgcg

SEQ ID NO: 7301 - DNA, 20 bp, Artificial Sequence
  sgRNA
  BRDN0000737730
ggggggtctaataccgattg

SEQ ID NO: 7302 - DNA, 20 bp, Artificial Sequence
  sgRNA
  BRDN0000737430
ggggtaggcctaattacgga

SEQ ID NO: 7303 - DNA, 20 bp, Artificial Sequence
  sgRNA
  BRDN0000738237
ggggttggatacgcgattta

SEQ ID NO: 7304 - DNA, 20 bp, Artificial Sequence
  sgRNA
  BRDN0000738330
gggtagcaccccgccgacac

SEQ ID NO: 7305 - DNA, 20 bp, Artificial Sequence
  sgRNA
  BRDN0000738306
gggtcgcaccccaatagctg

SEQ ID NO: 7306 - DNA, 20 bp, Artificial Sequence
  sgRNA
  BRDN0000737436
gggtgcacacgccggcctat

SEQ ID NO: 7307 - DNA, 20 bp, Artificial Sequence
  sgRNA
  BRDN0000738088
ggtaaaaagcgtaacgagta

SEQ ID NO: 7308 - DNA, 20 bp, Artificial Sequence
  sgRNA
  BRDN0000738290
ggtaacataggcggcgatct

SEQ ID NO: 7309 - DNA, 20 bp, Artificial Sequence
  sgRNA
  BRDN0000737580
ggtcaaagcgatgttagccg

SEQ ID NO: 7310 - DNA, 20 bp, Artificial Sequence
  sgRNA
  BRDN0000737956
ggtcgctcgatttcatttaa

SEQ ID NO: 7311 - DNA, 20 bp, Artificial Sequence
  sgRNA
  BRDN0000738343
ggtctagataatcttaccga

SEQ ID NO: 7312 - DNA, 20 bp, Artificial Sequence
  sgRNA
  BRDN0000738172
ggtctcgtaatgtcctatat

SEQ ID NO: 7313 - DNA, 20 bp, Artificial Sequence
  sgRNA
  BRDN0000737551
ggtctgtccgttgcgaccac

SEQ ID NO: 7314 - DNA, 20 bp, Artificial Sequence
  sgRNA
  BRDN0000737500
ggtgcagtccgtttagtcgg

SEQ ID NO: 7315 - DNA, 20 bp, Artificial Sequence
  sgRNA
  BRDN0000737937
ggtgtggaccgcttttacgc

SEQ ID NO: 7316 - DNA, 20 bp, Artificial Sequence
  sgRNA
  BRDN0000737692
ggttaaaaattaagcggtcc

SEQ ID NO: 7317 - DNA, 20 bp, Artificial Sequence
  sgRNA
  BRDN0000737590
gtacatgcggcaagtcgact

SEQ ID NO: 7318 - DNA, 20 bp, Artificial Sequence
  sgRNA
  BRDN0000737958
gtaccacttatcgaccttgc

SEQ ID NO: 7319 - DNA, 20 bp, Artificial Sequence
  sgRNA
  BRDN0000737762
gtaccatgataaccgtacta

SEQ ID NO: 7320 - DNA, 20 bp, Artificial Sequence
  sgRNA
  BRDN0000738013
gtacgcagggtgtagcgacc

SEQ ID NO: 7321 - DNA, 20 bp, Artificial Sequence
  sgRNA
  BRDN0000738085
gtactgacgttacgttcata

SEQ ID NO: 7322 - DNA, 20 bp, Artificial Sequence
  sgRNA
  BRDN0000737522
gtagacatattgcgtaatcg

SEQ ID NO: 7323 - DNA, 20 bp, Artificial Sequence
  sgRNA
  BRDN0000738145
gtagctgaccgcttaactaa

SEQ ID NO: 7324 - DNA, 20 bp, Artificial Sequence
  sgRNA
  BRDN0000738373
gtagcttcatgtccggtcgg

SEQ ID NO: 7325 - DNA, 20 bp, Artificial Sequence
  sgRNA
  BRDN0000738060
gtaggccgctgatcgaataa

SEQ ID NO: 7326 - DNA, 20 bp, Artificial Sequence
  sgRNA
  BRDN0000737889
gtagtgcgtgtgatgtcggg

SEQ ID NO: 7327 - DNA, 20 bp, Artificial Sequence
  sgRNA
  BRDN0000737408
gtatcctccttacggcccgt

SEQ ID NO: 7328 - DNA, 20 bp, Artificial Sequence
  sgRNA
  BRDN0000737512
gtatcctcgcaatcgttagg

SEQ ID NO: 7329 - DNA, 20 bp, Artificial Sequence
  sgRNA
  BRDN0000737393
gtcaagccgaacgctgccgg

SEQ ID NO: 7330 - DNA, 20 bp, Artificial Sequence
  sgRNA
  BRDN0000738274
gtcacaaaaaacgagcgtta

SEQ ID NO: 7331 - DNA, 20 bp, Artificial Sequence
  sgRNA
  BRDN0000737876
gtcctagatcctatcgggag

SEQ ID NO: 7332 - DNA, 20 bp, Artificial Sequence
  sgRNA
  BRDN0000738127
gtcgattagatgatgcccgg

SEQ ID NO: 7333 - DNA, 20 bp, Artificial Sequence
  sgRNA
  BRDN0000738279
gtcgcgtatcctgacgacac

SEQ ID NO: 7334 - DNA, 20 bp, Artificial Sequence
  sgRNA
  BRDN0000738021
gtcgctcgaactcacgtagc

SEQ ID NO: 7335 - DNA, 20 bp, Artificial Sequence
  sgRNA
  BRDN0000737883
gtcggccgcttaaccctttc

SEQ ID NO: 7336 - DNA, 20 bp, Artificial Sequence
  sgRNA
  BRDN0000737810
gtcggctcatcggaaaatat

SEQ ID NO: 7337 - DNA, 20 bp, Artificial Sequence
  sgRNA
  BRDN0000738311
gtcgtggggcacgatgcgta

SEQ ID NO: 7338 - DNA, 20 bp, Artificial Sequence
  sgRNA
  BRDN0000738178
gtcgttaacgacccggattc

SEQ ID NO: 7339 - DNA, 20 bp, Artificial Sequence
  sgRNA
  BRDN0000737917
gtctaacatcggcgcacgtg

SEQ ID NO: 7340 - DNA, 20 bp, Artificial Sequence
  sgRNA
  BRDN0000737649
gtgatggccacgtccgaacc

SEQ ID NO: 7341 - DNA, 20 bp, Artificial Sequence
  sgRNA
  BRDN0000737480
gtgcaacgactgacccgcgg

SEQ ID NO: 7342 - DNA, 20 bp, Artificial Sequence
  sgRNA
  BRDN0000738129
gtgccagcgtcgattgacgc

SEQ ID NO: 7343 - DNA, 20 bp, Artificial Sequence
  sgRNA
  BRDN0000737728
gtgcctgatagtgtgaagcg

SEQ ID NO: 7344 - DNA, 20 bp, Artificial Sequence
  sgRNA
  BRDN0000738372
gtgcgaattaaccgttagga

SEQ ID NO: 7345 - DNA, 20 bp, Artificial Sequence
  sgRNA
  BRDN0000738354
gtgcgcgcgtatagaaaaaa

SEQ ID NO: 7346 - DNA, 20 bp, Artificial Sequence
  sgRNA
  BRDN0000737665
gtgggctgaccgttctcgac

SEQ ID NO: 7347 - DNA, 20 bp, Artificial Sequence
  sgRNA
  BRDN0000737410
gtggttacgttaacgactac

SEQ ID NO: 7348 - DNA, 20 bp, Artificial Sequence
  sgRNA
  BRDN0000737936
gtgtatgacgagaagcgaag

SEQ ID NO: 7349 - DNA, 20 bp, Artificial Sequence
  sgRNA
  BRDN0000738038
gtgtctttcggtcttacgag

SEQ ID NO: 7350 - DNA, 20 bp, Artificial Sequence
  sgRNA
  BRDN0000737494
gtgtgcctcgacagcgtaag

SEQ ID NO: 7351 - DNA, 20 bp, Artificial Sequence
  sgRNA
  BRDN0000738132
gtgtggtatatccccgtttt

SEQ ID NO: 7352 - DNA, 20 bp, Artificial Sequence
  sgRNA
  BRDN0000738141
gtgttgtccgagaacccgac

SEQ ID NO: 7353 - DNA, 20 bp, Artificial Sequence
  sgRNA
  BRDN0000738370
gttaagtagatcggtgacat

SEQ ID NO: 7354 - DNA, 20 bp, Artificial Sequence
  sgRNA
  BRDN0000737933
gttaatattgtggcccgcac

SEQ ID NO: 7355 - DNA, 20 bp, Artificial Sequence
  sgRNA
  BRDN0000737576
gttacccctttggccggaag

SEQ ID NO: 7356 - DNA, 20 bp, Artificial Sequence
  sgRNA
  BRDN0000737709
gttaccgtgacgataagaat

SEQ ID NO: 7357 - DNA, 20 bp, Artificial Sequence
  sgRNA
  BRDN0000738007
gttacttacctgaccggcaa

SEQ ID NO: 7358 - DNA, 20 bp, Artificial Sequence
  sgRNA
  BRDN0000737938
gttataccacctactatgac

SEQ ID NO: 7359 - DNA, 20 bp, Artificial Sequence
  sgRNA
  BRDN0000737540
gttattgcgccttggccgta

SEQ ID NO: 7360 - DNA, 20 bp, Artificial Sequence
  sgRNA
  BRDN0000737588
gttatttgtctgtcgaaacg

SEQ ID NO: 7361 - DNA, 20 bp, Artificial Sequence
  sgRNA
  BRDN0000737702
gttccggatatatacggtta

SEQ ID NO: 7362 - DNA, 20 bp, Artificial Sequence
  sgRNA
  BRDN0000737953
gttcgcgggggcttctatca

SEQ ID NO: 7363 - DNA, 20 bp, Artificial Sequence
  sgRNA
  BRDN0000737677
gttcggttgcagcttacacg

SEQ ID NO: 7364 - DNA, 20 bp, Artificial Sequence
  sgRNA
  BRDN0000737794
gttcttcaaagacgggcggc

SEQ ID NO: 7365 - DNA, 20 bp, Artificial Sequence
  sgRNA
  BRDN0000737782
gttgcggcgacctagatatc

SEQ ID NO: 7366 - DNA, 20 bp, Artificial Sequence
  sgRNA
  BRDN0000737642
gttgcgtccattccgtcgcc

SEQ ID NO: 7367 - DNA, 20 bp, Artificial Sequence
  sgRNA
  BRDN0000737712
gttgcgtgtgtccgtacaaa

SEQ ID NO: 7368 - DNA, 20 bp, Artificial Sequence
  sgRNA
  BRDN0000737586
gtttcagcgcgagttgcgcg

SEQ ID NO: 7369 - DNA, 20 bp, Artificial Sequence
  sgRNA
  BRDN0000737803
gtttcaggaacgacggcgag

SEQ ID NO: 7370 - DNA, 20 bp, Artificial Sequence
  sgRNA
  BRDN0000737515
gtttcccgggactgtcgcgt

SEQ ID NO: 7371 - DNA, 20 bp, Artificial Sequence
  sgRNA
  BRDN0000737435
gtttgcgagtcaaagtacgc

SEQ ID NO: 7372 - DNA, 20 bp, Artificial Sequence
  sgRNA
  BRDN0000738369
taaaaacgctggcggcctag

SEQ ID NO: 7373 - DNA, 20 bp, Artificial Sequence
  sgRNA
  BRDN0000737427
taaaaccgatcacgatacga

SEQ ID NO: 7374 - DNA, 20 bp, Artificial Sequence
  sgRNA
  BRDN0000737541
taaaagtggtgcgtcgtcgt

SEQ ID NO: 7375 - DNA, 20 bp, Artificial Sequence
  sgRNA
  BRDN0000737543
taaacgattcaccgataaca

SEQ ID NO: 7376 - DNA, 20 bp, Artificial Sequence
  sgRNA
  BRDN0000737855
taacacgcactcacgtccgg

SEQ ID NO: 7377 - DNA, 20 bp, Artificial Sequence
  sgRNA
  BRDN0000737508
taacagcttccgcgtaatat

SEQ ID NO: 7378 - DNA, 20 bp, Artificial Sequence
  sgRNA
  BRDN0000737813
taacccttgatcaaccgata

SEQ ID NO: 7379 - DNA, 20 bp, Artificial Sequence
  sgRNA
  BRDN0000737577
taacgttatgtcaaacgctc

SEQ ID NO: 7380 - DNA, 20 bp, Artificial Sequence
  sgRNA
  BRDN0000738076
taactctaatgcgttccaag

SEQ ID NO: 7381 - DNA, 20 bp, Artificial Sequence
  sgRNA
  BRDN0000737895
taagactgggtgtcccgcgt

SEQ ID NO: 7382 - DNA, 20 bp, Artificial Sequence
  sgRNA
  BRDN0000737518
taagcggcgtcatgtcgccc

SEQ ID NO: 7383 - DNA, 20 bp, Artificial Sequence
  sgRNA
  BRDN0000738233
taagtgacacttcgtatcgt

SEQ ID NO: 7384 - DNA, 20 bp, Artificial Sequence
  sgRNA
  BRDN0000737674
taataaactatgtcccgccg

SEQ ID NO: 7385 - DNA, 20 bp, Artificial Sequence
  sgRNA
  BRDN0000737630
taatgagtaacgctcatcgg

SEQ ID NO: 7386 - DNA, 20 bp, Artificial Sequence
  sgRNA
  BRDN0000737819
taatgcgaatgcgacctctc

SEQ ID NO: 7387 - DNA, 20 bp, Artificial Sequence
  sgRNA
  BRDN0000737486
taatggaagatgcgcgatac

SEQ ID NO: 7388 - DNA, 20 bp, Artificial Sequence
  sgRNA
  BRDN0000738024
taatggcacttaccgggtct

SEQ ID NO: 7389 - DNA, 20 bp, Artificial Sequence
  sgRNA
  BRDN0000737894
taattcgcaactcggatcat

SEQ ID NO: 7390 - DNA, 20 bp, Artificial Sequence
  sgRNA
  BRDN0000738255
taattctttagtacgtgcaa

SEQ ID NO: 7391 - DNA, 20 bp, Artificial Sequence
  sgRNA
  BRDN0000737780
tacacgccctaagctagtaa

SEQ ID NO: 7392 - DNA, 20 bp, Artificial Sequence
  sgRNA
  BRDN0000737390
tacagttatacgtcgcggtg

SEQ ID NO: 7393 - DNA, 20 bp, Artificial Sequence
  sgRNA
  BRDN0000738346
tacatcgaacaaccaaccga

SEQ ID NO: 7394 - DNA, 20 bp, Artificial Sequence
  sgRNA
  BRDN0000738123
tacatgcggttgacacgttc

SEQ ID NO: 7395 - DNA, 20 bp, Artificial Sequence
  sgRNA
  BRDN0000737618
tacccctctgcgatgccggt

SEQ ID NO: 7396 - DNA, 20 bp, Artificial Sequence
  sgRNA
  BRDN0000737462
taccccttgaggggcgcata

SEQ ID NO: 7397 - DNA, 20 bp, Artificial Sequence
  sgRNA
  BRDN0000737778
tacgacatcgcatggtaacg

SEQ ID NO: 7398 - DNA, 20 bp, Artificial Sequence
  sgRNA
  BRDN0000738131
tacgacgaggacgcatcgag

SEQ ID NO: 7399 - DNA, 20 bp, Artificial Sequence
  sgRNA
  BRDN0000738097
tacgctcacttctgcgaagg

SEQ ID NO: 7400 - DNA, 20 bp, Artificial Sequence
  sgRNA
  BRDN0000738334
tacggacgtcgaattgagca

SEQ ID NO: 7401 - DNA, 20 bp, Artificial Sequence
  sgRNA
  BRDN0000737898
tacgtctgcgcaaatagaat

SEQ ID NO: 7402 - DNA, 20 bp, Artificial Sequence
  sgRNA
  BRDN0000737696
tactgcgtaccgcagtaagc

SEQ ID NO: 7403 - DNA, 20 bp, Artificial Sequence
  sgRNA
  BRDN0000737602
tacttaccgaccgacaaacg

SEQ ID NO: 7404 - DNA, 20 bp, Artificial Sequence
  sgRNA
  BRDN0000737691
tacttaggtccgcgtaaagc

SEQ ID NO: 7405 - DNA, 20 bp, Artificial Sequence
  sgRNA
  BRDN0000737783
tagacgtccaccgactctga

SEQ ID NO: 7406 - DNA, 20 bp, Artificial Sequence
  sgRNA
  BRDN0000738091
tagagcagatcccctcaacg

SEQ ID NO: 7407 - DNA, 20 bp, Artificial Sequence
  sgRNA
  BRDN0000737468
tagatggtgcttctgtcgcg

SEQ ID NO: 7408 - DNA, 20 bp, Artificial Sequence
  sgRNA
  BRDN0000737447
tagcccgtcgagtactcccc

SEQ ID NO: 7409 - DNA, 20 bp, Artificial Sequence
  sgRNA
  BRDN0000737841
tagccgagttcacgccagta

SEQ ID NO: 7410 - DNA, 20 bp, Artificial Sequence
  sgRNA
  BRDN0000737652
tagctgtttacgccgacctg

SEQ ID NO: 7411 - DNA, 20 bp, Artificial Sequence
  sgRNA
  BRDN0000737638
taggccgctcaggccgcact

SEQ ID NO: 7412 - DNA, 20 bp, Artificial Sequence
  sgRNA
  BRDN0000737598
taggcggacggttacatata

SEQ ID NO: 7413 - DNA, 20 bp, Artificial Sequence
  sgRNA
  BRDN0000737920
taggggtgcgcattagacta

SEQ ID NO: 7414 - DNA, 20 bp, Artificial Sequence
  sgRNA
  BRDN0000737973
taggtggcgcccaatcggac

SEQ ID NO: 7415 - DNA, 20 bp, Artificial Sequence
  sgRNA
  BRDN0000738268
tagtaaaaaattcgccctcc

SEQ ID NO: 7416 - DNA, 20 bp, Artificial Sequence
  sgRNA
  BRDN0000738125
tagtaggccggagcgcatcc

SEQ ID NO: 7417 - DNA, 20 bp, Artificial Sequence
  sgRNA
  BRDN0000737796
tagtaggttgatcgcgtcgc

SEQ ID NO: 7418 - DNA, 20 bp, Artificial Sequence
  sgRNA
  BRDN0000737726
tagtcagtcggcctccgtgc

SEQ ID NO: 7419 - DNA, 20 bp, Artificial Sequence
  sgRNA
  BRDN0000737415
tagtcctagttagattcgcg

SEQ ID NO: 7420 - DNA, 20 bp, Artificial Sequence
  sgRNA
  BRDN0000738157
tagtgcgaacagtcacggcg

SEQ ID NO: 7421 - DNA, 20 bp, Artificial Sequence
  sgRNA
  BRDN0000738195
tagtgttgtgagcgtcgtac

SEQ ID NO: 7422 - DNA, 20 bp, Artificial Sequence
  sgRNA
  BRDN0000737664
tagttaaccgtaaagtgggc

SEQ ID NO: 7423 - DNA, 20 bp, Artificial Sequence
  sgRNA
  BRDN0000738093
tagttatctgcaacgcatag

SEQ ID NO: 7424 - DNA, 20 bp, Artificial Sequence
  sgRNA
  BRDN0000737747
tatactcgcctgtcacagcg

SEQ ID NO: 7425 - DNA, 20 bp, Artificial Sequence
  sgRNA
  BRDN0000737904
tatcccgatccggaaactag

SEQ ID NO: 7426 - DNA, 20 bp, Artificial Sequence
  sgRNA
  BRDN0000737465
tatcgaactgcacacgcaac

SEQ ID NO: 7427 - DNA, 20 bp, Artificial Sequence
  sgRNA
  BRDN0000737520
tatctaatcgcggagtcgta

SEQ ID NO: 7428 - DNA, 20 bp, Artificial Sequence
  sgRNA
  BRDN0000737739
tatctctggatgccgtcggt

SEQ ID NO: 7429 - DNA, 20 bp, Artificial Sequence
  sgRNA
  BRDN0000737922
tatgaaacatctcggcgacg

SEQ ID NO: 7430 - DNA, 20 bp, Artificial Sequence
  sgRNA
  BRDN0000738077
tatgaacctccggatcggtg

SEQ ID NO: 7431 - DNA, 20 bp, Artificial Sequence
  sgRNA
  BRDN0000737910
tatgaactaggcgtaaacgg

SEQ ID NO: 7432 - DNA, 20 bp, Artificial Sequence
  sgRNA
  BRDN0000738028
tatgacacacaatctgcgac

SEQ ID NO: 7433 - DNA, 20 bp, Artificial Sequence
  sgRNA
  BRDN0000737667
tatgactgcacgactcgcta

SEQ ID NO: 7434 - DNA, 20 bp, Artificial Sequence
  sgRNA
  BRDN0000737979
tatgatcgtatggcccttcc

SEQ ID NO: 7435 - DNA, 20 bp, Artificial Sequence
  sgRNA
  BRDN0000737940
tatgccatatgcccgttttt

SEQ ID NO: 7436 - DNA, 20 bp, Artificial Sequence
  sgRNA
  BRDN0000737438
tcaaacgcccgggcgcccca

SEQ ID NO: 7437 - DNA, 20 bp, Artificial Sequence
  sgRNA
  BRDN0000737654
tcaactatgaaccgccgtgc

SEQ ID NO: 7438 - DNA, 20 bp, Artificial Sequence
  sgRNA
  BRDN0000737718
tcaacttaacctcgagtccg

SEQ ID NO: 7439 - DNA, 20 bp, Artificial Sequence
  sgRNA
  BRDN0000737474
tcaatagttctgcgcgaatt

SEQ ID NO: 7440 - DNA, 20 bp, Artificial Sequence
  sgRNA
  BRDN0000738277
tcaatctgcggtgactcgtt

SEQ ID NO: 7441 - DNA, 20 bp, Artificial Sequence
  sgRNA
  BRDN0000737987
tcaattagtggccgccaagc

SEQ ID NO: 7442 - DNA, 20 bp, Artificial Sequence
  sgRNA
  BRDN0000738273
tcacaacccccgactatcgc

SEQ ID NO: 7443 - DNA, 20 bp, Artificial Sequence
  sgRNA
  BRDN0000737568
tcacacgggatctcgccggt

SEQ ID NO: 7444 - DNA, 20 bp, Artificial Sequence
  sgRNA
  BRDN0000738331
tcacatgacactcgttacga

SEQ ID NO: 7445 - DNA, 20 bp, Artificial Sequence
  sgRNA
  BRDN0000738070
tcacccgcgtatacgacctg

SEQ ID NO: 7446 - DNA, 20 bp, Artificial Sequence
  sgRNA
  BRDN0000737784
tcacgcacgactaagggaat

SEQ ID NO: 7447 - DNA, 20 bp, Artificial Sequence
  sgRNA
  BRDN0000738037
tcactcaaagtgcgtagtcg

SEQ ID NO: 7448 - DNA, 20 bp, Artificial Sequence
  sgRNA
  BRDN0000737673
tcacttcgggcattacgagc

SEQ ID NO: 7449 - DNA, 20 bp, Artificial Sequence
  sgRNA
  BRDN0000737851
tcactttaagcaccccgcgc

SEQ ID NO: 7450 - DNA, 20 bp, Artificial Sequence
  sgRNA
  BRDN0000738283
tcagcagaattgggcccgta

SEQ ID NO: 7451 - DNA, 20 bp, Artificial Sequence
  sgRNA
  BRDN0000737988
tcagctacgatcggacccaa

SEQ ID NO: 7452 - DNA, 20 bp, Artificial Sequence
  sgRNA
  BRDN0000738244
tcagtcagtcggccccctgc

SEQ ID NO: 7453 - DNA, 20 bp, Artificial Sequence
  sgRNA
  BRDN0000737840
tcatattagacaatctccgc

SEQ ID NO: 7454 - DNA, 20 bp, Artificial Sequence
  sgRNA
  BRDN0000737941
tcatctacggtatcgaaagg

SEQ ID NO: 7455 - DNA, 20 bp, Artificial Sequence
  sgRNA
  BRDN0000737495
tcatgcgcctcgtaatacct

SEQ ID NO: 7456 - DNA, 20 bp, Artificial Sequence
  sgRNA
  BRDN0000737846
tcatgttgcgtcgtccgtta

SEQ ID NO: 7457 - DNA, 20 bp, Artificial Sequence
  sgRNA
  BRDN0000737503
tcccccgtacgtgtatgtcg

SEQ ID NO: 7458 - DNA, 20 bp, Artificial Sequence
  sgRNA
  BRDN0000737984
tccccttcgtcggcgccagg

SEQ ID NO: 7459 - DNA, 20 bp, Artificial Sequence
  sgRNA
  BRDN0000737406
tcccgggaggtacggtgtac

SEQ ID NO: 7460 - DNA, 20 bp, Artificial Sequence
  sgRNA
  BRDN0000738104
tccgaacaggcgcgtttctc

SEQ ID NO: 7461 - DNA, 20 bp, Artificial Sequence
  sgRNA
  BRDN0000737756
tccgcggcaacgtttgggtc

SEQ ID NO: 7462 - DNA, 20 bp, Artificial Sequence
  sgRNA
  BRDN0000737546
tccgtacatcgacctattac

SEQ ID NO: 7463 - DNA, 20 bp, Artificial Sequence
  sgRNA
  BRDN0000737636
tccgtaggacgtatatattc

SEQ ID NO: 7464 - DNA, 20 bp, Artificial Sequence
  sgRNA
  BRDN0000738248
tcctacaccaccccggccgt

SEQ ID NO: 7465 - DNA, 20 bp, Artificial Sequence
  sgRNA
  BRDN0000738214
tcctaggcctgatttacccg

SEQ ID NO: 7466 - DNA, 20 bp, Artificial Sequence
  sgRNA
  BRDN0000737455
tcctataattgagcgaacgg

SEQ ID NO: 7467 - DNA, 20 bp, Artificial Sequence
  sgRNA
  BRDN0000738051
tcctccgatcgaccagggta

SEQ ID NO: 7468 - DNA, 20 bp, Artificial Sequence
  sgRNA
  BRDN0000737428
tcctgcgcgatgaccgtcgg

SEQ ID NO: 7469 - DNA, 20 bp, Artificial Sequence
  sgRNA
  BRDN0000737587
tcctgcgttccactcgtact

SEQ ID NO: 7470 - DNA, 20 bp, Artificial Sequence
  sgRNA
  BRDN0000738312
tcgagtcttgactcaacgct

SEQ ID NO: 7471 - DNA, 20 bp, Artificial Sequence
  sgRNA
  BRDN0000738191
tcgatcgtcggcggagcgga

SEQ ID NO: 7472 - DNA, 20 bp, Artificial Sequence
  sgRNA
  BRDN0000737499
tcgcaaaatgcggattccgt

SEQ ID NO: 7473 - DNA, 20 bp, Artificial Sequence
  sgRNA
  BRDN0000738150
tcgcactctaggccgttatt

SEQ ID NO: 7474 - DNA, 20 bp, Artificial Sequence
  sgRNA
  BRDN0000738126
tcgcgaattgctgccgaact

SEQ ID NO: 7475 - DNA, 20 bp, Artificial Sequence
  sgRNA
  BRDN0000737535
tcgctaagccgggtaatact

SEQ ID NO: 7476 - DNA, 20 bp, Artificial Sequence
  sgRNA
  BRDN0000738326
tcgctcattaggagcgctat

SEQ ID NO: 7477 - DNA, 20 bp, Artificial Sequence
  sgRNA
  BRDN0000737807
tcgctccgctagtagtgggt

SEQ ID NO: 7478 - DNA, 20 bp, Artificial Sequence
  sgRNA
  BRDN0000738298
tcgctgagcaacgaagcaac

SEQ ID NO: 7479 - DNA, 20 bp, Artificial Sequence
  sgRNA
  BRDN0000738339
tcgcttctgattgatccacg

SEQ ID NO: 7480 - DNA, 20 bp, Artificial Sequence
  sgRNA
  BRDN0000737680
tcggaattccgcaggccgag

SEQ ID NO: 7481 - DNA, 20 bp, Artificial Sequence
  sgRNA
  BRDN0000738305
tcggactatagcgtgaacgt

SEQ ID NO: 7482 - DNA, 20 bp, Artificial Sequence
  sgRNA
  BRDN0000738068
tcggatcggtacataaagtt

SEQ ID NO: 7483 - DNA, 20 bp, Artificial Sequence
  sgRNA
  BRDN0000738190
tcggattttaatccttacgc

SEQ ID NO: 7484 - DNA, 20 bp, Artificial Sequence
  sgRNA
  BRDN0000737808
tcggcgcagcctaatgtata

SEQ ID NO: 7485 - DNA, 20 bp, Artificial Sequence
  sgRNA
  BRDN0000737916
tcgtaaagtcgcagcgacgt

SEQ ID NO: 7486 - DNA, 20 bp, Artificial Sequence
  sgRNA
  BRDN0000737604
tcgtaagttcgctatatgcc

SEQ ID NO: 7487 - DNA, 20 bp, Artificial Sequence
  sgRNA
  BRDN0000737658
tcgtaccgcacgtgtaagcc

SEQ ID NO: 7488 - DNA, 20 bp, Artificial Sequence
  sgRNA
  BRDN0000737600
tcgtgccggaataaccacta

SEQ ID NO: 7489 - DNA, 20 bp, Artificial Sequence
  sgRNA
  BRDN0000737567
tcgtgcctagctcggttgag

SEQ ID NO: 7490 - DNA, 20 bp, Artificial Sequence
  sgRNA
  BRDN0000737413
tcgtgtctagctatcgagtg

SEQ ID NO: 7491 - DNA, 20 bp, Artificial Sequence
  sgRNA
  BRDN0000737475
tcgttacataccccgcggaa

SEQ ID NO: 7492 - DNA, 20 bp, Artificial Sequence
  sgRNA
  BRDN0000738345
tcgttgtgtcgacatccgca

SEQ ID NO: 7493 - DNA, 20 bp, Artificial Sequence
  sgRNA
  BRDN0000737732
tctacacgcgcgttcaaccg

SEQ ID NO: 7494 - DNA, 20 bp, Artificial Sequence
  sgRNA
  BRDN0000737550
tctaggatactcttaacggg

SEQ ID NO: 7495 - DNA, 20 bp, Artificial Sequence
  sgRNA
  BRDN0000737656
tctatatctagtctcggcgc

SEQ ID NO: 7496 - DNA, 20 bp, Artificial Sequence
  sgRNA
  BRDN0000737405
tctcagttcgtagcgaacga

SEQ ID NO: 7497 - DNA, 20 bp, Artificial Sequence
  sgRNA
  BRDN0000737865
tctccgggccgtgttagacc

SEQ ID NO: 7498 - DNA, 20 bp, Artificial Sequence
  sgRNA
  BRDN0000738192
tctccgtccgaaacggcgac

SEQ ID NO: 7499 - DNA, 20 bp, Artificial Sequence
  sgRNA
  BRDN0000737791
tctcgaataaattttctcgc

SEQ ID NO: 7500 - DNA, 20 bp, Artificial Sequence
  sgRNA
  BRDN0000738168
tctcttcgcgcccgctttgc

SEQ ID NO: 7501 - DNA, 20 bp, Artificial Sequence
  sgRNA
  BRDN0000737559
tctgcaccgcgacttagctt

SEQ ID NO: 7502 - DNA, 20 bp, Artificial Sequence
  sgRNA
  BRDN0000738246
tctggacgcgagatgacggg

SEQ ID NO: 7503 - DNA, 20 bp, Artificial Sequence
  sgRNA
  BRDN0000738175
tcttctagtgcgagttccgc

SEQ ID NO: 7504 - DNA, 20 bp, Artificial Sequence
  sgRNA
  BRDN0000738054
tcttctcgagcgtgcgggcc

SEQ ID NO: 7505 - DNA, 20 bp, Artificial Sequence
  sgRNA
  BRDN0000737716
tcttgactccgacttcgggc

SEQ ID NO: 7506 - DNA, 20 bp, Artificial Sequence
  sgRNA
  BRDN0000737955
tgacaaccgcggtacctcta

SEQ ID NO: 7507 - DNA, 20 bp, Artificial Sequence
  sgRNA
  BRDN0000738050
tgacccgtctcttcgcgcac

SEQ ID NO: 7508 - DNA, 20 bp, Artificial Sequence
  sgRNA
  BRDN0000737860
tgaccctcttaatctccggt

SEQ ID NO: 7509 - DNA, 20 bp, Artificial Sequence
  sgRNA
  BRDN0000737903
tgacgcgcctcggaccaacc

SEQ ID NO: 7510 - DNA, 20 bp, Artificial Sequence
  sgRNA
  BRDN0000737824
tgacgctaaggcccgctaac

SEQ ID NO: 7511 - DNA, 20 bp, Artificial Sequence
  sgRNA
  BRDN0000737760
tgacttgacacgttcgatat

SEQ ID NO: 7512 - DNA, 20 bp, Artificial Sequence
  sgRNA
  BRDN0000737770
tgagaccaatgccgcggaat

SEQ ID NO: 7513 - DNA, 20 bp, Artificial Sequence
  sgRNA
  BRDN0000737960
tgagagcaaggcgcatacgc

SEQ ID NO: 7514 - DNA, 20 bp, Artificial Sequence
  sgRNA
  BRDN0000738074
tgagccggtgcgctctcggt

SEQ ID NO: 7515 - DNA, 20 bp, Artificial Sequence
  sgRNA
  BRDN0000738149
tgagcctttgtggaccgcgg

SEQ ID NO: 7516 - DNA, 20 bp, Artificial Sequence
  sgRNA
  BRDN0000737835
tgagcgctttcccgatccgg

SEQ ID NO: 7517 - DNA, 20 bp, Artificial Sequence
  sgRNA
  BRDN0000738364
tgagggctcaatacttccgc

SEQ ID NO: 7518 - DNA, 20 bp, Artificial Sequence
  sgRNA
  BRDN0000738183
tgaggttaccgccggctttt

SEQ ID NO: 7519 - DNA, 20 bp, Artificial Sequence
  sgRNA
  BRDN0000737724
tgataaacgatgcgaactcg

SEQ ID NO: 7520 - DNA, 20 bp, Artificial Sequence
  sgRNA
  BRDN0000737884
tgatcaacgtcggtggacgg

SEQ ID NO: 7521 - DNA, 20 bp, Artificial Sequence
  sgRNA
  BRDN0000738320
tgatccccgtcccgaagtta

SEQ ID NO: 7522 - DNA, 20 bp, Artificial Sequence
  sgRNA
  BRDN0000737816
tgatgccggtacccgtaact

SEQ ID NO: 7523 - DNA, 20 bp, Artificial Sequence
  sgRNA
  BRDN0000737461
tgatggacgcgatacgttta

SEQ ID NO: 7524 - DNA, 20 bp, Artificial Sequence
  sgRNA
  BRDN0000737725
tgattgggggtcgttcgcca

SEQ ID NO: 7525 - DNA, 20 bp, Artificial Sequence
  sgRNA
  BRDN0000737411
tgcaacgatggttacggtac

SEQ ID NO: 7526 - DNA, 20 bp, Artificial Sequence
  sgRNA
  BRDN0000737444
tgcaccggtacgggcgactc

SEQ ID NO: 7527 - DNA, 20 bp, Artificial Sequence
  sgRNA
  BRDN0000737549
tgcagatcgcgaagcgacta

SEQ ID NO: 7528 - DNA, 20 bp, Artificial Sequence
  sgRNA
  BRDN0000738352
tgcagtagtcgcggataggc

SEQ ID NO: 7529 - DNA, 20 bp, Artificial Sequence
  sgRNA
  BRDN0000738336
tgccctgcgtccgctacgtc

SEQ ID NO: 7530 - DNA, 20 bp, Artificial Sequence
  sgRNA
  BRDN0000737595
tgccgacgcgacgcagcgta

SEQ ID NO: 7531 - DNA, 20 bp, Artificial Sequence
  sgRNA
  BRDN0000738186
tgcctactgtcgttcccgcg

SEQ ID NO: 7532 - DNA, 20 bp, Artificial Sequence
  sgRNA
  BRDN0000738284
tgccttcagtcgaccgttac

SEQ ID NO: 7533 - DNA, 20 bp, Artificial Sequence
  sgRNA
  BRDN0000737775
tgcgcgtcctgttatgaccg

SEQ ID NO: 7534 - DNA, 20 bp, Artificial Sequence
  sgRNA
  BRDN0000737596
tgcggcaatgttaaccctta

SEQ ID NO: 7535 - DNA, 20 bp, Artificial Sequence
  sgRNA
  BRDN0000737700
tgcgtaaaacttgcgctcga

SEQ ID NO: 7536 - DNA, 20 bp, Artificial Sequence
  sgRNA
  BRDN0000738100
tgcgtctcagcttcggctat

SEQ ID NO: 7537 - DNA, 20 bp, Artificial Sequence
  sgRNA
  BRDN0000738057
tgctggccgatacgtgcttg

SEQ ID NO: 7538 - DNA, 20 bp, Artificial Sequence
  sgRNA
  BRDN0000737864
tgcttagggcccttcggcgg

SEQ ID NO: 7539 - DNA, 20 bp, Artificial Sequence
  sgRNA
  BRDN0000738321
tgctttaccgcgttgggtaa

SEQ ID NO: 7540 - DNA, 20 bp, Artificial Sequence
  sgRNA
  BRDN0000737800
tggatccgcttcgcacggcg

SEQ ID NO: 7541 - DNA, 20 bp, Artificial Sequence
  sgRNA
  BRDN0000737675
tggcacggagttgcatacgc

SEQ ID NO: 7542 - DNA, 20 bp, Artificial Sequence
  sgRNA
  BRDN0000737429
tggcccacaaggtgcgatat

SEQ ID NO: 7543 - DNA, 20 bp, Artificial Sequence
  sgRNA
  BRDN0000737513
tggcgctcctgcgcacacga

SEQ ID NO: 7544 - DNA, 20 bp, Artificial Sequence
  sgRNA
  BRDN0000738005
tggcttaatggacagcgcga

SEQ ID NO: 7545 - DNA, 20 bp, Artificial Sequence
  sgRNA
  BRDN0000737839
tgggccatagtggcgcgtga

SEQ ID NO: 7546 - DNA, 20 bp, Artificial Sequence
  sgRNA
  BRDN0000738098
tgggcggttcaaagcgaatt

SEQ ID NO: 7547 - DNA, 20 bp, Artificial Sequence
  sgRNA
  BRDN0000737833
tgggtcctaaacgcggttca

SEQ ID NO: 7548 - DNA, 20 bp, Artificial Sequence
  sgRNA
  BRDN0000737501
tgggttccggccccatgtac

SEQ ID NO: 7549 - DNA, 20 bp, Artificial Sequence
  sgRNA
  BRDN0000738010
tggtaccactcgccgaatct

SEQ ID NO: 7550 - DNA, 20 bp, Artificial Sequence
  sgRNA
  BRDN0000737970
tggttcaccactcgagatcg

SEQ ID NO: 7551 - DNA, 20 bp, Artificial Sequence
  sgRNA
  BRDN0000737838
tggttcgaccaacatggttc

SEQ ID NO: 7552 - DNA, 20 bp, Artificial Sequence
  sgRNA
  BRDN0000738294
tggttggcatgtcgccagcg

SEQ ID NO: 7553 - DNA, 20 bp, Artificial Sequence
  sgRNA
  BRDN0000737721
tgtaacgatctgggcggtct

SEQ ID NO: 7554 - DNA, 20 bp, Artificial Sequence
  sgRNA
  BRDN0000737592
tgtactcgcatagcgggggc

SEQ ID NO: 7555 - DNA, 20 bp, Artificial Sequence
  sgRNA
  BRDN0000737597
tgtatagtcatcgccgtaat

SEQ ID NO: 7556 - DNA, 20 bp, Artificial Sequence
  sgRNA
  BRDN0000737420
tgtatccaccgtgacccggt

SEQ ID NO: 7557 - DNA, 20 bp, Artificial Sequence
  sgRNA
  BRDN0000738227
tgtcccgacgatgtgtaaat

SEQ ID NO: 7558 - DNA, 20 bp, Artificial Sequence
  sgRNA
  BRDN0000737487
tgtcctaccgaatgaaccgt

SEQ ID NO: 7559 - DNA, 20 bp, Artificial Sequence
  sgRNA
  BRDN0000737788
tgtcgccgatggtcagtcgc

SEQ ID NO: 7560 - DNA, 20 bp, Artificial Sequence
  sgRNA
  BRDN0000737466
tgtcggacccattgtcgaac

SEQ ID NO: 7561 - DNA, 20 bp, Artificial Sequence
  sgRNA
  BRDN0000738266
tgtctatgtttggccacgca

SEQ ID NO: 7562 - DNA, 20 bp, Artificial Sequence
  sgRNA
  BRDN0000738069
tgtctgccgcatacgctata

SEQ ID NO: 7563 - DNA, 20 bp, Artificial Sequence
  sgRNA
  BRDN0000737496
tgtgccacgccgctgcaacg

SEQ ID NO: 7564 - DNA, 20 bp, Artificial Sequence
  sgRNA
  BRDN0000738071
tgtgcctacgccattcggct

SEQ ID NO: 7565 - DNA, 20 bp, Artificial Sequence
  sgRNA
  BRDN0000737482
tgtgtaattacgtttcgcgg

SEQ ID NO: 7566 - DNA, 20 bp, Artificial Sequence
  sgRNA
  BRDN0000738261
tgttaatgccaacgggacat

SEQ ID NO: 7567 - DNA, 20 bp, Artificial Sequence
  sgRNA
  BRDN0000737805
tgttcgccctctcacgattg

SEQ ID NO: 7568 - DNA, 20 bp, Artificial Sequence
  sgRNA
  BRDN0000737822
tgtttatgcggaacttccgc

SEQ ID NO: 7569 - DNA, 20 bp, Artificial Sequence
  sgRNA
  BRDN0000738177
ttaacgtctgtgcgcactac

SEQ ID NO: 7570 - DNA, 20 bp, Artificial Sequence
  sgRNA
  BRDN0000737820
ttaactggggggaccggacg

SEQ ID NO: 7571 - DNA, 20 bp, Artificial Sequence
  sgRNA
  BRDN0000737686
ttacagttcataccgtcgcc

SEQ ID NO: 7572 - DNA, 20 bp, Artificial Sequence
  sgRNA
  BRDN0000738259
ttaccgtggtacgtcaggtt

SEQ ID NO: 7573 - DNA, 20 bp, Artificial Sequence
  sgRNA
  BRDN0000737896
ttacgcaaagctgcgatgag

SEQ ID NO: 7574 - DNA, 20 bp, Artificial Sequence
  sgRNA
  BRDN0000737647
ttactgatcagtcggacgca

SEQ ID NO: 7575 - DNA, 20 bp, Artificial Sequence
  sgRNA
  BRDN0000738147
ttacttggtgcaacaaccgg

SEQ ID NO: 7576 - DNA, 20 bp, Artificial Sequence
  sgRNA
  BRDN0000737996
ttagccttgccccgtcatac

SEQ ID NO: 7577 - DNA, 20 bp, Artificial Sequence
  sgRNA
  BRDN0000737663
ttaggacgtgcttccgaggg

SEQ ID NO: 7578 - DNA, 20 bp, Artificial Sequence
  sgRNA
  BRDN0000738026
ttagttcgaccactcctgat

SEQ ID NO: 7579 - DNA, 20 bp, Artificial Sequence
  sgRNA
  BRDN0000737443
ttataccgtcacgagtgccc

SEQ ID NO: 7580 - DNA, 20 bp, Artificial Sequence
  sgRNA
  BRDN0000737506
ttatcgcacaaccccgaaag

SEQ ID NO: 7581 - DNA, 20 bp, Artificial Sequence
  sgRNA
  BRDN0000738198
ttatcgtactagtacgtaca

SEQ ID NO: 7582 - DNA, 20 bp, Artificial Sequence
  sgRNA
  BRDN0000737902
ttatgacctcgatgcgacat

SEQ ID NO: 7583 - DNA, 20 bp, Artificial Sequence
  sgRNA
  BRDN0000737432
ttatgtgcctctcggcgcat

SEQ ID NO: 7584 - DNA, 20 bp, Artificial Sequence
  sgRNA
  BRDN0000738173
ttattggtttcaacggttgt

SEQ ID NO: 7585 - DNA, 20 bp, Artificial Sequence
  sgRNA
  BRDN0000737868
ttatttacgcgctgaacttg

SEQ ID NO: 7586 - DNA, 20 bp, Artificial Sequence
  sgRNA
  BRDN0000737918
ttcaacgacggaagacgcgc

SEQ ID NO: 7587 - DNA, 20 bp, Artificial Sequence
  sgRNA
  BRDN0000737959
ttcaagtgttatggacgcgc

SEQ ID NO: 7588 - DNA, 20 bp, Artificial Sequence
  sgRNA
  BRDN0000737452
ttcaattgttcgcccgaaca

SEQ ID NO: 7589 - DNA, 20 bp, Artificial Sequence
  sgRNA
  BRDN0000737969
ttcatccttcgtagcgcagc

SEQ ID NO: 7590 - DNA, 20 bp, Artificial Sequence
  sgRNA
  BRDN0000737968
ttcatcgcagatcgatttcg

SEQ ID NO: 7591 - DNA, 20 bp, Artificial Sequence
  sgRNA
  BRDN0000737906
ttccagtataccgaattcgc

SEQ ID NO: 7592 - DNA, 20 bp, Artificial Sequence
  sgRNA
  BRDN0000737795
ttccccgcccgtgcggtcat

SEQ ID NO: 7593 - DNA, 20 bp, Artificial Sequence
  sgRNA
  BRDN0000737514
ttcgaagtctaacccgcggg

SEQ ID NO: 7594 - DNA, 20 bp, Artificial Sequence
  sgRNA
  BRDN0000737451
ttcgacgtgcggcgtattgg

SEQ ID NO: 7595 - DNA, 20 bp, Artificial Sequence
  sgRNA
  BRDN0000737758
ttcgactgcgcacgccatga

SEQ ID NO: 7596 - DNA, 20 bp, Artificial Sequence
  sgRNA
  BRDN0000737446
ttcgagacggatacgtctgc

SEQ ID NO: 7597 - DNA, 20 bp, Artificial Sequence
  sgRNA
  BRDN0000738361
ttcgagattttaatagcgca

SEQ ID NO: 7598 - DNA, 20 bp, Artificial Sequence
  sgRNA
  BRDN0000737669
ttcgatataggggacggcgg

SEQ ID NO: 7599 - DNA, 20 bp, Artificial Sequence
  sgRNA
  BRDN0000737422
ttcgccggcgacgaagtgca

SEQ ID NO: 7600 - DNA, 20 bp, Artificial Sequence
  sgRNA
  BRDN0000738213
ttcgcgagtaaggtaggcat

SEQ ID NO: 7601 - DNA, 20 bp, Artificial Sequence
  sgRNA
  BRDN0000737477
ttcggctcaatggcgcgagc

SEQ ID NO: 7602 - DNA, 20 bp, Artificial Sequence
  sgRNA
  BRDN0000738340
ttcggctggtgtgcgttcac

SEQ ID NO: 7603 - DNA, 20 bp, Artificial Sequence
  sgRNA
  BRDN0000738108
ttcgtggccgaaggcgccgc

SEQ ID NO: 7604 - DNA, 20 bp, Artificial Sequence
  sgRNA
  BRDN0000737766
ttctccataccgtaactccg

SEQ ID NO: 7605 - DNA, 20 bp, Artificial Sequence
  sgRNA
  BRDN0000737985
ttctgattagatacgtacga

SEQ ID NO: 7606 - DNA, 20 bp, Artificial Sequence
  sgRNA
  BRDN0000738020
ttgaacacgacacccgtgcc

SEQ ID NO: 7607 - DNA, 20 bp, Artificial Sequence
  sgRNA
  BRDN0000737992
ttgaagtagggtcggattga

SEQ ID NO: 7608 - DNA, 20 bp, Artificial Sequence
  sgRNA
  BRDN0000738111
ttgaatccgaggcgccgatg

SEQ ID NO: 7609 - DNA, 20 bp, Artificial Sequence
  sgRNA
  BRDN0000737971
ttgagcggacccccctacaa

SEQ ID NO: 7610 - DNA, 20 bp, Artificial Sequence
  sgRNA
  BRDN0000737511
ttgataaaccgcggccgaaa

SEQ ID NO: 7611 - DNA, 20 bp, Artificial Sequence
  sgRNA
  BRDN0000738347
ttgcacccccagttcgttgc

SEQ ID NO: 7612 - DNA, 20 bp, Artificial Sequence
  sgRNA
  BRDN0000738211
ttgcagcaacggcgacggct

SEQ ID NO: 7613 - DNA, 20 bp, Artificial Sequence
  sgRNA
  BRDN0000737532
ttgcgtgtgcgttgttaacg

SEQ ID NO: 7614 - DNA, 20 bp, Artificial Sequence
  sgRNA
  BRDN0000737650
ttggacgtacactttcgttc

SEQ ID NO: 7615 - DNA, 20 bp, Artificial Sequence
  sgRNA
  BRDN0000738029
ttggcggctcgctcctgcgt

SEQ ID NO: 7616 - DNA, 20 bp, Artificial Sequence
  sgRNA
  BRDN0000737396
ttgtcaacttcggccaacgc

SEQ ID NO: 7617 - DNA, 20 bp, Artificial Sequence
  sgRNA
  BRDN0000738314
ttgtcgctaactcagaatag

SEQ ID NO: 7618 - DNA, 20 bp, Artificial Sequence
  sgRNA
  BRDN0000738080
ttgtttcagccttgagcgcg

SEQ ID NO: 7619 - DNA, 20 bp, Artificial Sequence
  sgRNA
  BRDN0000738075
tttacgtatgctgtgcgcga

SEQ ID NO: 7620 - DNA, 20 bp, Artificial Sequence
  sgRNA
  BRDN0000737774
tttagtcagacgagccggat

SEQ ID NO: 7621 - DNA, 20 bp, Artificial Sequence
  sgRNA
  BRDN0000737740
tttcagttgtcgcgcgactc

SEQ ID NO: 7622 - DNA, 20 bp, Artificial Sequence
  sgRNA
  BRDN0000737536
tttctaattacccgatacgt

SEQ ID NO: 7623 - DNA, 20 bp, Artificial Sequence
  sgRNA
  BRDN0000738061
tttctagggccgccgcccgc

SEQ ID NO: 7624 - DNA, 20 bp, Artificial Sequence
  sgRNA
  BRDN0000737890
tttgacattttcgtctcgcg

SEQ ID NO: 7625 - DNA, 20 bp, Artificial Sequence
  sgRNA
  BRDN0000738044
ttttagtaggtcaacgctgt

SEQ ID NO: 7626 - DNA, 20 bp, Artificial Sequence
  sgRNA
  BRDN0000737986
ttttcgtcgactaagtcaag

SEQ ID NO: 7627 - DNA, 20 bp, Artificial Sequence
  sgRNA
  BRDN0000738107
ttttggcgacgcatcgctgg

SEQ ID NO: 7628 - DNA, 20 bp, Artificial Sequence
  sgRNA
  BRDN0000737731
tttttagacctaattcgcgc

SEQ ID NO: 7629 - DNA, 91 bp, Artificial Sequence
  primer
aatgatacggcgaccaccgagatctacactctttccctacacgacgctcttccgatcttaagtagagtcttgtggaaaggacgaaacaccg

SEQ ID NO: 7630 - DNA, 92 bp, Artificial Sequence
  primer
aatgatacggcgaccaccgagatctacactctttccctacacgacgctcttccgatctatacacgatctcttgtggaaaggacgaaacaccg

SEQ ID NO: 7631 - DNA, 93 bp, Artificial Sequence
  primer
aatgatacggcgaccaccgagatctacactctttccctacacgacgctcttccgatctgatcgcgcggttcttgtggaaaggacgaaacaccg

SEQ ID NO: 7632 - DNA, 94 bp, Artificial Sequence
  primer
aatgatacggcgaccaccgagatctacactctttccctacacgacgctcttccgatctcgatcatgatcgtcttgtggaaaggacgaaacaccg

SEQ ID NO: 7633 - DNA, 95 bp, Artificial Sequence
  primer
aatgatacggcgaccaccgagatctacactctttccctacacgacgctcttccgatcttcgatcgttaccatcttgtggaaaggacgaaacaccg

SEQ ID NO: 7634 - DNA, 96 bp, Artificial Sequence
  primer
aatgatacggcgaccaccgagatctacactctttccctacacgacgctcttccgatctatcgattccttggttcttgtggaaaggacgaaacaccg

SEQ ID NO: 7635 - DNA, 97 bp, Artificial Sequence
  primer
aatgatacggcgaccaccgagatctacactctttccctacacgacgctcttccgatctgatcgataacgcatttcttgtggaaaggacgaaacaccg

SEQ ID NO: 7636 - DNA, 98 bp, Artificial Sequence
  primer
aatgatacggcgaccaccgagatctacactctttccctacacgacgctcttccgatctcgatcgatacaggtattcttgtggaaaggacgaaacaccg

SEQ ID NO: 7637 - DNA, 99 bp, Artificial Sequence
  primer
aatgatacggcgaccaccgagatctacactctttccctacacgacgctcttccgatctacgatcgataggtaaggtcttgtggaaaggacgaaacaccg

SEQ ID NO: 7638 - DNA, 91 bp, Artificial Sequence
  primer
aatgatacggcgaccaccgagatctacactctttccctacacgacgctcttccgatcttaacaatggtcttgtggaaaggacgaaacaccg

SEQ ID NO: 7639 - DNA, 92 bp, Artificial Sequence
  primer
aatgatacggcgaccaccgagatctacactctttccctacacgacgctcttccgatctatactgtatctcttgtggaaaggacgaaacaccg

SEQ ID NO: 7640 - DNA, 93 bp, Artificial Sequence
  primer
aatgatacggcgaccaccgagatctacactctttccctacacgacgctcttccgatctgataggtcgcatcttgtggaaaggacgaaacaccg

SEQ ID NO: 7641 - DNA, 91 bp, Artificial Sequence
  primer
caagcagaagacggcatacgagatgtaacgcggtgactggagttcagacgtgtgctcttccgatctgactcggtgccactttttcaagttg

SEQ ID NO: 7642 - DNA, 91 bp, Artificial Sequence
  primer
caagcagaagacggcatacgagatgaaggtctgtgactggagttcagacgtgtgctcttccgatctgactcggtgccactttttcaagttg

SEQ ID NO: 7643 - DNA, 91 bp, Artificial Sequence
  primer
caagcagaagacggcatacgagatttggaacagtgactggagttcagacgtgtgctcttccgatctgactcggtgccactttttcaagttg

SEQ ID NO: 7644 - DNA, 91 bp, Artificial Sequence
  primer
caagcagaagacggcatacgagatccttagacgtgactggagttcagacgtgtgctcttccgatctgactcggtgccactttttcaagttg

SEQ ID NO: 7645 - protein, 12 aa, Artificial Sequence
  CDR
  MGAT5
GFNFSSSSIHWV

SEQ ID NO: 7646 - protein, 19 aa, Artificial Sequence
  CDR
  MGAT5
LEWVASISSYYSSTYYADS

SEQ ID NO: 7647 - protein, 25 aa, Artificial Sequence
  CDR
  MGAT5
YYCARTVRGSKKPYFSGWAMDYWGQ

SEQ ID NO: 7648 - protein, 16 aa, Artificial Sequence
  CDR
  MGAT5
YYCQQWYHYSYPITFG

SEQ ID NO: 7649 - protein, 12 aa, Artificial Sequence
  CDR
  MGAT5
GFNLYYYSMHWV

SEQ ID NO: 7650 - protein, 19 aa, Artificial Sequence
  CDR
  MGAT5
LEWVASISSSYGYTYYADS

SEQ ID NO: 7651 - protein, 25 aa, Artificial Sequence
  CDR
  MGAT5
YYCARTVRGSKKPYFSGWAMDYWGQ

SEQ ID NO: 7652 - protein, 16 aa, Artificial Sequence
  CDR
  MGAT5
YYCQQSYAYSPFTFGQ

SEQ ID NO: 7653 - protein, 12 aa, Artificial Sequence
  CDR
  MGAT5
GFNFSSSSIHWV

SEQ ID NO: 7654 - protein, 19 aa, Artificial Sequence
  CDR
  MGAT5
LEWVASISSSYGYTYYADS

SEQ ID NO: 7655 - protein, 25 aa, Artificial Sequence
  CDR
  MGAT5
YYCARTVRGSKKPYFSGWAMDYWGQ

SEQ ID NO: 7656 - protein, 16 aa, Artificial Sequence
  CDR
  MGAT5
YYCQQWYHYSYPITFG

SEQ ID NO: 7657 - protein, 12 aa, Artificial Sequence
  CDR
  MGAT5
GFNFSSSSIHWV

SEQ ID NO: 7658 - protein, 19 aa, Artificial Sequence
  CDR
  MGAT5
LEWVASISSYYSSTYYADS

SEQ ID NO: 7659 - protein, 25 aa, Artificial Sequence
  CDR
  MGAT5
YYCARTVRGSKKPYFSGWAMDYWGQ

SEQ ID NO: 7660 - protein, 16 aa, Artificial Sequence
  CDR
  MGAT5
YYCQQWYHYSYPITFG

SEQ ID NO: 7661 - protein, 12 aa, Artificial Sequence
  CDR
  MGAT5
GFNFSSSSIHWV

SEQ ID NO: 7662 - protein, 19 aa, Artificial Sequence
  CDR
  MGAT5
LEWVASISSYYSSTYYADS

SEQ ID NO: 7663 - protein, 25 aa, Artificial Sequence
  CDR
  MGAT5
YYCARTVRGSKKPYFSGWAMDYWGQ

SEQ ID NO: 7664 - protein, 16 aa, Artificial Sequence
  CDR
  MGAT5
YYCQQWYHYSYPITFG

SEQ ID NO: 7665 - protein, 12 aa, Artificial Sequence
  CDR
  MGAT5
GFNFSSSSIHWV

SEQ ID NO: 7666 - protein, 19 aa, Artificial Sequence
  CDR
  MGAT5
LEWVASISSYYSSTYYADS

SEQ ID NO: 7667 - protein, 25 aa, Artificial Sequence
  CDR
  MGAT5
YYCARTVRGSKKPYFSGWAMDYWGQ

SEQ ID NO: 7668 - protein, 16 aa, Artificial Sequence
  CDR
  MGAT5
YYCQQWYHYSYPITFG

SEQ ID NO: 7669 - protein, 12 aa, Artificial Sequence
  CDR
  MGAT5
GFNFSSSSIHWV

SEQ ID NO: 7670 - protein, 19 aa, Artificial Sequence
  CDR
  MGAT5
LEWVASISSSYGYTYYADS

SEQ ID NO: 7671 - protein, 25 aa, Artificial Sequence
  CDR
  MGAT5
YYCARTVRGSKKPYFSGWAMDYWGQ

SEQ ID NO: 7672 - protein, 16 aa, Artificial Sequence
  CDR
  MGAT5
YYCQQWAYYSYPITFG

SEQ ID NO: 7673 - protein, 12 aa, Artificial Sequence
  CDR
  MGAT5
GFNFSSSSIHWV

SEQ ID NO: 7674 - protein, 19 aa, Artificial Sequence
  CDR
  MGAT5
LEWVASISSYYSSTYYADS

SEQ ID NO: 7675 - protein, 25 aa, Artificial Sequence
  CDR
  MGAT5
YYCARTVRGSKKPYFSGWAMDYWGQ

SEQ ID NO: 7676 - protein, 16 aa, Artificial Sequence
  CDR
  MGAT5
YYCQQWYHYSYPITFG

SEQ ID NO: 7677 - protein, 12 aa, Artificial Sequence
  CDR
  MGAT5
GFNFSSSSIHWV

SEQ ID NO: 7678 - protein, 19 aa, Artificial Sequence
  CDR
  MGAT5
LEWVASISSYYSSTYYADS

SEQ ID NO: 7679 - protein, 25 aa, Artificial Sequence
  CDR
  MGAT5
YYCARTVRGSKKPYFSGWAMDYWGQ

SEQ ID NO: 7680 - protein, 16 aa, Artificial Sequence
  CDR
  MGAT5
YYCQQWYHYSYPITFG

SEQ ID NO: 7681 - protein, 12 aa, Artificial Sequence
  CDR
  MGAT5
GFNLYYYSMHWV

SEQ ID NO: 7682 - protein, 19 aa, Artificial Sequence
  CDR
  MGAT5
LEWVASISSSYGYTYYADS

SEQ ID NO: 7683 - protein, 25 aa, Artificial Sequence
  CDR
  MGAT5
YYCARTVRGSKKPYFSGWAMDYWGQ

SEQ ID NO: 7684 - protein, 16 aa, Artificial Sequence
  CDR
  MGAT5
YYCQQSYAYSPFTFGQ

SEQ ID NO: 7685 - protein, 12 aa, Artificial Sequence
  CDR
  MGAT5
GFNFSSSSIHWV

SEQ ID NO: 7686 - protein, 19 aa, Artificial Sequence
  CDR
  MGAT5
LEWVASISSYYSSTYYADS

SEQ ID NO: 7687 - protein, 25 aa, Artificial Sequence
  CDR
  MGAT5
YYCARTVRGSKKPYFSGWAMDYWGQ

SEQ ID NO: 7688 - protein, 16 aa, Artificial Sequence
  CDR
  MGAT5
YYCQQWYHYSYPITFG

SEQ ID NO: 7689 - protein, 12 aa, Artificial Sequence
  CDR
  MGAT5
GFNFSSSSIHWV

SEQ ID NO: 7690 - protein, 19 aa, Artificial Sequence
  CDR
  MGAT5
LEWVASISSYYGSTYYADS

SEQ ID NO: 7691 - protein, 25 aa, Artificial Sequence
  CDR
  MGAT5
YYCARTVRGSKKPYFSGWAMDYWGQ

SEQ ID NO: 7692 - protein, 16 aa, Artificial Sequence
  CDR
  MGAT5
YYCQQWYHYSYPITFG

SEQ ID NO: 7693 - protein, 12 aa, Artificial Sequence
  CDR
  MGAT5
GFNFSSSSIHWV

SEQ ID NO: 7694 - protein, 19 aa, Artificial Sequence
  CDR
  MGAT5
LEWVASISSSYGYTYYADS

SEQ ID NO: 7695 - protein, 25 aa, Artificial Sequence
  CDR
  MGAT5
YYCARTVRGSKKPYFSGWAMDYWGQ

SEQ ID NO: 7696 - protein, 12 aa, Artificial Sequence
  CDR
  MGAT5
GFNFSSSSIHWV

SEQ ID NO: 7697 - protein, 19 aa, Artificial Sequence
  CDR
  MGAT5
LEWVASISSYYSSTYYADS

SEQ ID NO: 7698 - protein, 25 aa, Artificial Sequence
  CDR
  MGAT5
YYCARTVRGSKKPYFSGWAMDYWGQ

SEQ ID NO: 7699 - protein, 12 aa, Artificial Sequence
  CDR
  MGAT5
GFNFSSSSIHWV

SEQ ID NO: 7700 - protein, 19 aa, Artificial Sequence
  CDR
  MGAT5
LEWVASISSYYSSTYYADS

SEQ ID NO: 7701 - protein, 25 aa, Artificial Sequence
  CDR
  MGAT5
YYCARTVRGSKKPYFSGWAMDYWGQ

SEQ ID NO: 7702 - protein, 16 aa, Artificial Sequence
  CDR
  MGAT5
YYCQQWYHYSYPITFG

SEQ ID NO: 7703 - protein, 12 aa, Artificial Sequence
  CDR
  MGAT5
GFNFSSSSIHWV

SEQ ID NO: 7704 - protein, 19 aa, Artificial Sequence
  CDR
  MGAT5
LEWVASISSYYSSTYYADS

SEQ ID NO: 7705 - protein, 25 aa, Artificial Sequence
  CDR
  MGAT5
YYCARTVRGSKKPYFSGWAMDYWGQ

SEQ ID NO: 7706 - protein, 16 aa, Artificial Sequence
  CDR
  MGAT5
YYCQQWYHYSYPITFG

SEQ ID NO: 7707 - protein, 12 aa, Artificial Sequence
  CDR
  MGAT5
GFNFSSSSIHWV

SEQ ID NO: 7708 - protein, 19 aa, Artificial Sequence
  CDR
  MGAT5
LEWVASISSYYSSTYYADS

SEQ ID NO: 7709 - protein, 25 aa, Artificial Sequence
  CDR
  MGAT5
YYCARTVRGSKKPYFSGWAMDYWGQ

SEQ ID NO: 7710 - protein, 16 aa, Artificial Sequence
  CDR
  MGAT5
YYCQQWYHYSYPITFG

SEQ ID NO: 7711 - protein, 12 aa, Artificial Sequence
  CDR
  MGAT5
GFNFSSSSIHWV

SEQ ID NO: 7712 - protein, 19 aa, Artificial Sequence
  CDR
  MGAT5
LEWVASISSYYSSTYYADS

SEQ ID NO: 7713 - protein, 25 aa, Artificial Sequence
  CDR
  MGAT5
YYCARTVRGSKKPYFSGWAMDYWGQ

SEQ ID NO: 7714 - protein, 16 aa, Artificial Sequence
  CDR
  MGAT5
YYCQQWYHYSYPITFG

SEQ ID NO: 7715 - protein, 12 aa, Artificial Sequence
  CDR
  MGAT5
GFNFSSSSIHWV

SEQ ID NO: 7716 - protein, 19 aa, Artificial Sequence
  CDR
  MGAT5
LEWVASISSYYSSTYYADS

SEQ ID NO: 7717 - protein, 25 aa, Artificial Sequence
  CDR
  MGAT5
YYCARTVRGSKKPYFSGWAMDYWGQ

SEQ ID NO: 7718 - protein, 16 aa, Artificial Sequence
  CDR
  MGAT5
YYCQQWYHYSYPITFG

SEQ ID NO: 7719 - protein, 12 aa, Artificial Sequence
  CDR
  MGAT5
GFNFSSSSIHWV

SEQ ID NO: 7720 - protein, 19 aa, Artificial Sequence
  CDR
  MGAT5
LEWVASISSSYGYTYYADS

SEQ ID NO: 7721 - protein, 25 aa, Artificial Sequence
  CDR
  MGAT5
YYCARTVRGSKKPYFSGWAMDYWGQ

SEQ ID NO: 7722 - protein, 12 aa, Artificial Sequence
  CDR
  MGAT5
GFNFSSSSIHWV

SEQ ID NO: 7723 - protein, 19 aa, Artificial Sequence
  CDR
  MGAT5
LEWVASISSSYGYTYYADS

SEQ ID NO: 7724 - protein, 25 aa, Artificial Sequence
  CDR
  MGAT5
YYCARTVRGSKKPYFSGWAMDYWGQ

SEQ ID NO: 7725 - protein, 12 aa, Artificial Sequence
  CDR
  MGAT5
GFNFSSSSIHWV

SEQ ID NO: 7726 - protein, 19 aa, Artificial Sequence
  CDR
  MGAT5
LEWVASISSYYSSTYYADS

SEQ ID NO: 7727 - protein, 25 aa, Artificial Sequence
  CDR
  MGAT5
YYCARTVRGSKKPYFSGWAMDYWGQ

SEQ ID NO: 7728 - protein, 16 aa, Artificial Sequence
  CDR
  MGAT5
YYCQQWYHYSYPITFG

SEQ ID NO: 7729 - protein, 12 aa, Artificial Sequence
  CDR
  MGAT5
GFNFSSSSIHWV

SEQ ID NO: 7730 - protein, 19 aa, Artificial Sequence
  CDR
  MGAT5
LEWVASISSYYSSTYYADS

SEQ ID NO: 7731 - protein, 25 aa, Artificial Sequence
  CDR
  MGAT5
YYCARTVRGSKKPYFSGWAMDYWGQ

SEQ ID NO: 7732 - protein, 12 aa, Artificial Sequence
  CDR
  PDIA3
GFNLYSYYMHWV

SEQ ID NO: 7733 - protein, 19 aa, Artificial Sequence
  CDR
  PDIA3
LEWVAYIYPYYSYTYYADS

SEQ ID NO: 7734 - protein, 29 aa, Artificial Sequence
  CDR
  PDIA3
YYCARYPDSFHSSDYPSYSYYAMDYWGQG

SEQ ID NO: 7735 - protein, 18 aa, Artificial Sequence
  CDR
  PDIA3
YYCQQSGAGGYPFTFGQG

SEQ ID NO: 7736 - protein, 12 aa, Artificial Sequence
  CDR
  PDIA3
GFNFSSSSIHWV

SEQ ID NO: 7737 - protein, 19 aa, Artificial Sequence
  CDR
  PDIA3
LEWVASISSSYGYTYYADS

SEQ ID NO: 7738 - protein, 26 aa, Artificial Sequence
  CDR
  PDIA3
YYCARTVRGSKKPYFSGWAMDYWGQG

SEQ ID NO: 7739 - protein, 16 aa, Artificial Sequence
  CDR
  PDIA3
YYCQQSSYSLITFGQG

SEQ ID NO: 7740 - protein, 12 aa, Artificial Sequence
  CDR
  PDIA3
GFNLYYYYIHWV

SEQ ID NO: 7741 - protein, 19 aa, Artificial Sequence
  CDR
  PDIA3
LEWVASIYSYYSYTYYADS

SEQ ID NO: 7742 - protein, 25 aa, Artificial Sequence
  CDR
  PDIA3
YYCARSSDASSYGGGGYAIDYWGQG

SEQ ID NO: 7743 - protein, 17 aa, Artificial Sequence
  CDR
  PDIA3
YYCQQGFYSSPITFGQG

SEQ ID NO: 7744 - protein, 12 aa, Artificial Sequence
  CDR
  PDIA3
GFNFSSSSIHWV

SEQ ID NO: 7745 - protein, 19 aa, Artificial Sequence
  CDR
  PDIA3
LEWVASISSSYGYTYYADS

SEQ ID NO: 7746 - protein, 26 aa, Artificial Sequence
  CDR
  PDIA3
YYCARTVRGSKKPYFSGWAMDYWGQG

SEQ ID NO: 7747 - protein, 18 aa, Artificial Sequence
  CDR
  PDIA3
YYCQQHSHYGSPITFGQG

SEQ ID NO: 7748 - protein, 12 aa, Artificial Sequence
  CDR
  PDIA3
GFNLSSSYIHWV

SEQ ID NO: 7749 - protein, 19 aa, Artificial Sequence
  CDR
  PDIA3
LEWVASISSSYGYTYYADS

SEQ ID NO: 7750 - protein, 21 aa, Artificial Sequence
  CDR
  PDIA3
YYCARSYDDYYGGALDYWGQG

SEQ ID NO: 7751 - protein, 15 aa, Artificial Sequence
  CDR
  PDIA3
YYCQQHYHPITFGQG

SEQ ID NO: 7752 - protein, 12 aa, Artificial Sequence
  CDR
  PDIA3
GFNLSSSYIHWV

SEQ ID NO: 7753 - protein, 19 aa, Artificial Sequence
  CDR
  PDIA3
LEWVAYIYPSYGYTYYADS

SEQ ID NO: 7754 - protein, 18 aa, Artificial Sequence
  CDR
  PDIA3
YYCARGFASSGIDYWGQG

SEQ ID NO: 7755 - protein, 18 aa, Artificial Sequence
  CDR
  PDIA3
YYCQQASSYYYPFTFGQG

SEQ ID NO: 7756 - protein, 11 aa, Artificial Sequence
  CDR
  PDIA3
GFTSLLLLCTG

SEQ ID NO: 7757 - protein, 19 aa, Artificial Sequence
  CDR
  PDIA3
LEWVASISSYYGYTSYADS

SEQ ID NO: 7758 - protein, 29 aa, Artificial Sequence
  CDR
  PDIA3
YYCARHAHHGSGWDAYYYDYSAMDYWGQG

SEQ ID NO: 7759 - protein, 19 aa, Artificial Sequence
  CDR
  PDIA3
YYCQQSYSYYDALITFGQG

SEQ ID NO: 7760 - protein, 12 aa, Artificial Sequence
  CDR
  PDIA3
GFNFSSSSIHWV

SEQ ID NO: 7761 - protein, 19 aa, Artificial Sequence
  CDR
  PDIA3
LEWVASISSSYGYTYYADS

SEQ ID NO: 7762 - protein, 26 aa, Artificial Sequence
  CDR
  PDIA3
YYCARTVRGSKKPYFSGWAMDYWGQG

SEQ ID NO: 7763 - protein, 17 aa, Artificial Sequence
  CDR
  PDIA3
YYCQQYYPSSLFTFGQG

SEQ ID NO: 7764 - protein, 12 aa, Artificial Sequence
  CDR
  PDIA3
GFNLYYSYMHWV

SEQ ID NO: 7765 - protein, 19 aa, Artificial Sequence
  CDR
  PDIA3
LEWVTSIYPSYGYTYYADS

SEQ ID NO: 7766 - protein, 26 aa, Artificial Sequence
  CDR
  PDIA3
YYCARGYPFSDSFYWAGYALDYWGQG

SEQ ID NO: 7767 - protein, 17 aa, Artificial Sequence
  CDR
  PDIA3
YYCQQYFHYYLITFGQG

SEQ ID NO: 7768 - protein, 12 aa, Artificial Sequence
  CDR
  PDIA3
GFNLSSYYIHWV

SEQ ID NO: 7769 - protein, 19 aa, Artificial Sequence
  CDR
  PDIA3
LEWVASISSYSGSTYYADS

SEQ ID NO: 7770 - protein, 20 aa, Artificial Sequence
  CDR
  PDIA3
YYCARAGSYWSYAFDYWGQG

SEQ ID NO: 7771 - protein, 15 aa, Artificial Sequence
  CDR
  PDIA3
YYCQQSYGPITFGQG

SEQ ID NO: 7772 - protein, 12 aa, Artificial Sequence
  CDR
  PDIA3
GFNFSSSSIHWV

SEQ ID NO: 7773 - protein, 19 aa, Artificial Sequence
  CDR
  PDIA3
LEWVASISSSYGYTYYADS

SEQ ID NO: 7774 - protein, 26 aa, Artificial Sequence
  CDR
  PDIA3
YYCARTVRGSKKPYFSGWAMDYWGQG

SEQ ID NO: 7775 - protein, 16 aa, Artificial Sequence
  CDR
  PDIA3
YYCQQSSYSLITFGQG

SEQ ID NO: 7776 - protein, 12 aa, Artificial Sequence
  CDR
  PDIA3
GFNLSSSYIHWV

SEQ ID NO: 7777 - protein, 19 aa, Artificial Sequence
  CDR
  PDIA3
LEWVASIYSYYGSTYYADS

SEQ ID NO: 7778 - protein, 19 aa, Artificial Sequence
  CDR
  PDIA3
YYCARPSFSYYAMDYWGQG

SEQ ID NO: 7779 - protein, 17 aa, Artificial Sequence
  CDR
  PDIA3
YYCQQGFFFAPITFGQG

SEQ ID NO: 7780 - protein, 12 aa, Artificial Sequence
  CDR
  PDIA3
GFNLYSYSMHWV

SEQ ID NO: 7781 - protein, 19 aa, Artificial Sequence
  CDR
  PDIA3
LEWVAYIYSYSGYTYYADS

SEQ ID NO: 7782 - protein, 17 aa, Artificial Sequence
  CDR
  PDIA3
YYCARASYYGLDYWGQG

SEQ ID NO: 7783 - protein, 19 aa, Artificial Sequence
  CDR
  PDIA3
YYCQQSAYGYGHPITFGQG

SEQ ID NO: 7784 - protein, 12 aa, Artificial Sequence
  CDR
  PDIA3
GFNLYYYSMHWV

SEQ ID NO: 7785 - protein, 19 aa, Artificial Sequence
  CDR
  PDIA3
LEWVAYISSYSSYTYYADS

SEQ ID NO: 7786 - protein, 21 aa, Artificial Sequence
  CDR
  PDIA3
YYCARWSYPGGDGGMDYWGQG

SEQ ID NO: 7787 - protein, 17 aa, Artificial Sequence
  CDR
  PDIA3
YYCQQSSDAYSLITLDR

SEQ ID NO: 7788 - protein, 12 aa, Artificial Sequence
  CDR
  PDIA3
GFNFSSSSIHWV

SEQ ID NO: 7789 - protein, 19 aa, Artificial Sequence
  CDR
  PDIA3
LEWVASISSSYGYTYYADS

SEQ ID NO: 7790 - protein, 26 aa, Artificial Sequence
  CDR
  PDIA3
YYCARTVRGSKKPYFSGWAMDYWGQG

SEQ ID NO: 7791 - protein, 18 aa, Artificial Sequence
  CDR
  PDIA3
YYCQQGAYYGAPITFGQG

SEQ ID NO: 7792 - protein, 10 aa, Artificial Sequence
  CDR
  PDIA3
ASTSFFLMHG

SEQ ID NO: 7793 - protein, 19 aa, Artificial Sequence
  CDR
  PDIA3
LEWVAYIYSSSSSTSYADS

SEQ ID NO: 7794 - protein, 29 aa, Artificial Sequence
  CDR
  PDIA3
YYCARSSSASGYPGFSYFSYDGMDYWGQG

SEQ ID NO: 7795 - protein, 16 aa, Artificial Sequence
  CDR
  PDIA3
YYCQQSSYSLITFGQG

SEQ ID NO: 7796 - protein, 12 aa, Artificial Sequence
  CDR
  PDIA3
GFNFSSSSIHWV

SEQ ID NO: 7797 - protein, 19 aa, Artificial Sequence
  CDR
  PDIA3
LEWVASISSSYGYTYYADS

SEQ ID NO: 7798 - protein, 26 aa, Artificial Sequence
  CDR
  PDIA3
YYCARTVRGSKKPYFSGWAMDYWGQG

SEQ ID NO: 7799 - protein, 16 aa, Artificial Sequence
  CDR
  PDIA3
YYCQQSSYSLITFGQG

SEQ ID NO: 7800 - protein, 12 aa, Artificial Sequence
  CDR
  PDIA3
GFNIYYSYMHWV

SEQ ID NO: 7801 - protein, 19 aa, Artificial Sequence
  CDR
  PDIA3
LEWVASIYPYSSYTSYADS

SEQ ID NO: 7802 - protein, 23 aa, Artificial Sequence
  CDR
  PDIA3
YYCARFSWFGWYSYAGMDYWGQG

SEQ ID NO: 7803 - protein, 16 aa, Artificial Sequence
  CDR
  PDIA3
YYCQQSSYSLITFGQG

SEQ ID NO: 7804 - protein, 12 aa, Artificial Sequence
  CDR
  PDIA3
GFNLSSSSMHWV

SEQ ID NO: 7805 - protein, 19 aa, Artificial Sequence
  CDR
  PDIA3
LEWVAYIYSYSGYTSYADS

SEQ ID NO: 7806 - protein, 26 aa, Artificial Sequence
  CDR
  PDIA3
YYCARTVRGSNKPYFSGWAMDYWGQG

SEQ ID NO: 7807 - protein, 16 aa, Artificial Sequence
  CDR
  PDIA3
YYCQQAPAALITFGQG

SEQ ID NO: 7808 - protein, 12 aa, Artificial Sequence
  CDR
  PDIA3
GFNLYYSYMHWV

SEQ ID NO: 7809 - protein, 19 aa, Artificial Sequence
  CDR
  PDIA3
LEWVAYIYPYYGSTSYADS

SEQ ID NO: 7810 - protein, 24 aa, Artificial Sequence
  CDR
  PDIA3
YYCARYSYPYWYYFGSGLDYWGQG

SEQ ID NO: 7811 - protein, 14 aa, Artificial Sequence
  CDR
  PDIA3
YYCQQWYLITFGQG

SEQ ID NO: 7812 - protein, 12 aa, Artificial Sequence
  CDR
  PDIA3
GFNLYYYYMHWV

SEQ ID NO: 7813 - protein, 19 aa, Artificial Sequence
  CDR
  PDIA3
LEWVAYISPSYGYTYYADS

SEQ ID NO: 7814 - protein, 27 aa, Artificial Sequence
  CDR
  PDIA3
YYCARSSSGYSYGAFYYPSAIDYWGQG

SEQ ID NO: 7815 - protein, 15 aa, Artificial Sequence
  CDR
  PDIA3
YYCQQGYDLITFGQG

SEQ ID NO: 7816 - protein, 12 aa, Artificial Sequence
  CDR
  PDIA3
GFNIYYSYMHWV

SEQ ID NO: 7817 - protein, 19 aa, Artificial Sequence
  CDR
  PDIA3
LEWVASIYSYYSSTSYADS

SEQ ID NO: 7818 - protein, 14 aa, Artificial Sequence
  CDR
  PDIA3
YYCARSALDYWGQG

SEQ ID NO: 7819 - protein, 15 aa, Artificial Sequence
  CDR
  PDIA3
YYCQQYYYLITFGQG

SEQ ID NO: 7820 - protein, 12 aa, Artificial Sequence
  CDR
  PDIA3
GFNFSSSSIHWV

SEQ ID NO: 7821 - protein, 19 aa, Artificial Sequence
  CDR
  PDIA3
LEWVASISSSYGYTYYADS

SEQ ID NO: 7822 - protein, 24 aa, Artificial Sequence
  CDR
  PDIA3
YYCARHYAGYPGYYGYGIDYWGQG

SEQ ID NO: 7823 - protein, 16 aa, Artificial Sequence
  CDR
  PDIA3
YYCQQSSYSLITFGQG

SEQ ID NO: 7824 - protein, 84 aa, Artificial Sequence
  CDR
  L1_L2
IQMTQSPSSLSASVGDRVTITCRASQSVSSAVAWYQQKPGKAPKLLIYSASSLYSGVPSRFSGSRSGTDFTLTISSLQPEDFAT

SEQ ID NO: 7825 - DNA, 4862 bp, Artificial Sequence
  Antibody
  a-MGAT5 clone 10 heavy chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggttcagctggtggagtctggcggtggcctggtgcagccagggggctcactccgtttgtcctgtgcagcttctggcttcaacctctattattattctatgcactgggtgcgtcaggccccgggtaagggcctggaatgggttgcatctatttcttcttcttatggctatacttattatgccgatagcgtcaagggccgtttcactataagcgcagacacatccaaaaacacagcctacctacaaatgaacagcttaagagctgaggacactgccgtctattattgtgctcgcactgttcgtggatccaaaaaaccgtacttctctggttgggctatggactactggggtcaaggaaccctggtcaccgtctcctcgagtgctagcagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccgcaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatgatcccagtgtccctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7826 - DNA, 4180 bp, Artificial Sequence
  Antibody
  a-MGAT5 clone 10 light chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaatcttacgcttactctccgttcacgttcggacagggtaccaaggtggagatcaaacgactcgagatcaaacgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttagagacaaaggtcctgagagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7827 - DNA, 4180 bp, Artificial Sequence; identical to SEQ ID NO: 7826
  Antibody
  a-MGAT5 clone 3 heavy chain

SEQ ID NO: 7828 - DNA, 4183 bp, Artificial Sequence
  Antibody
  a-MGAT5 clone 3 light chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaatggtaccattactcttacccgatcacgttcggacagggtaccaaggtggagatcaaacgactcgagatcaaacgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttagagacaaaggtcctgagagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7829 - DNA, 4862 bp, Artificial Sequence
  Antibody
  a-MGAT5 clone 9 heavy chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggttcagctggtggagtctggcggtggcctggtgcagccagggggctcactccgtttgtcctgtgcagcttctggcttcaacttttcttcttcttctatacactgggtgcgtcaggccccgggtaagggcctggaatgggttgcatctatttcttcttattatagctctacttattatgccgatagcgtcaagggccgtttcactataagcgcagacacatccaaaaacacagcctacctacaaatgaacagcttaagagctgaggacactgccgtctattattgtgctcgcactgttcgtggatccaaaaaaccgtacttctctggttgggctatggactactggggtcaaggaaccctggtcaccgtctcctcgagtgctagcagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccgcaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatgatcccagtgtccctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7830 - DNA, 4183 bp, Artificial Sequence; identical to SEQ ID NO: 7828
  Antibody
  a-MGAT5 clone 9 light chain

SEQ ID NO: 7831 - DNA, 4862 bp, Artificial Sequence
  Antibody
  a-PDIA3 clone 17 heavy chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggttcagctggtggagtctggcggtggcctggtgcagccagggggctcactccgtttgtcctgtgcagcttctggcttcaacttttcttcttcttctatacactgggtgcgtcaggccccgggtaagggcctggaatgggttgcatctatttcttcttcttatggctatacttattatgccgatagcgtcaagggccgtttcactataagcgcagacacatccaaaaacacagcctacctacaaatgaacagcttaagagctgaggacactgccgtctattattgtgctcgcactgttcgtggatccaaaaaaccgtacttctctggttgggctatggactactggggtcaaggaaccctggtcaccgtctcctcgagtgctagcagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccgcaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatgatcccagtgtccctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7832 - DNA, 4177 bp, Artificial Sequence
  Antibody
  a-PDIA3 clone 17 light chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaatcttcttattctctgatcacgttcggacagggtaccaaggtggagatcaaacgactcgagatcaaacgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttagagacaaaggtcctgagagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7833 - DNA, 4865 bp, Artificial Sequence
  Antibody
  a-PDIA3 clone 21 heavy chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggttcagctggtggagtctggcggtggcctggtgcagccagggggctcactccgtttgtcctgtgcagcttctggcttcaacctctattattattatatgcactgggtgcgtcaggccccgggtaagggcctggaatgggttgcatatatttctccttcttatggctatacttattatgccgatagcgtcaagggccgtttcactataagcgcagacacatccaaaaacacagcctacctacaaatgaacagcttaagagctgaggacactgccgtctattattgtgctcgctcttcttctggttactcttacggtgctttctactacccgtctgctattgactactggggtcaaggaaccctggtcaccgtctcctcgagtgctagcagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccgcaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatgatcccagtgtccctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7834 - DNA, 4174 bp, Artificial Sequence
  Antibody
  a-PDIA3 clone 21 light chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaaggttacgacctgatcacgttcggacagggtaccaaggtggagatcaaacgactcgagatcaaacgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttagagacaaaggtcctgagagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7835 - DNA, 4841 bp, Artificial Sequence
  Antibody
  a-PDIA3 clone 22 heavy chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggttcagctggtggagtctggcggtggcctggtgcagccagggggctcactccgtttgtcctgtgcagcttctggcttcaacctctattattattctatccactgggtgcgtcaggccccgggtaagggcctggaatgggttgcatctatttcttcttattatagctctacttcttatgccgatagcgtcaagggccgtttcactataagcgcagacacatccaaaaacacagcctacctacaaatgaacagcttaagagctgaggacactgccgtctattattgtgctcgcttctactctggttacgctggtatggactactggggtcaaggaaccctggtcaccgtctcctcgagtgctagcagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccgcaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatgatcccagtgtccctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7836 - DNA, 4174 bp, Artificial Sequence
  Antibody
  a-PDIA3 clone 22 light chain
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaatctggttacctgatcacgttcggacagggtaccaaggtggagatcaaacgactcgagatcaaacgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttagagacaaaggtcctgagagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 7837 - DNA, 20 bp, Artificial Sequence
  sgRNA
  1110032F04Rik_1
cacgcctttctggacaacgt

SEQ ID NO: 7838 - DNA, 20 bp, Artificial Sequence
  sgRNA
  1110032F04Rik_2
gactcactgttggatagtgg

SEQ ID NO: 7839 - DNA, 20 bp, Artificial Sequence
  sgRNA
  1110032F04Rik_3
cacctcgtcgcgcagcagag

SEQ ID NO: 7840 - DNA, 20 bp, Artificial Sequence
  sgRNA
  1110032F04Rik_4
ggccacgcgggtacctgcgt

SEQ ID NO: 7841 - DNA, 20 bp, Artificial Sequence
  sgRNA
  1110032F04Rik_5
tcgtgctccgaaacgcagga

SEQ ID NO: 7842 - DNA, 20 bp, Artificial Sequence
  sgRNA
  1110032F04Rik_6
ccacgttgtccagaaaggcg

SEQ ID NO: 7843 - DNA, 20 bp, Artificial Sequence
  sgRNA
  1110032F04Rik_7
ccacctatgaggagtccatg

SEQ ID NO: 7844 - DNA, 20 bp, Artificial Sequence
  sgRNA
  1110032F04Rik_8
ctgcgactcggccaacgcca

SEQ ID NO: 7845 - DNA, 20 bp, Artificial Sequence
  sgRNA
  1110032F04Rik_9
agcccacgcaggtacccgcg

SEQ ID NO: 7846 - DNA, 20 bp, Artificial Sequence
  sgRNA
  1110032F04Rik_10
ccagctgcccagctacgagg

SEQ ID NO: 7847 - DNA, 20 bp, Artificial Sequence
  sgRNA
  1110032F04Rik_11
gtggcgctggagccaccgac

SEQ ID NO: 7848 - DNA, 20 bp, Artificial Sequence
  sgRNA
  1110032F04Rik_12
ttcggagcacgagctgcacg

SEQ ID NO: 7849 - DNA, 20 bp, Artificial Sequence
  sgRNA
  1110032F04Rik_13
gctgcagcagctcagcccag

SEQ ID NO: 7850 - DNA, 20 bp, Artificial Sequence
  sgRNA
  1110032F04Rik_14
cagtgagtcctgcgagcccg

SEQ ID NO: 7851 - DNA, 20 bp, Artificial Sequence
  sgRNA
  1110032F04Rik_15
cttgcagcagcgcacggccg

SEQ ID NO: 7852 - DNA, 20 bp, Artificial Sequence
  sgRNA
  1110032F04Rik_16
gcagcagctcagcccagcgg

SEQ ID NO: 7853 - DNA, 20 bp, Artificial Sequence
  sgRNA
  1110032F04Rik_17
tcactgttggatagtggcgg

SEQ ID NO: 7854 - DNA, 20 bp, Artificial Sequence
  sgRNA
  1110032F04Rik_18
tacttgacctcctcgtagct

SEQ ID NO: 7855 - DNA, 20 bp, Artificial Sequence
  sgRNA
  1110032F04Rik_19
tctccagctgcccagctacg

SEQ ID NO: 7856 - DNA, 20 bp, Artificial Sequence
  sgRNA
  1110032F04Rik_20
ctcgtgctccgaaacgcagg

SEQ ID NO: 7857 - DNA, 20 bp, Artificial Sequence
  sgRNA
  1700017D01Rik_1
gaagacaagagatatagcat

SEQ ID NO: 7858 - DNA, 20 bp, Artificial Sequence
  sgRNA
  1700017D01Rik_2
aggatccagcagtataactc

SEQ ID NO: 7859 - DNA, 20 bp, Artificial Sequence
  sgRNA
  1700017D01Rik_3
cagggtgcacaaataatgct

SEQ ID NO: 7860 - DNA, 20 bp, Artificial Sequence
  sgRNA
  1700017D01Rik_4
aaacatcataagtatcttcg

SEQ ID NO: 7861 - DNA, 20 bp, Artificial Sequence
  sgRNA
  1700017D01Rik_5
atagatggctgtgttgaagg

SEQ ID NO: 7862 - DNA, 20 bp, Artificial Sequence
  sgRNA
  1700017D01Rik_6
gcctaattcacaatgcactg

SEQ ID NO: 7863 - DNA, 20 bp, Artificial Sequence
  sgRNA
  1700017D01Rik_7
gttcctattgattcaaaaat

SEQ ID NO: 7864 - DNA, 20 bp, Artificial Sequence
  sgRNA
  1700017D01Rik_8
agtatcttcgtggctatatt

SEQ ID NO: 7865 - DNA, 20 bp, Artificial Sequence
  sgRNA
  1700017D01Rik_9
ttatgaaccagtgcagcact

SEQ ID NO: 7866 - DNA, 20 bp, Artificial Sequence
  sgRNA
  1700017D01Rik_10
aataccctgagttatactgc

SEQ ID NO: 7867 - DNA, 20 bp, Artificial Sequence
  sgRNA
  1700017D01Rik_11
tggtgatgataggtgtgaat

SEQ ID NO: 7868 - DNA, 20 bp, Artificial Sequence
  sgRNA
  1700017D01Rik_12
gtgttgaaggtggtgatgat

SEQ ID NO: 7869 - DNA, 20 bp, Artificial Sequence
  sgRNA
  1700017D01Rik_13
atatttggtttaattctact

SEQ ID NO: 7870 - DNA, 20 bp, Artificial Sequence
  sgRNA
  1700017D01Rik_14
ggatccagcagtataactca

SEQ ID NO: 7871 - DNA, 20 bp, Artificial Sequence
  sgRNA
  1700017D01Rik_15
acagccatctatgcttgagt

SEQ ID NO: 7872 - DNA, 20 bp, Artificial Sequence
  sgRNA
  1700017D01Rik_16
tggcctaattcacaatgcac

SEQ ID NO: 7873 - DNA, 20 bp, Artificial Sequence
  sgRNA
  1700017D01Rik_17
tgatgataggtgtgaatggg

SEQ ID NO: 7874 - DNA, 20 bp, Artificial Sequence
  sgRNA
  1700017D01Rik_18
tactagctaacataagttta

SEQ ID NO: 7875 - DNA, 20 bp, Artificial Sequence
  sgRNA
  1700017D01Rik_19
gatgataggtgtgaatggga

SEQ ID NO: 7876 - DNA, 20 bp, Artificial Sequence
  sgRNA
  1700017D01Rik_20
ttctccaactcaagcataga

SEQ ID NO: 7877 - DNA, 20 bp, Artificial Sequence
  sgRNA
  1810055G02Rik_1
gagcactccaacaaccagag

SEQ ID NO: 7878 - DNA, 20 bp, Artificial Sequence
  sgRNA
  1810055G02Rik_2
gaaacatagtcactaacaag

SEQ ID NO: 7879 - DNA, 20 bp, Artificial Sequence
  sgRNA
  1810055G02Rik_3
ctgcagcaagagtcgccgtg

SEQ ID NO: 7880 - DNA, 20 bp, Artificial Sequence
  sgRNA
  1810055G02Rik_4
caccacccaggtacaaacca

SEQ ID NO: 7881 - DNA, 20 bp, Artificial Sequence
  sgRNA
  1810055G02Rik_5
agccctacattacctaccca

SEQ ID NO: 7882 - DNA, 20 bp, Artificial Sequence
  sgRNA
  1810055G02Rik_6
ggaaatccacaccagcacca

SEQ ID NO: 7883 - DNA, 20 bp, Artificial Sequence
  sgRNA
  1810055G02Rik_7
agcaactgtggccccccaca

SEQ ID NO: 7884 - DNA, 20 bp, Artificial Sequence
  sgRNA
  1810055G02Rik_8
tagtccctcaaacgccaccc

SEQ ID NO: 7885 - DNA, 20 bp, Artificial Sequence
  sgRNA
  1810055G02Rik_9
caagaagaaggactacacgc

SEQ ID NO: 7886 - DNA, 20 bp, Artificial Sequence
  sgRNA
  1810055G02Rik_10
gggatatgacgtctacatca

SEQ ID NO: 7887 - DNA, 20 bp, Artificial Sequence
  sgRNA
  1810055G02Rik_11
gtagctctcataggcttgca

SEQ ID NO: 7888 - DNA, 20 bp, Artificial Sequence
  sgRNA
  1810055G02Rik_12
aggtacagccagagttctgg

SEQ ID NO: 7889 - DNA, 20 bp, Artificial Sequence
  sgRNA
  1810055G02Rik_13
cgtgtcaccaagaacagcca

SEQ ID NO: 7890 - DNA, 20 bp, Artificial Sequence
  sgRNA
  1810055G02Rik_14
aagtaacatcttgttcacca

SEQ ID NO: 7891 - DNA, 20 bp, Artificial Sequence
  sgRNA
  1810055G02Rik_15
ctagacccaccaccattgct

SEQ ID NO: 7892 - DNA, 20 bp, Artificial Sequence
  sgRNA
  1810055G02Rik_16
tggctccttggtttgtacct

SEQ ID NO: 7893 - DNA, 20 bp, Artificial Sequence
  sgRNA
  1810055G02Rik_17
acagcagaggtgacaacaca

SEQ ID NO: 7894 - DNA, 20 bp, Artificial Sequence
  sgRNA
  1810055G02Rik_18
ggactcggagtccttgtgtg

SEQ ID NO: 7895 - DNA, 20 bp, Artificial Sequence
  sgRNA
  1810055G02Rik_19
acattacctacccagggcac

SEQ ID NO: 7896 - DNA, 20 bp, Artificial Sequence
  sgRNA
  1810055G02Rik_20
acctcaggtgcccaaataca

SEQ ID NO: 7897 - DNA, 20 bp, Artificial Sequence
  sgRNA
  2900092C05Rik_1
gtatacttactatatcacgt

SEQ ID NO: 7898 - DNA, 20 bp, Artificial Sequence
  sgRNA
  2900092C05Rik_2
agtattgcaagtaagcctct

SEQ ID NO: 7899 - DNA, 20 bp, Artificial Sequence
  sgRNA
  2900092C05Rik_3
tgaacaagtccaggcctacg

SEQ ID NO: 7900 - DNA, 20 bp, Artificial Sequence
  sgRNA
  2900092C05Rik_4
tatgcaaagacttacgtgct

SEQ ID NO: 7901 - DNA, 20 bp, Artificial Sequence
  sgRNA
  2900092C05Rik_5
gagcatgagcccacatagca

SEQ ID NO: 7902 - DNA, 20 bp, Artificial Sequence
  sgRNA
  2900092C05Rik_6
ttatttgtatcgaattctga

SEQ ID NO: 7903 - DNA, 20 bp, Artificial Sequence
  sgRNA
  2900092C05Rik_7
tcttctatgggacagcccag

SEQ ID NO: 7904 - DNA, 20 bp, Artificial Sequence
  sgRNA
  2900092C05Rik_8
gcctctttctcatctacaag

SEQ ID NO: 7905 - DNA, 20 bp, Artificial Sequence
  sgRNA
  2900092C05Rik_9
gtataaagctcatctgcata

SEQ ID NO: 7906 - DNA, 20 bp, Artificial Sequence
  sgRNA
  2900092C05Rik_10
acatagcagggcaatgacaa

SEQ ID NO: 7907 - DNA, 20 bp, Artificial Sequence
  sgRNA
  2900092C05Rik_11
tcagttgcatccagagaatg

SEQ ID NO: 7908 - DNA, 20 bp, Artificial Sequence
  sgRNA
  2900092C05Rik_12
atcataaccatcatcttcag

SEQ ID NO: 7909 - DNA, 20 bp, Artificial Sequence
  sgRNA
  2900092C05Rik_13
gaaacttctaaatcttctat

SEQ ID NO: 7910 - DNA, 20 bp, Artificial Sequence
  sgRNA
  2900092C05Rik_14
gaaattacatgaacaagtcc

SEQ ID NO: 7911 - DNA, 20 bp, Artificial Sequence
  sgRNA
  2900092C05Rik_15
tttcccagctcctcattctc

SEQ ID NO: 7912 - DNA, 20 bp, Artificial Sequence
  sgRNA
  2900092C05Rik_16
gctgggattattacttctgt

SEQ ID NO: 7913 - DNA, 20 bp, Artificial Sequence
  sgRNA
  2900092C05Rik_17
aattctgatggcttcacagt

SEQ ID NO: 7914 - DNA, 20 bp, Artificial Sequence
  sgRNA
  2900092C05Rik_18
aaggcaagcagacatgaagt

SEQ ID NO: 7915 - DNA, 20 bp, Artificial Sequence
  sgRNA
  2900092C05Rik_19
ttgtcattgccctgctatgt

SEQ ID NO: 7916 - DNA, 20 bp, Artificial Sequence
  sgRNA
  2900092C05Rik_20
aaagaggcctctgaagatga

SEQ ID NO: 7917 - DNA, 20 bp, Artificial Sequence
  sgRNA
  4922502D21Rik_1
gtatccaacataaaaactcg

SEQ ID NO: 7918 - DNA, 20 bp, Artificial Sequence
  sgRNA
  4922502D21Rik_2
ctcagacaagccatgaacgc

SEQ ID NO: 7919 - DNA, 20 bp, Artificial Sequence
  sgRNA
  4922502D21Rik_3
aaacaagacatgtgacgacg

SEQ ID NO: 7920 - DNA, 20 bp, Artificial Sequence
  sgRNA
  4922502D21Rik_4
acctcctagcagggtccaaa

SEQ ID NO: 7921 - DNA, 20 bp, Artificial Sequence
  sgRNA
  4922502D21Rik_5
agttgcatcatggagttcgc

SEQ ID NO: 7922 - DNA, 20 bp, Artificial Sequence
  sgRNA
  4922502D21Rik_6
acacagccagagttgcatca

SEQ ID NO: 7923 - DNA, 20 bp, Artificial Sequence
  sgRNA
  4922502D21Rik_7
ctgcgttcatggcttgtctg

SEQ ID NO: 7924 - DNA, 20 bp, Artificial Sequence
  sgRNA
  4922502D21Rik_8
tgtgccttcgtgcatcaaaa

SEQ ID NO: 7925 - DNA, 20 bp, Artificial Sequence
  sgRNA
  4922502D21Rik_9
catagacagtaccagttgtg

SEQ ID NO: 7926 - DNA, 20 bp, Artificial Sequence
  sgRNA
  4922502D21Rik_10
aggtagtctgggtgaagtgt

SEQ ID NO: 7927 - DNA, 20 bp, Artificial Sequence
  sgRNA
  4922502D21Rik_11
accctttggaccctgctagg

SEQ ID NO: 7928 - DNA, 20 bp, Artificial Sequence
  sgRNA
  4922502D21Rik_12
agcaacagcacctcctagca

SEQ ID NO: 7929 - DNA, 20 bp, Artificial Sequence
  sgRNA
  4922502D21Rik_13
atggagttcgcaggtgtcgt

SEQ ID NO: 7930 - DNA, 20 bp, Artificial Sequence
  sgRNA
  4922502D21Rik_14
gtagtttgttccagtcttta

SEQ ID NO: 7931 - DNA, 20 bp, Artificial Sequence
  sgRNA
  4922502D21Rik_15
cgaactccatgatgcaactc

SEQ ID NO: 7932 - DNA, 20 bp, Artificial Sequence
  sgRNA
  4922502D21Rik_16
gttcatcgacaaaactgaag

SEQ ID NO: 7933 - DNA, 20 bp, Artificial Sequence
  sgRNA
  4922502D21Rik_17
tggcttgtctgaggtagtct

SEQ ID NO: 7934 - DNA, 20 bp, Artificial Sequence
  sgRNA
  4922502D21Rik_18
aggcacactgaccatgatct

SEQ ID NO: 7935 - DNA, 20 bp, Artificial Sequence
  sgRNA
  4922502D21Rik_19
taaagctgtgccctaaagac

SEQ ID NO: 7936 - DNA, 20 bp, Artificial Sequence
  sgRNA
  4922502D21Rik_20
ctgcacagacaaaatttatt

SEQ ID NO: 7937 - DNA, 20 bp, Artificial Sequence
  sgRNA
  5330417C22Rik_1
gaggcgatgtagtctccccg

SEQ ID NO: 7938 - DNA, 20 bp, Artificial Sequence
  sgRNA
  5330417C22Rik_2
gcgacagcacaggttccagg

SEQ ID NO: 7939 - DNA, 20 bp, Artificial Sequence
  sgRNA
  5330417C22Rik_3
gagtatttgtcagcatcaca

SEQ ID NO: 7940 - DNA, 20 bp, Artificial Sequence
  sgRNA
  5330417C22Rik_4
ggtgatgggctacaaggccg

SEQ ID NO: 7941 - DNA, 20 bp, Artificial Sequence
  sgRNA
  5330417C22Rik_5
tgtagcccatcacctcagag

SEQ ID NO: 7942 - DNA, 20 bp, Artificial Sequence
  sgRNA
  5330417C22Rik_6
gcaggaactgagcctgccgt

SEQ ID NO: 7943 - DNA, 20 bp, Artificial Sequence
  sgRNA
  5330417C22Rik_7
tcttaaagactgcgacctgc

SEQ ID NO: 7944 - DNA, 20 bp, Artificial Sequence
  sgRNA
  5330417C22Rik_8
tgctactgtgagcttcacat

SEQ ID NO: 7945 - DNA, 20 bp, Artificial Sequence
  sgRNA
  5330417C22Rik_9
gactatgtccggaattcccg

SEQ ID NO: 7946 - DNA, 20 bp, Artificial Sequence
  sgRNA
  5330417C22Rik_10
tgctggccattacatcaacc

SEQ ID NO: 7947 - DNA, 20 bp, Artificial Sequence
  sgRNA
  5330417C22Rik_11
tgggccataccaaaaatctg

SEQ ID NO: 7948 - DNA, 20 bp, Artificial Sequence
  sgRNA
  5330417C22Rik_12
gcgatgtttctaacaagcac

SEQ ID NO: 7949 - DNA, 20 bp, Artificial Sequence
  sgRNA
  5330417C22Rik_13
gctgtcatcgacctccaagt

SEQ ID NO: 7950 - DNA, 20 bp, Artificial Sequence
  sgRNA
  5330417C22Rik_14
ccagtgctgatgactccagg

SEQ ID NO: 7951 - DNA, 20 bp, Artificial Sequence
  sgRNA
  5330417C22Rik_15
cttgcaggggaaacactcgg

SEQ ID NO: 7952 - DNA, 20 bp, Artificial Sequence
  sgRNA
  5330417C22Rik_16
gtagtagtactcaaagttaa

SEQ ID NO: 7953 - DNA, 20 bp, Artificial Sequence
  sgRNA
  5330417C22Rik_17
agccccttcgaggtgaagct

SEQ ID NO: 7954 - DNA, 20 bp, Artificial Sequence
  sgRNA
  5330417C22Rik_18
cgacctccaagttggccgag

SEQ ID NO: 7955 - DNA, 20 bp, Artificial Sequence
  sgRNA
  5330417C22Rik_19
gcaggaggagcccaaatcag

SEQ ID NO: 7956 - DNA, 20 bp, Artificial Sequence
  sgRNA
  5330417C22Rik_20
gacaaaagtgtggtagtcag

SEQ ID NO: 7957 - DNA, 20 bp, Artificial Sequence
  sgRNA
  5830411N06Rik_1
tcaggtgtcaaaacataccg

SEQ ID NO: 7958 - DNA, 20 bp, Artificial Sequence
  sgRNA
  5830411N06Rik_2
ccttcaatcttacacccagg

SEQ ID NO: 7959 - DNA, 20 bp, Artificial Sequence
  sgRNA
  5830411N06Rik_3
gccataagaccattcctgtg

SEQ ID NO: 7960 - DNA, 20 bp, Artificial Sequence
  sgRNA
  5830411N06Rik_4
gtggtaccacactacaaatg

SEQ ID NO: 7961 - DNA, 20 bp, Artificial Sequence
  sgRNA
  5830411N06Rik_5
ccagctccctacaaaccacg

SEQ ID NO: 7962 - DNA, 20 bp, Artificial Sequence
  sgRNA
  5830411N06Rik_6
cctgtaccaaaagctccacg

SEQ ID NO: 7963 - DNA, 20 bp, Artificial Sequence
  sgRNA
  5830411N06Rik_7
gctctgatcgtgtcagcctg

SEQ ID NO: 7964 - DNA, 20 bp, Artificial Sequence
  sgRNA
  5830411N06Rik_8
ggtggtaccacactacaaat

SEQ ID NO: 7965 - DNA, 20 bp, Artificial Sequence
  sgRNA
  5830411N06Rik_9
gcagccactgatggtccccc

SEQ ID NO: 7966 - DNA, 20 bp, Artificial Sequence
  sgRNA
  5830411N06Rik_10
gagcagtctccatatcccca

SEQ ID NO: 7967 - DNA, 20 bp, Artificial Sequence
  sgRNA
  5830411N06Rik_11
tgaccttctgacctacaccc

SEQ ID NO: 7968 - DNA, 20 bp, Artificial Sequence
  sgRNA
  5830411N06Rik_12
cttcaacacgcccagcacag

SEQ ID NO: 7969 - DNA, 20 bp, Artificial Sequence
  sgRNA
  5830411N06Rik_13
acaccacagcagcatcacgc

SEQ ID NO: 7970 - DNA, 20 bp, Artificial Sequence
  sgRNA
  5830411N06Rik_14
gttcttagaggacttacctg

SEQ ID NO: 7971 - DNA, 20 bp, Artificial Sequence
  sgRNA
  5830411N06Rik_15
ctgtccctccctcagccgaa

SEQ ID NO: 7972 - DNA, 20 bp, Artificial Sequence
  sgRNA
  5830411N06Rik_16
gccatacaggccctgaacca

SEQ ID NO: 7973 - DNA, 20 bp, Artificial Sequence
  sgRNA
  5830411N06Rik_17
tcaatcgtagacgagcccct

SEQ ID NO: 7974 - DNA, 20 bp, Artificial Sequence
  sgRNA
  5830411N06Rik_18
ggacgcctagaggttcttag

SEQ ID NO: 7975 - DNA, 20 bp, Artificial Sequence
  sgRNA
  5830411N06Rik_19
gagcccacgatggaactaac

SEQ ID NO: 7976 - DNA, 20 bp, Artificial Sequence
  sgRNA
  5830411N06Rik_20
gctgcccaacaagcacctta

SEQ ID NO: 7977 - DNA, 20 bp, Artificial Sequence
  sgRNA
  9330182L06Rik_1
ccatctgaaaacgtccccgg

SEQ ID NO: 7978 - DNA, 20 bp, Artificial Sequence
  sgRNA
  9330182L06Rik_2
agaatgtattaggtgtaagg

SEQ ID NO: 7979 - DNA, 20 bp, Artificial Sequence
  sgRNA
  9330182L06Rik_3
tgcaacattcatggacactg

SEQ ID NO: 7980 - DNA, 20 bp, Artificial Sequence
  sgRNA
  9330182L06Rik_4
agtcgctatagcaaagcgag

SEQ ID NO: 7981 - DNA, 20 bp, Artificial Sequence
  sgRNA
  9330182L06Rik_5
ataccccctgtgacgaagaa

SEQ ID NO: 7982 - DNA, 20 bp, Artificial Sequence
  sgRNA
  9330182L06Rik_6
catctgaaaacgtccccgga

SEQ ID NO: 7983 - DNA, 20 bp, Artificial Sequence
  sgRNA
  9330182L06Rik_7
agtgctggctctgttccggc

SEQ ID NO: 7984 - DNA, 20 bp, Artificial Sequence
  sgRNA
  9330182L06Rik_8
gatagagccaaaaatctgca

SEQ ID NO: 7985 - DNA, 20 bp, Artificial Sequence
  sgRNA
  9330182L06Rik_9
gttccatctgaaaacgtccc

SEQ ID NO: 7986 - DNA, 20 bp, Artificial Sequence
  sgRNA
  9330182L06Rik_10
agtgtaggctcgctgatgaa

SEQ ID NO: 7987 - DNA, 20 bp, Artificial Sequence
  sgRNA
  9330182L06Rik_11
gcaacgttggaaaatcctgc

SEQ ID NO: 7988 - DNA, 20 bp, Artificial Sequence
  sgRNA
  9330182L06Rik_12
gactctatatagttcccacg

SEQ ID NO: 7989 - DNA, 20 bp, Artificial Sequence
  sgRNA
  9330182L06Rik_13
cttctttgagtaccagtacg

SEQ ID NO: 7990 - DNA, 20 bp, Artificial Sequence
  sgRNA
  9330182L06Rik_14
cggaatggcgaccctccacc

SEQ ID NO: 7991 - DNA, 20 bp, Artificial Sequence
  sgRNA
  9330182L06Rik_15
tcagctgaacagactcaaag

SEQ ID NO: 7992 - DNA, 20 bp, Artificial Sequence
  sgRNA
  9330182L06Rik_16
cttgccatccctgccctccg

SEQ ID NO: 7993 - DNA, 20 bp, Artificial Sequence
  sgRNA
  9330182L06Rik_17
gaatgggatgaattgccggc

SEQ ID NO: 7994 - DNA, 20 bp, Artificial Sequence
  sgRNA
  9330182L06Rik_18
gttgggaattccaagtgcga

SEQ ID NO: 7995 - DNA, 20 bp, Artificial Sequence
  sgRNA
  9330182L06Rik_19
tccccatgattccaccacat

SEQ ID NO: 7996 - DNA, 20 bp, Artificial Sequence
  sgRNA
  9330182L06Rik_20
actgatatcacacctgcacc

SEQ ID NO: 7997 - DNA, 20 bp, Artificial Sequence
  sgRNA
  9430015G10Rik_1
ccagcaacctgagtgttgca

SEQ ID NO: 7998 - DNA, 20 bp, Artificial Sequence
  sgRNA
  9430015G10Rik_2
agagccattgtatgtcggga

SEQ ID NO: 7999 - DNA, 20 bp, Artificial Sequence
  sgRNA
  9430015G10Rik_3
tgctgatgaagagtgtcccc

SEQ ID NO: 8000 - DNA, 20 bp, Artificial Sequence
  sgRNA
  9430015G10Rik_4
tgcctcggtacaggtctctg

SEQ ID NO: 8001 - DNA, 20 bp, Artificial Sequence
  sgRNA
  9430015G10Rik_5
ggccacagagacctgtaccg

SEQ ID NO: 8002 - DNA, 20 bp, Artificial Sequence
  sgRNA
  9430015G10Rik_6
gggaccctcccgacatacaa

SEQ ID NO: 8003 - DNA, 20 bp, Artificial Sequence
  sgRNA
  9430015G10Rik_7
ttcccatgaacaggagcacg

SEQ ID NO: 8004 - DNA, 20 bp, Artificial Sequence
  sgRNA
  9430015G10Rik_8
gcagcacccagacaagaata

SEQ ID NO: 8005 - DNA, 20 bp, Artificial Sequence
  sgRNA
  9430015G10Rik_9
gggacactcttcatcagcac

SEQ ID NO: 8006 - DNA, 20 bp, Artificial Sequence
  sgRNA
  9430015G10Rik_10
agaagaatccagccacagag

SEQ ID NO: 8007 - DNA, 20 bp, Artificial Sequence
  sgRNA
  9430015G10Rik_11
gcttcccatgaacaggagca

SEQ ID NO: 8008 - DNA, 20 bp, Artificial Sequence
  sgRNA
  9430015G10Rik_12
ctgactggccttctgacagg

SEQ ID NO: 8009 - DNA, 20 bp, Artificial Sequence
  sgRNA
  9430015G10Rik_13
gcgctccagcaaacttcctg

SEQ ID NO: 8010 - DNA, 20 bp, Artificial Sequence
  sgRNA
  9430015G10Rik_14
ggagggtcccattccagcac

SEQ ID NO: 8011 - DNA, 20 bp, Artificial Sequence
  sgRNA
  9430015G10Rik_15
gtgcaagtccacagaaagcc

SEQ ID NO: 8012 - DNA, 20 bp, Artificial Sequence
  sgRNA
  9430015G10Rik_16
tctctcctgtagaaaacctc

SEQ ID NO: 8013 - DNA, 20 bp, Artificial Sequence
  sgRNA
  9430015G10Rik_17
accacatccatgcaacactc

SEQ ID NO: 8014 - DNA, 20 bp, Artificial Sequence
  sgRNA
  9430015G10Rik_18
tgcacacgcctcctgtcaga

SEQ ID NO: 8015 - DNA, 20 bp, Artificial Sequence
  sgRNA
  9430015G10Rik_19
acctgagtgttgcatggatg

SEQ ID NO: 8016 - DNA, 20 bp, Artificial Sequence
  sgRNA
  9430015G10Rik_20
gtccccgtgctcctgttcat

SEQ ID NO: 8017 - DNA, 20 bp, Artificial Sequence
  sgRNA
  AC117241.1_1
cacaacgcaagagaagtgaa

SEQ ID NO: 8018 - DNA, 20 bp, Artificial Sequence
  sgRNA
  AC117241.1_2
agggctgcgctctatgcact

SEQ ID NO: 8019 - DNA, 20 bp, Artificial Sequence
  sgRNA
  AC117241.1_3
cattcacttctcttgcgttg

SEQ ID NO: 8020 - DNA, 20 bp, Artificial Sequence
  sgRNA
  AC117241.1_4
cagggctgcgctctatgcac

SEQ ID NO: 8021 - DNA, 20 bp, Artificial Sequence
  sgRNA
  AC117241.1_5
gcgttgtggtcttcctgctg

SEQ ID NO: 8022 - DNA, 20 bp, Artificial Sequence
  sgRNA
  AC117241.1_6
cgcagccctgcccgtgtact

SEQ ID NO: 8023 - DNA, 20 bp, Artificial Sequence
  sgRNA
  AI593442_1
ctttccacatccacaagcgt

SEQ ID NO: 8024 - DNA, 20 bp, Artificial Sequence
  sgRNA
  AI593442_2
tggtggcacttgcatcacgc

SEQ ID NO: 8025 - DNA, 20 bp, Artificial Sequence
  sgRNA
  AI593442_3
gaaaagaaacccgactggag

SEQ ID NO: 8026 - DNA, 20 bp, Artificial Sequence
  sgRNA
  AI593442_4
gtccggttcaggagacaagg

SEQ ID NO: 8027 - DNA, 20 bp, Artificial Sequence
  sgRNA
  AI593442_5
tatgagcgagatcattgcag

SEQ ID NO: 8028 - DNA, 20 bp, Artificial Sequence
  sgRNA
  AI593442_6
aagtggagagggacagcacg

SEQ ID NO: 8029 - DNA, 20 bp, Artificial Sequence
  sgRNA
  AI593442_7
gatcattgcagcggcagcca

SEQ ID NO: 8030 - DNA, 20 bp, Artificial Sequence
  sgRNA
  AI593442_8
ggagcttgaacacctgcccg

SEQ ID NO: 8031 - DNA, 20 bp, Artificial Sequence
  sgRNA
  AI593442_9
tgcttggacacacctggcga

SEQ ID NO: 8032 - DNA, 20 bp, Artificial Sequence
  sgRNA
  AI593442_10
gtggatgtggaaagtggaga

SEQ ID NO: 8033 - DNA, 20 bp, Artificial Sequence
  sgRNA
  AI593442_11
gcttcccacaacgccagtgg

SEQ ID NO: 8034 - DNA, 20 bp, Artificial Sequence
  sgRNA
  AI593442_12
gccaggtgtgtccaagcagg

SEQ ID NO: 8035 - DNA, 20 bp, Artificial Sequence
  sgRNA
  AI593442_13
gtgcagaaagcggagtcccg

SEQ ID NO: 8036 - DNA, 20 bp, Artificial Sequence
  sgRNA
  AI593442_14
tttgcttcccacaacgccag

SEQ ID NO: 8037 - DNA, 20 bp, Artificial Sequence
  sgRNA
  AI593442_15
gtccaagcaggaggaagctg

SEQ ID NO: 8038 - DNA, 20 bp, Artificial Sequence
  sgRNA
  AI593442_16
gtttgcaaaaggccctcgcc

SEQ ID NO: 8039 - DNA, 20 bp, Artificial Sequence
  sgRNA
  AI593442_17
acaagcgtaggatgaagaag

SEQ ID NO: 8040 - DNA, 20 bp, Artificial Sequence
  sgRNA
  AI593442_18
ggttcaggagacaaggcggc

SEQ ID NO: 8041 - DNA, 20 bp, Artificial Sequence
  sgRNA
  AI593442_19
gcttcttcatcctacgcttg

SEQ ID NO: 8042 - DNA, 20 bp, Artificial Sequence
  sgRNA
  AI593442_20
ggcacttgcatcacgcaggt

SEQ ID NO: 8043 - DNA, 20 bp, Artificial Sequence
  sgRNA
  Abca1_1
acatgtcatcaacataacag

SEQ ID NO: 8044 - DNA, 20 bp, Artificial Sequence
  sgRNA
  Abca1_2
gtggacccgtactctcgcag

SEQ ID NO: 8045 - DNA, 20 bp, Artificial Sequence
  sgRNA
  Abca1_3
caagctgtcaagcaacactg

SEQ ID NO: 8046 - DNA, 20 bp, Artificial Sequence
  sgRNA
  Abca1_4
ggtatacacagagccatttg

SEQ ID NO: 8047 - DNA, 20 bp, Artificial Sequence
  sgRNA
  Abca1_5
ggaagacgaacaccacgctg

SEQ ID NO: 8048 - DNA, 20 bp, Artificial Sequence
  sgRNA
  Abca1_6
gcgagagtacgggtccaccc

SEQ ID NO: 8049 - DNA, 20 bp, Artificial Sequence
  sgRNA
  Abca1_7
ggtggacccgtactctcgca

SEQ ID NO: 8050 - DNA, 20 bp, Artificial Sequence
  sgRNA
  Abca1_8
agatgacacagatagacacg

SEQ ID NO: 8051 - DNA, 20 bp, Artificial Sequence
  sgRNA
  Abca1_9
gctcggagatgagctccatc

SEQ ID NO: 8052 - DNA, 20 bp, Artificial Sequence
  sgRNA
  Abca1_10
ggaagcacgtgtctgaagcc

SEQ ID NO: 8053 - DNA, 20 bp, Artificial Sequence
  sgRNA
  Abca1_11
ctttggagggaataacaccg

SEQ ID NO: 8054 - DNA, 20 bp, Artificial Sequence
  sgRNA
  Abca1_12
tcatcctcgtcattcaaagg

SEQ ID NO: 8055 - DNA, 20 bp, Artificial Sequence
  sgRNA
  Abca1_13
gcaaggtatcggggtccaat

SEQ ID NO: 8056 - DNA, 20 bp, Artificial Sequence
  sgRNA
  Abca1_14
gcaaggctaccaattacatt

SEQ ID NO: 8057 - DNA, 20 bp, Artificial Sequence
  sgRNA
  Abca1_15
gtccagacccatgatccgca

SEQ ID NO: 8058 - DNA, 20 bp, Artificial Sequence
  sgRNA
  Abca1_16
ccatgaatcgagatatcgtc

SEQ ID NO: 8059 - DNA, 20 bp, Artificial Sequence
  sgRNA
  Abca1_17
ggttctatgcgcgcctaaag

SEQ ID NO: 8060 - DNA, 20 bp, Artificial Sequence
  sgRNA
  Abca1_18
actggtgagaaccacatagg

SEQ ID NO: 8061 - DNA, 20 bp, Artificial Sequence
  sgRNA
  Abca1_19
atattcccctgcgagagtac

SEQ ID NO: 8062 - DNA, 20 bp, Artificial Sequence
  sgRNA
  Abca1_20
gatagtaacccgttcccaac

SEQ ID NO: 8063 - DNA, 20 bp, Artificial Sequence
  sgRNA
  Abca12_1
catagcagttaagtactcgg

SEQ ID NO: 8064 - DNA, 20 bp, Artificial Sequence
  sgRNA
  Abca12_2
acggctcataccaaccgtag

SEQ ID NO: 8065 - DNA, 20 bp, Artificial Sequence
  sgRNA
  Abca12_3
gataacgatgaggattgcaa

SEQ ID NO: 8066 - DNA, 20 bp, Artificial Sequence
  sgRNA
  Abca12_4
ggcatgggtaaactcaacat

SEQ ID NO: 8067 - DNA, 20 bp, Artificial Sequence
  sgRNA
  Abca12_5
tctctaacatgagcttcgag

SEQ ID NO: 8068 - DNA, 20 bp, Artificial Sequence
  sgRNA
  Abca12_6
agaggttccaccacacccgc

SEQ ID NO: 8069 - DNA, 20 bp, Artificial Sequence
  sgRNA
  Abca12_7
gattgtgcttatggtcgcct

SEQ ID NO: 8070 - DNA, 20 bp, Artificial Sequence
  sgRNA
  Abca12_8
tcaatctgaacttctacgaa

SEQ ID NO: 8071 - DNA, 20 bp, Artificial Sequence
  sgRNA
  Abca12_9
catagtccgcagtgtaccca

SEQ ID NO: 8072 - DNA, 20 bp, Artificial Sequence
  sgRNA
  Abca12_10
tgtatagccacccttatcca

SEQ ID NO: 8073 - DNA, 20 bp, Artificial Sequence
  sgRNA
  Abca12_11
cggtttccctatcaaggcca

SEQ ID NO: 8074 - DNA, 20 bp, Artificial Sequence
  sgRNA
  Abca12_12
ggatcgtctggtttagcagg

SEQ ID NO: 8075 - DNA, 20 bp, Artificial Sequence
  sgRNA
  Abca12_13
gccgtggctacaaagacgat

SEQ ID NO: 8076 - DNA, 20 bp, Artificial Sequence
  sgRNA
  Abca12_14
tccaaagcgctctttccaat

SEQ ID NO: 8077 - DNA, 20 bp, Artificial Sequence
  sgRNA
  Abca12_15
tcggaggtgccgtaaatgga

SEQ ID NO: 8078 - DNA, 20 bp, Artificial Sequence
  sgRNA
  Abca12_16
atatccatagctctcatcgg

SEQ ID NO: 8079 - DNA, 20 bp, Artificial Sequence
  sgRNA
  Abca12_17
agagttggaacgttgtcggg

SEQ ID NO: 8080 - DNA, 20 bp, Artificial Sequence
  sgRNA
  Abca12_18
tcataattctggctattacc

SEQ ID NO: 8081 - DNA, 20 bp, Artificial Sequence
  sgRNA
  Abca12_19
gcttggatattccacaccgt

SEQ ID NO: 8082 - DNA, 20 bp, Artificial Sequence
  sgRNA
  Abca12_20
tgcgactcctcatcaatgag

SEQ ID NO: 8083 - DNA, 20 bp, Artificial Sequence
  sgRNA
  Abca13_1
agtatgttataactatgact

SEQ ID NO: 8084 - DNA, 20 bp, Artificial Sequence
  sgRNA
  Abca13_2
tgtgaattattcaggaaacg

SEQ ID NO: 8085 - DNA, 20 bp, Artificial Sequence
  sgRNA
  Abca13_3
cctactagtaccataaagca

SEQ ID NO: 8086 - DNA, 20 bp, Artificial Sequence
  sgRNA
  Abca13_4
aggccatcttgcctcaactg

SEQ ID NO: 8087 - DNA, 20 bp, Artificial Sequence
  sgRNA
  Abca13_5
attagtctgggcataccacg

SEQ ID NO: 8088 - DNA, 20 bp, Artificial Sequence
  sgRNA
  Abca13_6
gctgacctataccatcccca

SEQ ID NO: 8089 - DNA, 20 bp, Artificial Sequence
  sgRNA
  Abca13_7
ttatatttgaatccgccggc

SEQ ID NO: 8090 - DNA, 20 bp, Artificial Sequence
  sgRNA
  Abca13_8
acttgggatgacagtctgcc

SEQ ID NO: 8091 - DNA, 20 bp, Artificial Sequence
  sgRNA
  Abca13_9
cttccacatcatagcccgag

SEQ ID NO: 8092 - DNA, 20 bp, Artificial Sequence
  sgRNA
  Abca13_10
cctgcaccagaccatccccc

SEQ ID NO: 8093 - DNA, 20 bp, Artificial Sequence
  sgRNA
  Abca13_11
ttaaacagcagagcgagtcg

SEQ ID NO: 8094 - DNA, 20 bp, Artificial Sequence
  sgRNA
  Abca13_12
cgcgcagtccaaaaaccatg

SEQ ID NO: 8095 - DNA, 20 bp, Artificial Sequence
  sgRNA
  Abca13_13
cggccagaagaactcagcca

SEQ ID NO: 8096 - DNA, 20 bp, Artificial Sequence
  sgRNA
  Abca13_14
gccctgcctgagccgatagg

SEQ ID NO: 8097 - DNA, 20 bp, Artificial Sequence
  sgRNA
  Abca13_15
agataagatgtttaaccacg

SEQ ID NO: 8098 - DNA, 20 bp, Artificial Sequence
  sgRNA
  Abca13_16
tcacagcatggaagagtgcg

SEQ ID NO: 8099 - DNA, 20 bp, Artificial Sequence
  sgRNA
  Abca13_17
gtagtttgcgcaccaaaccc

SEQ ID NO: 8100 - DNA, 20 bp, Artificial Sequence
  sgRNA
  Abca13_18
tgcttccttcagcttccgca

SEQ ID NO: 8101 - DNA, 20 bp, Artificial Sequence
  sgRNA
  Abca13_19
acatcatccatgcagtcagt

SEQ ID NO: 8102 - DNA, 20 bp, Artificial Sequence
  sgRNA
  Abca13_20
cagatatcagagccactcct

SEQ ID NO: 8103 - DNA, 20 bp, Artificial Sequence
  sgRNA
  Abca2_1
catgtatgtagcgatccgcg

SEQ ID NO: 8104 - DNA, 20 bp, Artificial Sequence
  sgRNA
  Abca2_2
ctggacgccaataagcacgg

SEQ ID NO: 8105 - DNA, 20 bp, Artificial Sequence
  sgRNA
  Abca2_3
taagggataaagttgccacg

SEQ ID NO: 8106 - DNA, 20 bp, Artificial Sequence
  sgRNA
  Abca2_4
gagcctgaagcgcttcggag

SEQ ID NO: 8107 - DNA, 20 bp, Artificial Sequence
  sgRNA
  Abca2_5
gtatgtagcgatccgcgagg

SEQ ID NO: 8108 - DNA, 20 bp, Artificial Sequence
  sgRNA
  Abca2_6
gacaatgtcccactcgaacg

SEQ ID NO: 8109 - DNA, 20 bp, Artificial Sequence
  sgRNA
  Abca2_7
gaggaagtagaagcgaccac

SEQ ID NO: 8110 - DNA, 20 bp, Artificial Sequence
  sgRNA
  Abca2_8
actggctcatgcactaggcg

SEQ ID NO: 8111 - DNA, 20 bp, Artificial Sequence
  sgRNA
  Abca2_9
atagtggctgagcccgacgt

SEQ ID NO: 8112 - DNA, 20 bp, Artificial Sequence
  sgRNA
  Abca2_10
ttgtccacacagacgaccaa

SEQ ID NO: 8113 - DNA, 20 bp, Artificial Sequence
  sgRNA
  Abca2_11
ggtcccctaagagtgccggc

SEQ ID NO: 8114 - DNA, 20 bp, Artificial Sequence
  sgRNA
  Abca2_12
ataagcacggcggatctcat

SEQ ID NO: 8115 - DNA, 20 bp, Artificial Sequence
  sgRNA
  Abca2_13
tgtcatgggctacctcctcg

SEQ ID NO: 8116 - DNA, 20 bp, Artificial Sequence
  sgRNA
  Abca2_14
gctctttgaccggctcacgg

SEQ ID NO: 8117 - DNA, 20 bp, Artificial Sequence
  sgRNA
  Abca2_15
gatgacgatgaggaacacgt

SEQ ID NO: 8118 - DNA, 20 bp, Artificial Sequence
  sgRNA
  Abca2_16
tcagccgaggacaacctgag

SEQ ID NO: 8119 - DNA, 20 bp, Artificial Sequence
  sgRNA
  Abca2_17
gtgacaatgtcccactcgaa

SEQ ID NO: 8120 - DNA, 20 bp, Artificial Sequence
  sgRNA
  Abca2_18
cgatgggtaccgcctcacat

SEQ ID NO: 8121 - DNA, 20 bp, Artificial Sequence
  sgRNA
  Abca2_19
aattgccctcctccactaca

SEQ ID NO: 8122 - DNA, 20 bp, Artificial Sequence
  sgRNA
  Abca2_20
ttatgccaatgaggaacgcc

SEQ ID NO: 8123 - DNA, 20 bp, Artificial Sequence
  sgRNA
  Abca3_1
gaggagccacgaaaaagtag

SEQ ID NO: 8124 - DNA, 20 bp, Artificial Sequence
  sgRNA
  Abca3_2
agctggctaccacatgacgc

SEQ ID NO: 8125 - DNA, 20 bp, Artificial Sequence
  sgRNA
  Abca3_3
acacacgaagaaattacatg

SEQ ID NO: 8126 - DNA, 20 bp, Artificial Sequence
  sgRNA
  Abca3_4
aaggaggcggctttaatgag

SEQ ID NO: 8127 - DNA, 20 bp, Artificial Sequence
  sgRNA
  Abca3_5
ggaacccaagaactgtcgta

SEQ ID NO: 8128 - DNA, 20 bp, Artificial Sequence
  sgRNA
  Abca3_6
caatgtgcacgccttcacga

SEQ ID NO: 8129 - DNA, 20 bp, Artificial Sequence
  sgRNA
  Abca3_7
aattgtcgtccacgttgaca

SEQ ID NO: 8130 - DNA, 20 bp, Artificial Sequence
  sgRNA
  Abca3_8
gcgacctgcagggtgttccg

SEQ ID NO: 8131 - DNA, 20 bp, Artificial Sequence
  sgRNA
  Abca3_9
tcaatgtgcacgccttcacg

SEQ ID NO: 8132 - DNA, 20 bp, Artificial Sequence
  sgRNA
  Abca3_10
gctcagaaagacctgctcca

SEQ ID NO: 8133 - DNA, 20 bp, Artificial Sequence
  sgRNA
  Abca3_11
catggcgatgagcaaattga

SEQ ID NO: 8134 - DNA, 20 bp, Artificial Sequence
  sgRNA
  Abca3_12
agtatcccagagtagacgcc

SEQ ID NO: 8135 - DNA, 20 bp, Artificial Sequence
  sgRNA
  Abca3_13
gatgctgtaaccaccaacaa

SEQ ID NO: 8136 - DNA, 20 bp, Artificial Sequence
  sgRNA
  Abca3_14
gttatgtatgcacggctccg

SEQ ID NO: 8137 - DNA, 20 bp, Artificial Sequence
  sgRNA
  Abca3_15
aaggttgtccacgatggcca

SEQ ID NO: 8138 - DNA, 20 bp, Artificial Sequence
  sgRNA
  Abca3_16
ggggtgatggacccaacgaa

SEQ ID NO: 8139 - DNA, 20 bp, Artificial Sequence
  sgRNA
  Abca3_17
gcttgatcacatgactggca

SEQ ID NO: 8140 - DNA, 20 bp, Artificial Sequence
  sgRNA
  Abca3_18
cattgggcacattctccgac

SEQ ID NO: 8141 - DNA, 20 bp, Artificial Sequence
  sgRNA
  Abca3_19
gcttcgcttgaagatccagt

SEQ ID NO: 8142 - DNA, 20 bp, Artificial Sequence
  sgRNA
  Abca3_20
tggcctggtgacctggtacg

SEQ ID NO: 8143 - DNA, 20 bp, Artificial Sequence
  sgRNA
  Abca4_1
ataactataaagccttcctg

SEQ ID NO: 8144 - DNA, 20 bp, Artificial Sequence
  sgRNA
  Abca4_2
gctggaaattcaccaaacgg

SEQ ID NO: 8145 - DNA, 20 bp, Artificial Sequence
  sgRNA
  Abca4_3
ggtattgattagccaagcgt

SEQ ID NO: 8146 - DNA, 20 bp, Artificial Sequence
  sgRNA
  Abca4_4
ggaggtctgcctcgtccatg

SEQ ID NO: 8147 - DNA, 20 bp, Artificial Sequence
  sgRNA
  Abca4_5
gactacttccgtggatgccg

SEQ ID NO: 8148 - DNA, 20 bp, Artificial Sequence
  sgRNA
  Abca4_6
ggtgccaaacccaaatgcca

SEQ ID NO: 8149 - DNA, 20 bp, Artificial Sequence
  sgRNA
  Abca4_7
agcttgaagagaaatccgga

SEQ ID NO: 8150 - DNA, 20 bp, Artificial Sequence
  sgRNA
  Abca4_8
gtccactcaccacatggacg

SEQ ID NO: 8151 - DNA, 20 bp, Artificial Sequence
  sgRNA
  Abca4_9
catgttgcccgagtgccccg

SEQ ID NO: 8152 - DNA, 20 bp, Artificial Sequence
  sgRNA
  Abca4_10
gccaaggtgctggacctccg

SEQ ID NO: 8153 - DNA, 20 bp, Artificial Sequence
  sgRNA
  Abca4_11
ggtataccaccatgtcccag

SEQ ID NO: 8154 - DNA, 20 bp, Artificial Sequence
  sgRNA
  Abca4_12
ccagatgatgaacgtgagcg

SEQ ID NO: 8155 - DNA, 20 bp, Artificial Sequence
  sgRNA
  Abca4_13
acggcgttcctgggtcacaa

SEQ ID NO: 8156 - DNA, 20 bp, Artificial Sequence
  sgRNA
  Abca4_14
tcacaccatccgcagccgca

SEQ ID NO: 8157 - DNA, 20 bp, Artificial Sequence
  sgRNA
  Abca4_15
ggtgtccatgaactgcgaca

SEQ ID NO: 8158 - DNA, 20 bp, Artificial Sequence
  sgRNA
  Abca4_16
gattagccaagcgtaggaat

SEQ ID NO: 8159 - DNA, 20 bp, Artificial Sequence
  sgRNA
  Abca4_17
atgagcacagttcctgacgt

SEQ ID NO: 8160 - DNA, 20 bp, Artificial Sequence
  sgRNA
  Abca4_18
ggtcaactcccaagttcgtg

SEQ ID NO: 8161 - DNA, 20 bp, Artificial Sequence
  sgRNA
  Abca4_19
gatgtccgagagctgctcct

SEQ ID NO: 8162 - DNA, 20 bp, Artificial Sequence
  sgRNA
  Abca4_20
tcctggggattgattccaca

SEQ ID NO: 8163 - DNA, 20 bp, Artificial Sequence
  sgRNA
  Abca5_1
caagcgaaaaagttaagcgg

SEQ ID NO: 8164 - DNA, 20 bp, Artificial Sequence
  sgRNA
  Abca5_2
aaactataaggagctatcgg

SEQ ID NO: 8165 - DNA, 20 bp, Artificial Sequence
  sgRNA
  Abca5_3
cttcctggcaatccacatcg

SEQ ID NO: 8166 - DNA, 20 bp, Artificial Sequence
  sgRNA
  Abca5_4
tgcacaccagaacataatgg

SEQ ID NO: 8167 - DNA, 20 bp, Artificial Sequence
  sgRNA
  Abca5_5
attgccaggaagtagccgaa

SEQ ID NO: 8168 - DNA, 20 bp, Artificial Sequence
  sgRNA
  Abca5_6
aactataaggagctatcgga

SEQ ID NO: 8169 - DNA, 20 bp, Artificial Sequence
  sgRNA
  Abca5_7
gtcattctgctgcagtagcg

SEQ ID NO: 8170 - DNA, 20 bp, Artificial Sequence
  sgRNA
  Abca5_8
agggcgagaaggctatgacg

SEQ ID NO: 8171 - DNA, 20 bp, Artificial Sequence
  sgRNA
  Abca5_9
gtacgtgaacagaatgacgg

SEQ ID NO: 8172 - DNA, 20 bp, Artificial Sequence
  sgRNA
  Abca5_10
attccaatctaccctctcct

SEQ ID NO: 8173 - DNA, 20 bp, Artificial Sequence
  sgRNA
  Abca5_11
tcttcatcctcattgatggg

SEQ ID NO: 8174 - DNA, 20 bp, Artificial Sequence
  sgRNA
  Abca5_12
agattgacaccttcccgcga

SEQ ID NO: 8175 - DNA, 20 bp, Artificial Sequence
  sgRNA
  Abca5_13
agtgtatccaagaataacgt

SEQ ID NO: 8176 - DNA, 20 bp, Artificial Sequence
  sgRNA
  Abca5_14
ctgtaaagaagctacctgca

SEQ ID NO: 8177 - DNA, 20 bp, Artificial Sequence
  sgRNA
  Abca5_15
gagattgacaccttcccgcg

SEQ ID NO: 8178 - DNA, 20 bp, Artificial Sequence
  sgRNA
  Abca5_16
tacgtgaacagaatgacgga

SEQ ID NO: 8179 - DNA, 20 bp, Artificial Sequence
  sgRNA
  Abca5_17
catgaagtgagtactaaaca

SEQ ID NO: 8180 - DNA, 20 bp, Artificial Sequence
  sgRNA
  Abca5_18
gatgggttgccagtgttgtg

SEQ ID NO: 8181 - DNA, 20 bp, Artificial Sequence
  sgRNA
  Abca5_19
ccatgtaatgagtagtcagg

SEQ ID NO: 8182 - DNA, 20 bp, Artificial Sequence
  sgRNA
  Abca5_20
gcagtaccccatacacttaa

SEQ ID NO: 8183 - DNA, 20 bp, Artificial Sequence
  sgRNA
  Abca6_1
aagggatcgagtcctacagt

SEQ ID NO: 8184 - DNA, 20 bp, Artificial Sequence
  sgRNA
  Abca6_2
gtccacaccagtaggccgaa

SEQ ID NO: 8185 - DNA, 20 bp, Artificial Sequence
  sgRNA
  Abca6_3
aaaaacagcgaatagaaaca

SEQ ID NO: 8186 - DNA, 20 bp, Artificial Sequence
  sgRNA
  Abca6_4
aaaacagcgtaaatatgacc

SEQ ID NO: 8187 - DNA, 20 bp, Artificial Sequence
  sgRNA
  Abca6_5
ggatgcaaaatatataaacg

SEQ ID NO: 8188 - DNA, 20 bp, Artificial Sequence
  sgRNA
  Abca6_6
cggtagatccagaataccaa

SEQ ID NO: 8189 - DNA, 20 bp, Artificial Sequence
  sgRNA
  Abca6_7
aaaagctcagccaaatcccg

SEQ ID NO: 8190 - DNA, 20 bp, Artificial Sequence
  sgRNA
  Abca6_8
tctgcaacagaacagccatc

SEQ ID NO: 8191 - DNA, 20 bp, Artificial Sequence
  sgRNA
  Abca6_9
ttgggattgttaggacccga

SEQ ID NO: 8192 - DNA, 20 bp, Artificial Sequence
  sgRNA
  Abca6_10
tcaagagccattagttcaca

SEQ ID NO: 8193 - DNA, 20 bp, Artificial Sequence
  sgRNA
  Abca6_11
gttattgatgaccaataggc

SEQ ID NO: 8194 - DNA, 20 bp, Artificial Sequence
  sgRNA
  Abca6_12
gggtttcctgaaggaacgca

SEQ ID NO: 8195 - DNA, 20 bp, Artificial Sequence
  sgRNA
  Abca6_13
tacaaaccgccattaacgct

SEQ ID NO: 8196 - DNA, 20 bp, Artificial Sequence
  sgRNA
  Abca6_14
gtaccttcctttgcattgaa

SEQ ID NO: 8197 - DNA, 20 bp, Artificial Sequence
  sgRNA
  Abca6_15
gggtcaccagggcgacagca

SEQ ID NO: 8198 - DNA, 20 bp, Artificial Sequence
  sgRNA
  Abca6_16
tcagctcctccatcaccgag

SEQ ID NO: 8199 - DNA, 20 bp, Artificial Sequence
  sgRNA
  Abca6_17
ggttcaaaatactcatccga

SEQ ID NO: 8200 - DNA, 20 bp, Artificial Sequence
  sgRNA
  Abca6_18
attattataggactgcatat

SEQ ID NO: 8201 - DNA, 20 bp, Artificial Sequence
  sgRNA
  Abca6_19
gacttccaagatcctgagga

SEQ ID NO: 8202 - DNA, 20 bp, Artificial Sequence
  sgRNA
  Abca6_20
gggtctgcgaaccagcctat

SEQ ID NO: 8203 - DNA, 20 bp, Artificial Sequence
  sgRNA
  Abca7_1
gtgtcggcgcaagaaaagcg

SEQ ID NO: 8204 - DNA, 20 bp, Artificial Sequence
  sgRNA
  Abca7_2
gagaaaccatgcgtgcgatg

SEQ ID NO: 8205 - DNA, 20 bp, Artificial Sequence
  sgRNA
  Abca7_3
cagacacatttcggccagtg

SEQ ID NO: 8206 - DNA, 20 bp, Artificial Sequence
  sgRNA
  Abca7_4
aatcctaggacaaatgatgg

SEQ ID NO: 8207 - DNA, 20 bp, Artificial Sequence
  sgRNA
  Abca7_5
tagctatgcagaccgacccg

SEQ ID NO: 8208 - DNA, 20 bp, Artificial Sequence
  sgRNA
  Abca7_6
gcttgtgctaccctatgcgg

SEQ ID NO: 8209 - DNA, 20 bp, Artificial Sequence
  sgRNA
  Abca7_7
ggctgaagacgtcctccgcg

SEQ ID NO: 8210 - DNA, 20 bp, Artificial Sequence
  sgRNA
  Abca7_8
gttggcttcgtaccaattga

SEQ ID NO: 8211 - DNA, 20 bp, Artificial Sequence
  sgRNA
  Abca7_9
ttgctgtccgtggtgcgcga

SEQ ID NO: 8212 - DNA, 20 bp, Artificial Sequence
  sgRNA
  Abca7_10
gtgaccagccgaccagtcaa

SEQ ID NO: 8213 - DNA, 20 bp, Artificial Sequence
  sgRNA
  Abca7_11
cctgagggccatacatagca

SEQ ID NO: 8214 - DNA, 20 bp, Artificial Sequence
  sgRNA
  Abca7_12
cctccgctgtaggtacccgc

SEQ ID NO: 8215 - DNA, 20 bp, Artificial Sequence
  sgRNA
  Abca7_13
taccccagcctggtgcgccg

SEQ ID NO: 8216 - DNA, 20 bp, Artificial Sequence
  sgRNA
  Abca7_14
ggaacacgatgcctgcccag

SEQ ID NO: 8217 - DNA, 20 bp, Artificial Sequence
  sgRNA
  Abca7_15
gatacccgcacagtgctcgg

SEQ ID NO: 8218 - DNA, 20 bp, Artificial Sequence
  sgRNA
  Abca7_16
agctatgcagaccgacccgc

SEQ ID NO: 8219 - DNA, 20 bp, Artificial Sequence
  sgRNA
  Abca7_17
tttcttggcggccttcgcgg

SEQ ID NO: 8220 - DNA, 20 bp, Artificial Sequence
  sgRNA
  Abca7_18
atacggtctagcgcattccc

SEQ ID NO: 8221 - DNA, 20 bp, Artificial Sequence
  sgRNA
  Abca7_19
agtactgcttcaccactgct

SEQ ID NO: 8222 - DNA, 20 bp, Artificial Sequence
  sgRNA
  Abca7_20
gctttgctgcggaggccccg

SEQ ID NO: 8223 - DNA, 20 bp, Artificial Sequence
  sgRNA
  Abca8b_1
ccatagataatccataaagg

SEQ ID NO: 8224 - DNA, 20 bp, Artificial Sequence
  sgRNA
  Abca8b_2
acagatgacccatcctacaa

SEQ ID NO: 8225 - DNA, 20 bp, Artificial Sequence
  sgRNA
  Abca8b_3
ccttgctcaaaacctaagtg

SEQ ID NO: 8226 - DNA, 20 bp, Artificial Sequence
  sgRNA
  Abca8b_4
gcaaacctgtgcgatcgcaa

SEQ ID NO: 8227 - DNA, 20 bp, Artificial Sequence
  sgRNA
  Abca8b_5
gcccgacccagtaagccgaa

SEQ ID NO: 8228 - DNA, 20 bp, Artificial Sequence
  sgRNA
  Abca8b_6
cttccattccagacatcgaa

SEQ ID NO: 8229 - DNA, 20 bp, Artificial Sequence
  sgRNA
  Abca8b_7
agtcacctgatgaaggaacg

SEQ ID NO: 8230 - DNA, 20 bp, Artificial Sequence
  sgRNA
  Abca8b_8
ataccaccgtccactctggt

SEQ ID NO: 8231 - DNA, 20 bp, Artificial Sequence
  sgRNA
  Abca8b_9
gcctacgcaaagaatatgca

SEQ ID NO: 8232 - DNA, 20 bp, Artificial Sequence
  sgRNA
  Abca8b_10
gctccgggacaacagcccca

SEQ ID NO: 8233 - DNA, 20 bp, Artificial Sequence
  sgRNA
  Abca8b_11
ttacccttcgatgtctggaa

SEQ ID NO: 8234 - DNA, 20 bp, Artificial Sequence
  sgRNA
  Abca8b_12
ttactgtgagagaaaacctc

SEQ ID NO: 8235 - DNA, 20 bp, Artificial Sequence
  sgRNA
  Abca8b_13
gcaggtggagcccctcaata

SEQ ID NO: 8236 - DNA, 20 bp, Artificial Sequence
  sgRNA
  Abca8b_14
ttctagatgagccgtccact

SEQ ID NO: 8237 - DNA, 20 bp, Artificial Sequence
  sgRNA
  Abca8b_15
gcaccccctgatccagccag

SEQ ID NO: 8238 - DNA, 20 bp, Artificial Sequence
  sgRNA
  Abca8b_16
catccaaccagagtggacgg

SEQ ID NO: 8239 - DNA, 20 bp, Artificial Sequence
  sgRNA
  Abca8b_17
tattctaaccagcttcatgg

SEQ ID NO: 8240 - DNA, 20 bp, Artificial Sequence
  sgRNA
  Abca8b_18
attccttcttgacggacaaa

SEQ ID NO: 8241 - DNA, 20 bp, Artificial Sequence
  sgRNA
  Abca8b_19
tgttctggcgttccacagaa

SEQ ID NO: 8242 - DNA, 20 bp, Artificial Sequence
  sgRNA
  Abca8b_20
ggaaagtgttcatctccaat

SEQ ID NO: 8243 - DNA, 20 bp, Artificial Sequence
  sgRNA
  Abca9_1
tgggcgcttacaaagcgatg

SEQ ID NO: 8244 - DNA, 20 bp, Artificial Sequence
  sgRNA
  Abca9_2
gctgcccatcgcaatgtaag

SEQ ID NO: 8245 - DNA, 20 bp, Artificial Sequence
  sgRNA
  Abca9_3
taggtaagtacggacatcaa

SEQ ID NO: 8246 - DNA, 20 bp, Artificial Sequence
  sgRNA
  Abca9_4
ctgggttggatccactctcg

SEQ ID NO: 8247 - DNA, 20 bp, Artificial Sequence
  sgRNA
  Abca9_5
gcagtaccccaagaatccga

SEQ ID NO: 8248 - DNA, 20 bp, Artificial Sequence
  sgRNA
  Abca9_6
ttccagtgagtcattcagcg

SEQ ID NO: 8249 - DNA, 20 bp, Artificial Sequence
  sgRNA
  Abca9_7
gcttgtctatatcttgcccc

SEQ ID NO: 8250 - DNA, 20 bp, Artificial Sequence
  sgRNA
  Abca9_8
aatgaagcgtgtgatccaga

SEQ ID NO: 8251 - DNA, 20 bp, Artificial Sequence
  sgRNA
  Abca9_9
tccagtgagtcattcagcga

SEQ ID NO: 8252 - DNA, 20 bp, Artificial Sequence
  sgRNA
  Abca9_10
cgactgggatggaccccgaa

SEQ ID NO: 8253 - DNA, 20 bp, Artificial Sequence
  sgRNA
  Abca9_11
aactccagtgatcgtgagga

SEQ ID NO: 8254 - DNA, 20 bp, Artificial Sequence
  sgRNA
  Abca9_12
ggacgtacgacctttatccg

SEQ ID NO: 8255 - DNA, 20 bp, Artificial Sequence
  sgRNA
  Abca9_13
tcttcaagctcaagaatgaa

SEQ ID NO: 8256 - DNA, 20 bp, Artificial Sequence
  sgRNA
  Abca9_14
atagccaagccagtaagaaa

SEQ ID NO: 8257 - DNA, 20 bp, Artificial Sequence
  sgRNA
  Abca9_15
ccacatttgctgctgccctt

SEQ ID NO: 8258 - DNA, 20 bp, Artificial Sequence
  sgRNA
  Abca9_16
tgctgcccatcgcaatgtaa

SEQ ID NO: 8259 - DNA, 20 bp, Artificial Sequence
  sgRNA
  Abca9_17
aagccgttcttcgctttgcg

SEQ ID NO: 8260 - DNA, 20 bp, Artificial Sequence
  sgRNA
  Abca9_18
tgaagaaaaagatcgccacg

SEQ ID NO: 8261 - DNA, 20 bp, Artificial Sequence
  sgRNA
  Abca9_19
tgtgggcgcttacaaagcga

SEQ ID NO: 8262 - DNA, 20 bp, Artificial Sequence
  sgRNA
  Abca9_20
cctccttgggcaataaaagg

SEQ ID NO: 8263 - DNA, 20 bp, Artificial Sequence
  sgRNA
  Abcb11_1
tacgcaccatgccttcgcag

SEQ ID NO: 8264 - DNA, 20 bp, Artificial Sequence
  sgRNA
  Abcb11_2
atgaaggcgagtacacacca

SEQ ID NO: 8265 - DNA, 20 bp, Artificial Sequence
  sgRNA
  Abcb11_3
ccactgttcgaatagatgag

SEQ ID NO: 8266 - DNA, 20 bp, Artificial Sequence
  sgRNA
  Abcb11_4
aaggttgtgggtaatcactg

SEQ ID NO: 8267 - DNA, 20 bp, Artificial Sequence
  sgRNA
  Abcb11_5
ccttagcaatatccgcaccg

SEQ ID NO: 8268 - DNA, 20 bp, Artificial Sequence
  sgRNA
  Abcb11_6
tgacaaacggaacaagctgt

SEQ ID NO: 8269 - DNA, 20 bp, Artificial Sequence
  sgRNA
  Abcb11_7
gctgagacttagatcgttga

SEQ ID NO: 8270 - DNA, 20 bp, Artificial Sequence
  sgRNA
  Abcb11_8
gggctctcaactctctcgcg

SEQ ID NO: 8271 - DNA, 20 bp, Artificial Sequence
  sgRNA
  Abcb11_9
agacttagatcgttgacgga

SEQ ID NO: 8272 - DNA, 20 bp, Artificial Sequence
  sgRNA
  Abcb11_10
actgacagcgagaatcacca

SEQ ID NO: 8273 - DNA, 20 bp, Artificial Sequence
  sgRNA
  Abcb11_11
ttcgttctcttaacatccgg

SEQ ID NO: 8274 - DNA, 20 bp, Artificial Sequence
  sgRNA
  Abcb11_12
cctctcatctattcgaacag

SEQ ID NO: 8275 - DNA, 20 bp, Artificial Sequence
  sgRNA
  Abcb11_13
gctccactgtacacatcaat

SEQ ID NO: 8276 - DNA, 20 bp, Artificial Sequence
  sgRNA
  Abcb11_14
ggcaagaaatgatatcccct

SEQ ID NO: 8277 - DNA, 20 bp, Artificial Sequence
  sgRNA
  Abcb11_15
ggagctgttgatccatacaa

SEQ ID NO: 8278 - DNA, 20 bp, Artificial Sequence
  sgRNA
  Abcb11_16
ccattatccttctcgaccag

SEQ ID NO: 8279 - DNA, 20 bp, Artificial Sequence
  sgRNA
  Abcb11_17
tcgcctcttctctaccaagg

SEQ ID NO: 8280 - DNA, 20 bp, Artificial Sequence
  sgRNA
  Abcb11_18
ggaagctgctgaacacccag

SEQ ID NO: 8281 - DNA, 20 bp, Artificial Sequence
  sgRNA
  Abcb11_19
ttgaacctgccccagttagg

SEQ ID NO: 8282 - DNA, 20 bp, Artificial Sequence
  sgRNA
  Abcb11_20
aatagatgagaggacttcat

SEQ ID NO: 8283 - DNA, 20 bp, Artificial Sequence
  sgRNA
  Abcb1a_1
actgaatgctccaattaaca

SEQ ID NO: 8284 - DNA, 20 bp, Artificial Sequence
  sgRNA
  Abcb1a_2
caggaagcttagtaccaaag

SEQ ID NO: 8285 - DNA, 20 bp, Artificial Sequence
  sgRNA
  Abcb1a_3
caaagatcagcatcataagt

SEQ ID NO: 8286 - DNA, 20 bp, Artificial Sequence
  sgRNA
  Abcb1a_4
aatgacgtcagcattacgaa

SEQ ID NO: 8287 - DNA, 20 bp, Artificial Sequence
  sgRNA
  Abcb1a_5
tttataataggatttacccg

SEQ ID NO: 8288 - DNA, 20 bp, Artificial Sequence
  sgRNA
  Abcb1a_6
gtacccatcattgcgatagc

SEQ ID NO: 8289 - DNA, 20 bp, Artificial Sequence
  sgRNA
  Abcb1a_7
actcctgctatcgcaatgat

SEQ ID NO: 8290 - DNA, 20 bp, Artificial Sequence
  sgRNA
  Abcb1a_8
gatgaccctaaaaacaccac

SEQ ID NO: 8291 - DNA, 20 bp, Artificial Sequence
  sgRNA
  Abcb1a_9
ataagctgctcctcgtgcat

SEQ ID NO: 8292 - DNA, 20 bp, Artificial Sequence
  sgRNA
  Abcb1a_10
gagtcaaagagacaacagtg

SEQ ID NO: 8293 - DNA, 20 bp, Artificial Sequence
  sgRNA
  Abcb1a_11
actgacctgccccactgcca

SEQ ID NO: 8294 - DNA, 20 bp, Artificial Sequence
  sgRNA
  Abcb1a_12
ggtttgatgtgcatgacgtt

SEQ ID NO: 8295 - DNA, 20 bp, Artificial Sequence
  sgRNA
  Abcb1a_13
cagctgacagtccaagaaca

SEQ ID NO: 8296 - DNA, 20 bp, Artificial Sequence
  sgRNA
  Abcb1a_14
gtggcccccctgaaacccag

SEQ ID NO: 8297 - DNA, 20 bp, Artificial Sequence
  sgRNA
  Abcb1a_15
gaagccttcgccaatgcacg

SEQ ID NO: 8298 - DNA, 20 bp, Artificial Sequence
  sgRNA
  Abcb1a_16
caagttgctgttctgccgct

SEQ ID NO: 8299 - DNA, 20 bp, Artificial Sequence
  sgRNA
  Abcb1a_17
cgatgctgctcaagtgaaag

SEQ ID NO: 8300 - DNA, 20 bp, Artificial Sequence
  sgRNA
  Abcb1a_18
caacttcaggatccgccaaa

SEQ ID NO: 8301 - DNA, 20 bp, Artificial Sequence
  sgRNA
  Abcb1a_19
catcattgcgatagcaggag

SEQ ID NO: 8302 - DNA, 20 bp, Artificial Sequence
  sgRNA
  Abcb1a_20
tggaagaagctaaaaggctg

SEQ ID NO: 8303 - DNA, 20 bp, Artificial Sequence
  sgRNA
  Abcb1b_1
agcctttgcaaacgcacgag

SEQ ID NO: 8304 - DNA, 20 bp, Artificial Sequence
  sgRNA
  Abcb1b_2
tgatgcttctagtgttaaag

SEQ ID NO: 8305 - DNA, 20 bp, Artificial Sequence
  sgRNA
  Abcb1b_3
tcatctcttgaaaaaacctg

SEQ ID NO: 8306 - DNA, 20 bp, Artificial Sequence
  sgRNA
  Abcb1b_4
cagatgacaatccaataaga

SEQ ID NO: 8307 - DNA, 20 bp, Artificial Sequence
  sgRNA
  Abcb1b_5
gctgtagctgtcaatctcag

SEQ ID NO: 8308 - DNA, 20 bp, Artificial Sequence
  sgRNA
  Abcb1b_6
gattgacagctacagcacag

SEQ ID NO: 8309 - DNA, 20 bp, Artificial Sequence
  sgRNA
  Abcb1b_7
attccgcccaatacaatgag

SEQ ID NO: 8310 - DNA, 20 bp, Artificial Sequence
  sgRNA
  Abcb1b_8
aagcctttgcaaacgcacga

SEQ ID NO: 8311 - DNA, 20 bp, Artificial Sequence
  sgRNA
  Abcb1b_9
ataccgctcattgtattggg

SEQ ID NO: 8312 - DNA, 20 bp, Artificial Sequence
  sgRNA
  Abcb1b_10
tgatgcatagaccaacaggt

SEQ ID NO: 8313 - DNA, 20 bp, Artificial Sequence
  sgRNA
  Abcb1b_11
gagaagacttagtatgaaag

SEQ ID NO: 8314 - DNA, 20 bp, Artificial Sequence
  sgRNA
  Abcb1b_12
tagatttaggatccgccaaa

SEQ ID NO: 8315 - DNA, 20 bp, Artificial Sequence
  sgRNA
  Abcb1b_13
tctcctgattcattatagca

SEQ ID NO: 8316 - DNA, 20 bp, Artificial Sequence
  sgRNA
  Abcb1b_14
ccaaacaccagcatcaagag

SEQ ID NO: 8317 - DNA, 20 bp, Artificial Sequence
  sgRNA
  Abcb1b_15
tcgcttggtgaggatctctc

SEQ ID NO: 8318 - DNA, 20 bp, Artificial Sequence
  sgRNA
  Abcb1b_16
agaggatgactcctgtcccg

SEQ ID NO: 8319 - DNA, 20 bp, Artificial Sequence
  sgRNA
  Abcb1b_17
attgacagcttctcaacaaa

SEQ ID NO: 8320 - DNA, 20 bp, Artificial Sequence
  sgRNA
  Abcb1b_18
agaggggaagtaatgttcca

SEQ ID NO: 8321 - DNA, 20 bp, Artificial Sequence
  sgRNA
  Abcb1b_19
catatgatgcatagaccaac

SEQ ID NO: 8322 - DNA, 20 bp, Artificial Sequence
  sgRNA
  Abcb1b_20
gccagccatagactaaggag

SEQ ID NO: 8323 - DNA, 20 bp, Artificial Sequence
  sgRNA
  Abcb4_1
gatgacatctgcgttccgga

SEQ ID NO: 8324 - DNA, 20 bp, Artificial Sequence
  sgRNA
  Abcb4_2
aggaccgtgatagctttcgg

SEQ ID NO: 8325 - DNA, 20 bp, Artificial Sequence
  sgRNA
  Abcb4_3
tagcgaaagcatcaatacag

SEQ ID NO: 8326 - DNA, 20 bp, Artificial Sequence
  sgRNA
  Abcb4_4
tactactattcgggactagg

SEQ ID NO: 8327 - DNA, 20 bp, Artificial Sequence
  sgRNA
  Abcb4_5
catccatcgttacattccca

SEQ ID NO: 8328 - DNA, 20 bp, Artificial Sequence
  sgRNA
  Abcb4_6
tcatccagcagtaggacccg

SEQ ID NO: 8329 - DNA, 20 bp, Artificial Sequence
  sgRNA
  Abcb4_7
gcttcactgcgtcatcccca

SEQ ID NO: 8330 - DNA, 20 bp, Artificial Sequence
  sgRNA
  Abcb4_8
gatgctttcgctaatgcaag

SEQ ID NO: 8331 - DNA, 20 bp, Artificial Sequence
  sgRNA
  Abcb4_9
gaaaatatccgctatggccg

SEQ ID NO: 8332 - DNA, 20 bp, Artificial Sequence
  sgRNA
  Abcb4_10
tcaatggtcaacatccaggc

SEQ ID NO: 8333 - DNA, 20 bp, Artificial Sequence
  sgRNA
  Abcb4_11
gattgagaaagccgtcaaag

SEQ ID NO: 8334 - DNA, 20 bp, Artificial Sequence
  sgRNA
  Abcb4_12
ggaacgcagatgtcatcgct

SEQ ID NO: 8335 - DNA, 20 bp, Artificial Sequence
  sgRNA
  Abcb4_13
gctacagtggagaagggctg

SEQ ID NO: 8336 - DNA, 20 bp, Artificial Sequence
  sgRNA
  Abcb4_14
cgcccctctatcaccaacca

SEQ ID NO: 8337 - DNA, 20 bp, Artificial Sequence
  sgRNA
  Abcb4_15
ttatatcatttatttacggt

SEQ ID NO: 8338 - DNA, 20 bp, Artificial Sequence
  sgRNA
  Abcb4_16
gagccctcatcagacagcct

SEQ ID NO: 8339 - DNA, 20 bp, Artificial Sequence
  sgRNA
  Abcb4_17
gaggctctacgaccccacag

SEQ ID NO: 8340 - DNA, 20 bp, Artificial Sequence
  sgRNA
  Abcb4_18
cctctgattgacagctacag

SEQ ID NO: 8341 - DNA, 20 bp, Artificial Sequence
  sgRNA
  Abcb4_19
ataagtttgtagataatact

SEQ ID NO: 8342 - DNA, 20 bp, Artificial Sequence
  sgRNA
  Abcb4_20
gcctcatgatgagattgtga

SEQ ID NO: 8343 - DNA, 20 bp, Artificial Sequence
  sgRNA
  Abcb5_1
gtgcgatgtgaatagtgcca

SEQ ID NO: 8344 - DNA, 20 bp, Artificial Sequence
  sgRNA
  Abcb5_2
caggctctccaccattcgtg

SEQ ID NO: 8345 - DNA, 20 bp, Artificial Sequence
  sgRNA
  Abcb5_3
aaaggccattatgaagtcgt

SEQ ID NO: 8346 - DNA, 20 bp, Artificial Sequence
  sgRNA
  Abcb5_4
acagcacttaaaggacgcaa

SEQ ID NO: 8347 - DNA, 20 bp, Artificial Sequence
  sgRNA
  Abcb5_5
agctgtggagaacatacgta

SEQ ID NO: 8348 - DNA, 20 bp, Artificial Sequence
  sgRNA
  Abcb5_6
gctgtactactccctcgcca

SEQ ID NO: 8349 - DNA, 20 bp, Artificial Sequence
  sgRNA
  Abcb5_7
ggatgcctattccaaagctg

SEQ ID NO: 8350 - DNA, 20 bp, Artificial Sequence
  sgRNA
  Abcb5_8
ctatggtgataacagccgca

SEQ ID NO: 8351 - DNA, 20 bp, Artificial Sequence
  sgRNA
  Abcb5_9
tctcctctaagggcaccatg

SEQ ID NO: 8352 - DNA, 20 bp, Artificial Sequence
  sgRNA
  Abcb5_10
ggagcctatttgattcaagc

SEQ ID NO: 8353 - DNA, 20 bp, Artificial Sequence
  sgRNA
  Abcb5_11
ggaagactgtagcattcgtt

SEQ ID NO: 8354 - DNA, 20 bp, Artificial Sequence
  sgRNA
  Abcb5_12
acaaagactggctattgcaa

SEQ ID NO: 8355 - DNA, 20 bp, Artificial Sequence
  sgRNA
  Abcb5_13
ctctccgccaaaaatcaagg

SEQ ID NO: 8356 - DNA, 20 bp, Artificial Sequence
  sgRNA
  Abcb5_14
tgtccctcagcattgagaaa

SEQ ID NO: 8357 - DNA, 20 bp, Artificial Sequence
  sgRNA
  Abcb5_15
tctgggtcataactgcagcc

SEQ ID NO: 8358 - DNA, 20 bp, Artificial Sequence
  sgRNA
  Abcb5_16
cacgcctcttagtcccacta

SEQ ID NO: 8359 - DNA, 20 bp, Artificial Sequence
  sgRNA
  Abcb5_17
aatcaggtctgccccacgaa

SEQ ID NO: 8360 - DNA, 20 bp, Artificial Sequence
  sgRNA
  Abcb5_18
ataccaaaaagccagtccat

SEQ ID NO: 8361 - DNA, 20 bp, Artificial Sequence
  sgRNA
  Abcb5_19
ccgtcctgcttgaatcaaat

SEQ ID NO: 8362 - DNA, 20 bp, Artificial Sequence
  sgRNA
  Abcb5_20
ggctggagagacagtagcct

SEQ ID NO: 8363 - DNA, 20 bp, Artificial Sequence
  sgRNA
  Abcb9_1
taccccgctgccccagacgt

SEQ ID NO: 8364 - DNA, 20 bp, Artificial Sequence
  sgRNA
  Abcb9_2
gcccacaaagaggcacacga

SEQ ID NO: 8365 - DNA, 20 bp, Artificial Sequence
  sgRNA
  Abcb9_3
gttcagtctggcaaatacga

SEQ ID NO: 8366 - DNA, 20 bp, Artificial Sequence
  sgRNA
  Abcb9_4
acactttaacatcttcgact

SEQ ID NO: 8367 - DNA, 20 bp, Artificial Sequence
  sgRNA
  Abcb9_5
gctgggggctaccataggcg

SEQ ID NO: 8368 - DNA, 20 bp, Artificial Sequence
  sgRNA
  Abcb9_6
gagaacttctaccctctgca

SEQ ID NO: 8369 - DNA, 20 bp, Artificial Sequence
  sgRNA
  Abcb9_7
ggtgctggacaagggccggg

SEQ ID NO: 8370 - DNA, 20 bp, Artificial Sequence
  sgRNA
  Abcb9_8
gtctacagtggcctgatgca

SEQ ID NO: 8371 - DNA, 20 bp, Artificial Sequence
  sgRNA
  Abcb9_9
aggtgttcgagttcatcgac

SEQ ID NO: 8372 - DNA, 20 bp, Artificial Sequence
  sgRNA
  Abcb9_10
gctgaaggcgtagatggccg

SEQ ID NO: 8373 - DNA, 20 bp, Artificial Sequence
  sgRNA
  Abcb9_11
ttggcccccgaccacctcga

SEQ ID NO: 8374 - DNA, 20 bp, Artificial Sequence
  sgRNA
  Abcb9_12
tgacgagccacgaagcccgc

SEQ ID NO: 8375 - DNA, 20 bp, Artificial Sequence
  sgRNA
  Abcb9_13
gcttgccatccaacaataca

SEQ ID NO: 8376 - DNA, 20 bp, Artificial Sequence
  sgRNA
  Abcb9_14
catcgcgctgatggtttcct

SEQ ID NO: 8377 - DNA, 20 bp, Artificial Sequence
  sgRNA
  Abcb9_15
gaagcccatgaaggtgacca

SEQ ID NO: 8378 - DNA, 20 bp, Artificial Sequence
  sgRNA
  Abcb9_16
atacacggccgccctgcaga

SEQ ID NO: 8379 - DNA, 20 bp, Artificial Sequence
  sgRNA
  Abcb9_17
agtccaccctgccctcgagg

SEQ ID NO: 8380 - DNA, 20 bp, Artificial Sequence
  sgRNA
  Abcb9_18
acacctgctgaagcttccgc

SEQ ID NO: 8381 - DNA, 20 bp, Artificial Sequence
  sgRNA
  Abcb9_19
ggggccacctagtcatctcg

SEQ ID NO: 8382 - DNA, 20 bp, Artificial Sequence
  sgRNA
  Abcb9_20
ggctggctgtgtagtccaag

SEQ ID NO: 8383 - DNA, 20 bp, Artificial Sequence
  sgRNA
  Abcc1_1
ggtgaagtacagatagaacg

SEQ ID NO: 8384 - DNA, 20 bp, Artificial Sequence
  sgRNA
  Abcc1_2
ggctaggatgacttgcagag

SEQ ID NO: 8385 - DNA, 20 bp, Artificial Sequence
  sgRNA
  Abcc1_3
agctgtaggcacattcacgt

SEQ ID NO: 8386 - DNA, 20 bp, Artificial Sequence
  sgRNA
  Abcc1_4
gagcggaggtcgatcaagag

SEQ ID NO: 8387 - DNA, 20 bp, Artificial Sequence
  sgRNA
  Abcc1_5
tatctctctcgccatgaccg

SEQ ID NO: 8388 - DNA, 20 bp, Artificial Sequence
  sgRNA
  Abcc1_6
acaatgctgctgataaccat

SEQ ID NO: 8389 - DNA, 20 bp, Artificial Sequence
  sgRNA
  Abcc1_7
agtaatcccggaactctaca

SEQ ID NO: 8390 - DNA, 20 bp, Artificial Sequence
  sgRNA
  Abcc1_8
gtacgctcaaagaaactcat

SEQ ID NO: 8391 - DNA, 20 bp, Artificial Sequence
  sgRNA
  Abcc1_9
tatcagctacctgccccaag

SEQ ID NO: 8392 - DNA, 20 bp, Artificial Sequence
  sgRNA
  Abcc1_10
agtggactccatgatcccgc

SEQ ID NO: 8393 - DNA, 20 bp, Artificial Sequence
  sgRNA
  Abcc1_11
attgatccggaacaaaccca

SEQ ID NO: 8394 - DNA, 20 bp, Artificial Sequence
  sgRNA
  Abcc1_12
tcagaacacggtcctcacat

SEQ ID NO: 8395 - DNA, 20 bp, Artificial Sequence
  sgRNA
  Abcc1_13
gattgtcaacctcatgtccg

SEQ ID NO: 8396 - DNA, 20 bp, Artificial Sequence
  sgRNA
  Abcc1_14
gttgacaatctctccgaccg

SEQ ID NO: 8397 - DNA, 20 bp, Artificial Sequence
  sgRNA
  Abcc1_15
gctagaaaatcttccacggt

SEQ ID NO: 8398 - DNA, 20 bp, Artificial Sequence
  sgRNA
  Abcc1_16
tctttgagcgtacacccagt

SEQ ID NO: 8399 - DNA, 20 bp, Artificial Sequence
  sgRNA
  Abcc1_17
gaaagtaagcataattcccg

SEQ ID NO: 8400 - DNA, 20 bp, Artificial Sequence
  sgRNA
  Abcc1_18
cattgatccggaacaaaccc

SEQ ID NO: 8401 - DNA, 20 bp, Artificial Sequence
  sgRNA
  Abcc1_19
ggagatggagaccaacattg

SEQ ID NO: 8402 - DNA, 20 bp, Artificial Sequence
  sgRNA
  Abcc1_20
gatttggaaatcctgcccag

SEQ ID NO: 8403 - DNA, 20 bp, Artificial Sequence
  sgRNA
  Abcc10_1
agagaccattgatcacccag

SEQ ID NO: 8404 - DNA, 20 bp, Artificial Sequence
  sgRNA
  Abcc10_2
agaagacacacacggcccag

SEQ ID NO: 8405 - DNA, 20 bp, Artificial Sequence
  sgRNA
  Abcc10_3
gaaaggtgtgaccctcagcg

SEQ ID NO: 8406 - DNA, 20 bp, Artificial Sequence
  sgRNA
  Abcc10_4
caatggttgcatacacgatg

SEQ ID NO: 8407 - DNA, 20 bp, Artificial Sequence
  sgRNA
  Abcc10_5
tactaggcaccgactccgag

SEQ ID NO: 8408 - DNA, 20 bp, Artificial Sequence
  sgRNA
  Abcc10_6
cgacctggagagaaccaccg

SEQ ID NO: 8409 - DNA, 20 bp, Artificial Sequence
  sgRNA
  Abcc10_7
ccaatcagcaccgttgcgcg

SEQ ID NO: 8410 - DNA, 20 bp, Artificial Sequence
  sgRNA
  Abcc10_8
gggctcttgtggtcccccag

SEQ ID NO: 8411 - DNA, 20 bp, Artificial Sequence
  sgRNA
  Abcc10_9
agatggggtgaccttccgtg

SEQ ID NO: 8412 - DNA, 20 bp, Artificial Sequence
  sgRNA
  Abcc10_10
ttatggctagaggtgctagc

SEQ ID NO: 8413 - DNA, 20 bp, Artificial Sequence
  sgRNA
  Abcc10_11
tcctctcaacaacttcccct

SEQ ID NO: 8414 - DNA, 20 bp, Artificial Sequence
  sgRNA
  Abcc10_12
gcagtgtcagaactgtccaa

SEQ ID NO: 8415 - DNA, 20 bp, Artificial Sequence
  sgRNA
  Abcc10_13
aggctacgtctgatgagaag

SEQ ID NO: 8416 - DNA, 20 bp, Artificial Sequence
  sgRNA
  Abcc10_14
ggacccccagggcctacacg

SEQ ID NO: 8417 - DNA, 20 bp, Artificial Sequence
  sgRNA
  Abcc10_15
ggtcaagagcctctaagcca

SEQ ID NO: 8418 - DNA, 20 bp, Artificial Sequence
  sgRNA
  Abcc10_16
gtgggtgcacagcagccggg

SEQ ID NO: 8419 - DNA, 20 bp, Artificial Sequence
  sgRNA
  Abcc10_17
ggagaagagaagcagccgtg

SEQ ID NO: 8420 - DNA, 20 bp, Artificial Sequence
  sgRNA
  Abcc10_18
gaagcggttcaagacccggc

SEQ ID NO: 8421 - DNA, 20 bp, Artificial Sequence
  sgRNA
  Abcc10_19
aagagaccattgatcaccca

SEQ ID NO: 8422 - DNA, 20 bp, Artificial Sequence
  sgRNA
  Abcc10_20
gcttctctccaggctccaca

SEQ ID NO: 8423 - DNA, 20 bp, Artificial Sequence
  sgRNA
  Abcc12_1
aaagacatgcttccccacgt

SEQ ID NO: 8424 - DNA, 20 bp, Artificial Sequence
  sgRNA
  Abcc12_2
tgtaaaccaactggtacatg

SEQ ID NO: 8425 - DNA, 20 bp, Artificial Sequence
  sgRNA
  Abcc12_3
tagaggtaactcttaccaca

SEQ ID NO: 8426 - DNA, 20 bp, Artificial Sequence
  sgRNA
  Abcc12_4
catcggacatcaacgccaag

SEQ ID NO: 8427 - DNA, 20 bp, Artificial Sequence
  sgRNA
  Abcc12_5
ccttgaacgttatctcccct

SEQ ID NO: 8428 - DNA, 20 bp, Artificial Sequence
  sgRNA
  Abcc12_6
ccttcagtcggatcgctgtg

SEQ ID NO: 8429 - DNA, 20 bp, Artificial Sequence
  sgRNA
  Abcc12_7
gcacaaacgaccattaggat

SEQ ID NO: 8430 - DNA, 20 bp, Artificial Sequence
  sgRNA
  Abcc12_8
aacatgccagagcatctcgt

SEQ ID NO: 8431 - DNA, 20 bp, Artificial Sequence
  sgRNA
  Abcc12_9
tgaattacggagaagtgccc

SEQ ID NO: 8432 - DNA, 20 bp, Artificial Sequence
  sgRNA
  Abcc12_10
gccgatcccgatgtgtccgg

SEQ ID NO: 8433 - DNA, 20 bp, Artificial Sequence
  sgRNA
  Abcc12_11
ggacaggtccccactttgaa

SEQ ID NO: 8434 - DNA, 20 bp, Artificial Sequence
  sgRNA
  Abcc12_12
aagcttatccacaacctccg

SEQ ID NO: 8435 - DNA, 20 bp, Artificial Sequence
  sgRNA
  Abcc12_13
gcattaagaagacactcaaa

SEQ ID NO: 8436 - DNA, 20 bp, Artificial Sequence
  sgRNA
  Abcc12_14
agtctggatgagctggtgag

SEQ ID NO: 8437 - DNA, 20 bp, Artificial Sequence
  sgRNA
  Abcc12_15
tcgtcggtgtggctccccaa

SEQ ID NO: 8438 - DNA, 20 bp, Artificial Sequence
  sgRNA
  Abcc12_16
cagtcaggtctccataaggg

SEQ ID NO: 8439 - DNA, 20 bp, Artificial Sequence
  sgRNA
  Abcc12_17
acgaaacagggccatgccca

SEQ ID NO: 8440 - DNA, 20 bp, Artificial Sequence
  sgRNA
  Abcc12_18
ttaacgtcttaaaggacagc

SEQ ID NO: 8441 - DNA, 20 bp, Artificial Sequence
  sgRNA
  Abcc12_19
aacgttatctcccctcggct

SEQ ID NO: 8442 - DNA, 20 bp, Artificial Sequence
  sgRNA
  Abcc12_20
tgttcagagcaccataaagg

SEQ ID NO: 8443 - DNA, 20 bp, Artificial Sequence
  sgRNA
  Abcc2_1
aagaccctgactcatatccg

SEQ ID NO: 8444 - DNA, 20 bp, Artificial Sequence
  sgRNA
  Abcc2_2
gcattcggaagaaagaactc

SEQ ID NO: 8445 - DNA, 20 bp, Artificial Sequence
  sgRNA
  Abcc2_3
actcggatcttggttacaca

SEQ ID NO: 8446 - DNA, 20 bp, Artificial Sequence
  sgRNA
  Abcc2_4
gtttaagacgatcatgacaa

SEQ ID NO: 8447 - DNA, 20 bp, Artificial Sequence
  sgRNA
  Abcc2_5
gagtgtccacagccgacagg

SEQ ID NO: 8448 - DNA, 20 bp, Artificial Sequence
  sgRNA
  Abcc2_6
ttataagaattccttaaccg

SEQ ID NO: 8449 - DNA, 20 bp, Artificial Sequence
  sgRNA
  Abcc2_7
gcctcattcagacgaccatc

SEQ ID NO: 8450 - DNA, 20 bp, Artificial Sequence
  sgRNA
  Abcc2_8
tattctagacgaccccctgt

SEQ ID NO: 8451 - DNA, 20 bp, Artificial Sequence
  sgRNA
  Abcc2_9
gcatagatatatccaaccca

SEQ ID NO: 8452 - DNA, 20 bp, Artificial Sequence
  sgRNA
  Abcc2_10
ctatcaagtgcggtatcggc

SEQ ID NO: 8453 - DNA, 20 bp, Artificial Sequence
  sgRNA
  Abcc2_11
tcggctgtggacactcacgt

SEQ ID NO: 8454 - DNA, 20 bp, Artificial Sequence
  sgRNA
  Abcc2_12
tttcctggattacctccaac

SEQ ID NO: 8455 - DNA, 20 bp, Artificial Sequence
  sgRNA
  Abcc2_13
gcatggccagaggaaagcgc

SEQ ID NO: 8456 - DNA, 20 bp, Artificial Sequence
  sgRNA
  Abcc2_14
ggatttgtatatttaacagg

SEQ ID NO: 8457 - DNA, 20 bp, Artificial Sequence
  sgRNA
  Abcc2_15
cggtcatcactatcgcacac

SEQ ID NO: 8458 - DNA, 20 bp, Artificial Sequence
  sgRNA
  Abcc2_16
gttgctccatgaagtgacag

SEQ ID NO: 8459 - DNA, 20 bp, Artificial Sequence
  sgRNA
  Abcc2_17
gttgtgtcaaaaaaactcat

SEQ ID NO: 8460 - DNA, 20 bp, Artificial Sequence
  sgRNA
  Abcc2_18
ggaaaagacgcatttctggt

SEQ ID NO: 8461 - DNA, 20 bp, Artificial Sequence
  sgRNA
  Abcc2_19
agttcaacaactatcaagtg

SEQ ID NO: 8462 - DNA, 20 bp, Artificial Sequence
  sgRNA
  Abcc2_20
ctgggagaactcgttccgga

SEQ ID NO: 8463 - DNA, 20 bp, Artificial Sequence
  sgRNA
  Abcc3_1
gtcagtccactgattaactg

SEQ ID NO: 8464 - DNA, 20 bp, Artificial Sequence
  sgRNA
  Abcc3_2
tagggtattaacctatctgg

SEQ ID NO: 8465 - DNA, 20 bp, Artificial Sequence
  sgRNA
  Abcc3_3
ctttgctaatccagtacgag

SEQ ID NO: 8466 - DNA, 20 bp, Artificial Sequence
  sgRNA
  Abcc3_4
caatgagccagccatctacg

SEQ ID NO: 8467 - DNA, 20 bp, Artificial Sequence
  sgRNA
  Abcc3_5
gtagacaccgagccttacgg

SEQ ID NO: 8468 - DNA, 20 bp, Artificial Sequence
  sgRNA
  Abcc3_6
gagacggatgacctcatcca

SEQ ID NO: 8469 - DNA, 20 bp, Artificial Sequence
  sgRNA
  Abcc3_7
ggacatatacgtcatcgacg

SEQ ID NO: 8470 - DNA, 20 bp, Artificial Sequence
  sgRNA
  Abcc3_8
ttgcctgttccgaatcctgg

SEQ ID NO: 8471 - DNA, 20 bp, Artificial Sequence
  sgRNA
  Abcc3_9
gctctcacaaggtggtacaa

SEQ ID NO: 8472 - DNA, 20 bp, Artificial Sequence
  sgRNA
  Abcc3_10
cgtcattgatgggctcaacg

SEQ ID NO: 8473 - DNA, 20 bp, Artificial Sequence
  sgRNA
  Abcc3_11
gctcacgaacgtgttcaggt

SEQ ID NO: 8474 - DNA, 20 bp, Artificial Sequence
  sgRNA
  Abcc3_12
agatgcctccggccgcaatg

SEQ ID NO: 8475 - DNA, 20 bp, Artificial Sequence
  sgRNA
  Abcc3_13
agttccccacaaactccacg

SEQ ID NO: 8476 - DNA, 20 bp, Artificial Sequence
  sgRNA
  Abcc3_14
tgtccaccttagtatcactg

SEQ ID NO: 8477 - DNA, 20 bp, Artificial Sequence
  sgRNA
  Abcc3_15
ggaggactgctctcacaagg

SEQ ID NO: 8478 - DNA, 20 bp, Artificial Sequence
  sgRNA
  Abcc3_16
gtaggaccgcatcctcacct

SEQ ID NO: 8479 - DNA, 20 bp, Artificial Sequence
  sgRNA
  Abcc3_17
ccaggcgctgagccacacat

SEQ ID NO: 8480 - DNA, 20 bp, Artificial Sequence
  sgRNA
  Abcc3_18
catgattgtgttgagccggt

SEQ ID NO: 8481 - DNA, 20 bp, Artificial Sequence
  sgRNA
  Abcc3_19
tcctccgagtatcggccaaa

SEQ ID NO: 8482 - DNA, 20 bp, Artificial Sequence
  sgRNA
  Abcc3_20
gactggcgcattaatcaaag

SEQ ID NO: 8483 - DNA, 20 bp, Artificial Sequence
  sgRNA
  Abcc4_1
aagcggtgaaatcttgcacg

SEQ ID NO: 8484 - DNA, 20 bp, Artificial Sequence
  sgRNA
  Abcc4_2
tggtacttaggaatttacgc

SEQ ID NO: 8485 - DNA, 20 bp, Artificial Sequence
  sgRNA
  Abcc4_3
cagaccctcgttgaaagacg

SEQ ID NO: 8486 - DNA, 20 bp, Artificial Sequence
  sgRNA
  Abcc4_4
ggttaagtaactcggccatg

SEQ ID NO: 8487 - DNA, 20 bp, Artificial Sequence
  sgRNA
  Abcc4_5
agccgattctcccttccgaa

SEQ ID NO: 8488 - DNA, 20 bp, Artificial Sequence
  sgRNA
  Abcc4_6
tggaggtgttcataaccgcg

SEQ ID NO: 8489 - DNA, 20 bp, Artificial Sequence
  sgRNA
  Abcc4_7
gcctggtgagttgttagccg

SEQ ID NO: 8490 - DNA, 20 bp, Artificial Sequence
  sgRNA
  Abcc4_8
attggaggtgttcataaccg

SEQ ID NO: 8491 - DNA, 20 bp, Artificial Sequence
  sgRNA
  Abcc4_9
tattacattcaccagccccg

SEQ ID NO: 8492 - DNA, 20 bp, Artificial Sequence
  sgRNA
  Abcc4_10
gtgccacatgatttaccgga

SEQ ID NO: 8493 - DNA, 20 bp, Artificial Sequence
  sgRNA
  Abcc4_11
gaagatcgctcaaagcacct

SEQ ID NO: 8494 - DNA, 20 bp, Artificial Sequence
  sgRNA
  Abcc4_12
agaagaacacgcgcgagcag

SEQ ID NO: 8495 - DNA, 20 bp, Artificial Sequence
  sgRNA
  Abcc4_13
ctacaagaattacttctcgg

SEQ ID NO: 8496 - DNA, 20 bp, Artificial Sequence
  sgRNA
  Abcc4_14
tcaggctgtcagaacccgag

SEQ ID NO: 8497 - DNA, 20 bp, Artificial Sequence
  sgRNA
  Abcc4_15
cagcgatcacacttacgacg

SEQ ID NO: 8498 - DNA, 20 bp, Artificial Sequence
  sgRNA
  Abcc4_16
ggggccccgtctttcaacga

SEQ ID NO: 8499 - DNA, 20 bp, Artificial Sequence
  sgRNA
  Abcc4_17
gtatgaccccgacgactcgg

SEQ ID NO: 8500 - DNA, 20 bp, Artificial Sequence
  sgRNA
  Abcc4_18
caggaaacgaaccttctccg

SEQ ID NO: 8501 - DNA, 20 bp, Artificial Sequence
  sgRNA
  Abcc4_19
gcaaagccaccgagtcgtcg

SEQ ID NO: 8502 - DNA, 20 bp, Artificial Sequence
  sgRNA
  Abcc4_20
tctgcatcgacagcgctgag

SEQ ID NO: 8503 - DNA, 20 bp, Artificial Sequence
  sgRNA
  Abcc5_1
ggagctgatgaacttaaatg

SEQ ID NO: 8504 - DNA, 20 bp, Artificial Sequence
  sgRNA
  Abcc5_2
aaatccgagaggaggaacgt

SEQ ID NO: 8505 - DNA, 20 bp, Artificial Sequence
  sgRNA
  Abcc5_3
cattaaagaaaagtccctag

SEQ ID NO: 8506 - DNA, 20 bp, Artificial Sequence
  sgRNA
  Abcc5_4
aaagacaagagggctaccag

SEQ ID NO: 8507 - DNA, 20 bp, Artificial Sequence
  sgRNA
  Abcc5_5
cattagacagaaggaccgat

SEQ ID NO: 8508 - DNA, 20 bp, Artificial Sequence
  sgRNA
  Abcc5_6
gcttcaggacacttaaacca

SEQ ID NO: 8509 - DNA, 20 bp, Artificial Sequence
  sgRNA
  Abcc5_7
gcaacacactgagcaccagg

SEQ ID NO: 8510 - DNA, 20 bp, Artificial Sequence
  sgRNA
  Abcc5_8
agacgctgcctccctgcgaa

SEQ ID NO: 8511 - DNA, 20 bp, Artificial Sequence
  sgRNA
  Abcc5_9
gttcaccgtcagactggcat

SEQ ID NO: 8512 - DNA, 20 bp, Artificial Sequence
  sgRNA
  Abcc5_10
gatccacacaacccttcgca

SEQ ID NO: 8513 - DNA, 20 bp, Artificial Sequence
  sgRNA
  Abcc5_11
gggacagaagcgctgtacca

SEQ ID NO: 8514 - DNA, 20 bp, Artificial Sequence
  sgRNA
  Abcc5_12
cgtctggtggagctatctgg

SEQ ID NO: 8515 - DNA, 20 bp, Artificial Sequence
  sgRNA
  Abcc5_13
tcatctccaaattctggacg

SEQ ID NO: 8516 - DNA, 20 bp, Artificial Sequence
  sgRNA
  Abcc5_14
tccggaacctgggttcctcg

SEQ ID NO: 8517 - DNA, 20 bp, Artificial Sequence
  sgRNA
  Abcc5_15
tctgttctgccagcaccgcc

SEQ ID NO: 8518 - DNA, 20 bp, Artificial Sequence
  sgRNA
  Abcc5_16
tagctcatcatggagccggg

SEQ ID NO: 8519 - DNA, 20 bp, Artificial Sequence
  sgRNA
  Abcc5_17
gatccagtagctaagccacc

SEQ ID NO: 8520 - DNA, 20 bp, Artificial Sequence
  sgRNA
  Abcc5_18
agatcccttcagcctatgcg

SEQ ID NO: 8521 - DNA, 20 bp, Artificial Sequence
  sgRNA
  Abcc5_19
gcacctcttggagtacaccc

SEQ ID NO: 8522 - DNA, 20 bp, Artificial Sequence
  sgRNA
  Abcc5_20
agggcaacacagagaccccg

SEQ ID NO: 8523 - DNA, 20 bp, Artificial Sequence
  sgRNA
  Abcc9_1
catgtttgtgagatagcgga

SEQ ID NO: 8524 - DNA, 20 bp, Artificial Sequence
  sgRNA
  Abcc9_2
tccctcctagatcataatgg

SEQ ID NO: 8525 - DNA, 20 bp, Artificial Sequence
  sgRNA
  Abcc9_3
gactgcgaatctgaccaccg

SEQ ID NO: 8526 - DNA, 20 bp, Artificial Sequence
  sgRNA
  Abcc9_4
acaaatggatacttctcatg

SEQ ID NO: 8527 - DNA, 20 bp, Artificial Sequence
  sgRNA
  Abcc9_5
tagactactggctagctacg

SEQ ID NO: 8528 - DNA, 20 bp, Artificial Sequence
  sgRNA
  Abcc9_6
gcatcaaatgatcgctcagg

SEQ ID NO: 8529 - DNA, 20 bp, Artificial Sequence
  sgRNA
  Abcc9_7
tgagtgcgtccacaaagcag

SEQ ID NO: 8530 - DNA, 20 bp, Artificial Sequence
  sgRNA
  Abcc9_8
tctttgataccacaccgctg

SEQ ID NO: 8531 - DNA, 20 bp, Artificial Sequence
  sgRNA
  Abcc9_9
cattgccacgaagctggcgg

SEQ ID NO: 8532 - DNA, 20 bp, Artificial Sequence
  sgRNA
  Abcc9_10
tcagcgactccaaggtcgga

SEQ ID NO: 8533 - DNA, 20 bp, Artificial Sequence
  sgRNA
  Abcc9_11
gaccggcatcaacctccgtg

SEQ ID NO: 8534 - DNA, 20 bp, Artificial Sequence
  sgRNA
  Abcc9_12
ccaatcgccttcagatcgat

SEQ ID NO: 8535 - DNA, 20 bp, Artificial Sequence
  sgRNA
  Abcc9_13
agacattcagaccaaagacg

SEQ ID NO: 8536 - DNA, 20 bp, Artificial Sequence
  sgRNA
  Abcc9_14
cctcgtcacctccctcaccg

SEQ ID NO: 8537 - DNA, 20 bp, Artificial Sequence
  sgRNA
  Abcc9_15
tcgacttctaacctatccat

SEQ ID NO: 8538 - DNA, 20 bp, Artificial Sequence
  sgRNA
  Abcc9_16
caggacccaatcctgttcag

SEQ ID NO: 8539 - DNA, 20 bp, Artificial Sequence
  sgRNA
  Abcc9_17
aatgttatgataatagacga

SEQ ID NO: 8540 - DNA, 20 bp, Artificial Sequence
  sgRNA
  Abcc9_18
ctgggccaagaggctttccg

SEQ ID NO: 8541 - DNA, 20 bp, Artificial Sequence
  sgRNA
  Abcc9_19
gcaagggcgacgagaaacac

SEQ ID NO: 8542 - DNA, 20 bp, Artificial Sequence
  sgRNA
  Abcc9_20
gctcttccgaacaaaggccc

SEQ ID NO: 8543 - DNA, 20 bp, Artificial Sequence
  sgRNA
  Abcg3_1
attgtattgaagtccagatg

SEQ ID NO: 8544 - DNA, 20 bp, Artificial Sequence
  sgRNA
  Abcg3_2
gctgcaaggagagatccgcg

SEQ ID NO: 8545 - DNA, 20 bp, Artificial Sequence
  sgRNA
  Abcg3_3
gaacttaggatgtcgaagaa

SEQ ID NO: 8546 - DNA, 20 bp, Artificial Sequence
  sgRNA
  Abcg3_4
agcctagatccaaagaactc

SEQ ID NO: 8547 - DNA, 20 bp, Artificial Sequence
  sgRNA
  Abcg3_5
atatctcctgataatccacg

SEQ ID NO: 8548 - DNA, 20 bp, Artificial Sequence
  sgRNA
  Abcg3_6
acgatgagagatcaatgccc

SEQ ID NO: 8549 - DNA, 20 bp, Artificial Sequence
  sgRNA
  Abcg3_7
gaagaattcttgatgatcca

SEQ ID NO: 8550 - DNA, 20 bp, Artificial Sequence
  sgRNA
  Abcg3_8
gtatcaagtcacaggaaaac

SEQ ID NO: 8551 - DNA, 20 bp, Artificial Sequence
  sgRNA
  Abcg3_9
ctatcattgagattacagtg

SEQ ID NO: 8552 - DNA, 20 bp, Artificial Sequence
  sgRNA
  Abcg3_10
agttccctgccattgtccat

SEQ ID NO: 8553 - DNA, 20 bp, Artificial Sequence
  sgRNA
  Abcg3_11
catctcttgttatagtcact

SEQ ID NO: 8554 - DNA, 20 bp, Artificial Sequence
  sgRNA
  Abcg3_12
tcaggtctatcactatattc

SEQ ID NO: 8555 - DNA, 20 bp, Artificial Sequence
  sgRNA
  Abcg3_13
tggctgagctaatacccagg

SEQ ID NO: 8556 - DNA, 20 bp, Artificial Sequence
  sgRNA
  Abcg3_14
agaataggccagcaccatga

SEQ ID NO: 8557 - DNA, 20 bp, Artificial Sequence
  sgRNA
  Abcg3_15
gcacataggtaattgttaag

SEQ ID NO: 8558 - DNA, 20 bp, Artificial Sequence
  sgRNA
  Abcg3_16
tcattgtacaaactaaagcc

SEQ ID NO: 8559 - DNA, 20 bp, Artificial Sequence
  sgRNA
  Abcg3_17
agctcctatggacaatggca

SEQ ID NO: 8560 - DNA, 20 bp, Artificial Sequence
  sgRNA
  Abcg3_18
gccatcctggatcaactctt

SEQ ID NO: 8561 - DNA, 20 bp, Artificial Sequence
  sgRNA
  Abcg3_19
acttgagctgatggcagaaa

SEQ ID NO: 8562 - DNA, 20 bp, Artificial Sequence
  sgRNA
  Abcg3_20
tgacactctgtagtatccac

SEQ ID NO: 8563 - DNA, 20 bp, Artificial Sequence
  sgRNA
  Abcg4_1
tggaactgtcctattccgtg

SEQ ID NO: 8564 - DNA, 20 bp, Artificial Sequence
  sgRNA
  Abcg4_2
cattcatgaacatcttggca

SEQ ID NO: 8565 - DNA, 20 bp, Artificial Sequence
  sgRNA
  Abcg4_3
gcagaatggcctttgcacca

SEQ ID NO: 8566 - DNA, 20 bp, Artificial Sequence
  sgRNA
  Abcg4_4
tgatgtcctgctctcacacg

SEQ ID NO: 8567 - DNA, 20 bp, Artificial Sequence
  sgRNA
  Abcg4_5
aaggtatgccagcagccgca

SEQ ID NO: 8568 - DNA, 20 bp, Artificial Sequence
  sgRNA
  Abcg4_6
ggcagatcctggttaacggg

SEQ ID NO: 8569 - DNA, 20 bp, Artificial Sequence
  sgRNA
  Abcg4_7
gatgtcctgctacatcatgc

SEQ ID NO: 8570 - DNA, 20 bp, Artificial Sequence
  sgRNA
  Abcg4_8
acaccactgggcataccacc

SEQ ID NO: 8571 - DNA, 20 bp, Artificial Sequence
  sgRNA
  Abcg4_9
ctattacttggccaagacca

SEQ ID NO: 8572 - DNA, 20 bp, Artificial Sequence
  sgRNA
  Abcg4_10
atgtgacatgaaccgcaagt

SEQ ID NO: 8573 - DNA, 20 bp, Artificial Sequence
  sgRNA
  Abcg4_11
gcacagccctgaacagcatg

SEQ ID NO: 8574 - DNA, 20 bp, Artificial Sequence
  sgRNA
  Abcg4_12
actgtcctattccgtgcggg

SEQ ID NO: 8575 - DNA, 20 bp, Artificial Sequence
  sgRNA
  Abcg4_13
agactgggcaactaaggcgg

SEQ ID NO: 8576 - DNA, 20 bp, Artificial Sequence
  sgRNA
  Abcg4_14
cggaaggtcctcagctcgcg

SEQ ID NO: 8577 - DNA, 20 bp, Artificial Sequence
  sgRNA
  Abcg4_15
ggaactgtcctattccgtgc

SEQ ID NO: 8578 - DNA, 20 bp, Artificial Sequence
  sgRNA
  Abcg4_16
gtagcaggacatcttgcgga

SEQ ID NO: 8579 - DNA, 20 bp, Artificial Sequence
  sgRNA
  Abcg4_17
cttgaaactgacgaagaagc

SEQ ID NO: 8580 - DNA, 20 bp, Artificial Sequence
  sgRNA
  Abcg4_18
gctgaccacgcacctaaaga

SEQ ID NO: 8581 - DNA, 20 bp, Artificial Sequence
  sgRNA
  Abcg4_19
acttcatgagggacaccact

SEQ ID NO: 8582 - DNA, 20 bp, Artificial Sequence
  sgRNA
  Abcg4_20
gttgaccagttccagagcaa

SEQ ID NO: 8583 - DNA, 20 bp, Artificial Sequence
  sgRNA
  Abcg5_1
gctgatagagcagccccacg

SEQ ID NO: 8584 - DNA, 20 bp, Artificial Sequence
  sgRNA
  Abcg5_2
agcttgccgaacatcccagg

SEQ ID NO: 8585 - DNA, 20 bp, Artificial Sequence
  sgRNA
  Abcg5_3
caatcatttggtccgccacg

SEQ ID NO: 8586 - DNA, 20 bp, Artificial Sequence
  sgRNA
  Abcg5_4
ggattggaatgttcaggaca

SEQ ID NO: 8587 - DNA, 20 bp, Artificial Sequence
  sgRNA
  Abcg5_5
ttagcgtgttgttctggacg

SEQ ID NO: 8588 - DNA, 20 bp, Artificial Sequence
  sgRNA
  Abcg5_6
ccttgggtgatggcgcacat

SEQ ID NO: 8589 - DNA, 20 bp, Artificial Sequence
  sgRNA
  Abcg5_7
ggagatggcgtccagcagcg

SEQ ID NO: 8590 - DNA, 20 bp, Artificial Sequence
  sgRNA
  Abcg5_8
cttggcttcttcaataactg

SEQ ID NO: 8591 - DNA, 20 bp, Artificial Sequence
  sgRNA
  Abcg5_9
tttggaatgtaaaataaccc

SEQ ID NO: 8592 - DNA, 20 bp, Artificial Sequence
  sgRNA
  Abcg5_10
cgatgtgcgccatcacccaa

SEQ ID NO: 8593 - DNA, 20 bp, Artificial Sequence
  sgRNA
  Abcg5_11
accgtggcgatgacgctgaa

SEQ ID NO: 8594 - DNA, 20 bp, Artificial Sequence
  sgRNA
  Abcg5_12
agtcatgcagtccagtcctg

SEQ ID NO: 8595 - DNA, 20 bp, Artificial Sequence
  sgRNA
  Abcg5_13
ccccttcagcgtcatcgcca

SEQ ID NO: 8596 - DNA, 20 bp, Artificial Sequence
  sgRNA
  Abcg5_14
tgtagaagtccgcggagctg

SEQ ID NO: 8597 - DNA, 20 bp, Artificial Sequence
  sgRNA
  Abcg5_15
gcaacgtctcgcgcacagtg

SEQ ID NO: 8598 - DNA, 20 bp, Artificial Sequence
  sgRNA
  Abcg5_16
tgctggacgccatctccggg

SEQ ID NO: 8599 - DNA, 20 bp, Artificial Sequence
  sgRNA
  Abcg5_17
atacctgaaaaccttaccca

SEQ ID NO: 8600 - DNA, 20 bp, Artificial Sequence
  sgRNA
  Abcg5_18
gaatggctgcgagctgcgca

SEQ ID NO: 8601 - DNA, 20 bp, Artificial Sequence
  sgRNA
  Abcg5_19
cacgtggcggaccaaatgat

SEQ ID NO: 8602 - DNA, 20 bp, Artificial Sequence
  sgRNA
  Abcg5_20
ggatggtgacaatcacaatt

SEQ ID NO: 8603 - DNA, 20 bp, Artificial Sequence
  sgRNA
  Ace_1
gttgttgaacgagtacgcag

SEQ ID NO: 8604 - DNA, 20 bp, Artificial Sequence
  sgRNA
  Ace_2
acaaatacgtcaatctcagg

SEQ ID NO: 8605 - DNA, 20 bp, Artificial Sequence
  sgRNA
  Ace_3
ctataactcgagtgccgagg

SEQ ID NO: 8606 - DNA, 20 bp, Artificial Sequence
  sgRNA
  Ace_4
gcaatgcacacgggtcacga

SEQ ID NO: 8607 - DNA, 20 bp, Artificial Sequence
  sgRNA
  Ace_5
ttacccgacaactatccaga

SEQ ID NO: 8608 - DNA, 20 bp, Artificial Sequence
  sgRNA
  Ace_6
ggatagttgtcgggtaacgg

SEQ ID NO: 8609 - DNA, 20 bp, Artificial Sequence
  sgRNA
  Ace_7
gataaaggcgatcttgtcga

SEQ ID NO: 8610 - DNA, 20 bp, Artificial Sequence
  sgRNA
  Ace_8
catcgaccagtggcgctgga

SEQ ID NO: 8611 - DNA, 20 bp, Artificial Sequence
  sgRNA
  Ace_9
gtaaccatcacagcctccgc

SEQ ID NO: 8612 - DNA, 20 bp, Artificial Sequence
  sgRNA
  Ace_10
tcagctacctcatcgaccag

SEQ ID NO: 8613 - DNA, 20 bp, Artificial Sequence
  sgRNA
  Ace_11
actgctggagtacttccaac

SEQ ID NO: 8614 - DNA, 20 bp, Artificial Sequence
  sgRNA
  Ace_12
gttacccgacaactatccag

SEQ ID NO: 8615 - DNA, 20 bp, Artificial Sequence
  sgRNA
  Ace_13
gtgcagggaacgacgcacat

SEQ ID NO: 8616 - DNA, 20 bp, Artificial Sequence
  sgRNA
  Ace_14
aggaattcttcacctcgctg

SEQ ID NO: 8617 - DNA, 20 bp, Artificial Sequence
  sgRNA
  Ace_15
cttacccgtgactttccggg

SEQ ID NO: 8618 - DNA, 20 bp, Artificial Sequence
  sgRNA
  Ace_16
gtcgtgcgcccaactggcca

SEQ ID NO: 8619 - DNA, 20 bp, Artificial Sequence
  sgRNA
  Ace_17
ggacccatagtggcggtgca

SEQ ID NO: 8620 - DNA, 20 bp, Artificial Sequence
  sgRNA
  Ace_18
gggcacaggtaacagcccca

SEQ ID NO: 8621 - DNA, 20 bp, Artificial Sequence
  sgRNA
  Ace_19
catccagttccagttccacg

SEQ ID NO: 8622 - DNA, 20 bp, Artificial Sequence
  sgRNA
  Ace_20
cgtatttgtccccatagcgg

SEQ ID NO: 8623 - DNA, 20 bp, Artificial Sequence
  sgRNA
  Ace2_1
tgtagaacgtaccttcgcag

SEQ ID NO: 8624 - DNA, 20 bp, Artificial Sequence
  sgRNA
  Ace2_2
acttgtacagatattacaca

SEQ ID NO: 8625 - DNA, 20 bp, Artificial Sequence
  sgRNA
  Ace2_3
aatggatttcagatgcttgg

SEQ ID NO: 8626 - DNA, 20 bp, Artificial Sequence
  sgRNA
  Ace2_4
gatgtgtcccatctcgtgat

SEQ ID NO: 8627 - DNA, 20 bp, Artificial Sequence
  sgRNA
  Ace2_5
tactgctcagtccctcaccg

SEQ ID NO: 8628 - DNA, 20 bp, Artificial Sequence
  sgRNA
  Ace2_6
ctatcttcttgaaaatcgga

SEQ ID NO: 8629 - DNA, 20 bp, Artificial Sequence
  sgRNA
  Ace2_7
tggcatatgcaacagatgat

SEQ ID NO: 8630 - DNA, 20 bp, Artificial Sequence
  sgRNA
  Ace2_8
tgtagttgacgcttgatgat

SEQ ID NO: 8631 - DNA, 20 bp, Artificial Sequence
  sgRNA
  Ace2_9
ggatgtgtcccatctcgtga

SEQ ID NO: 8632 - DNA, 20 bp, Artificial Sequence
  sgRNA
  Ace2_10
caacctttcctgctaagaaa

SEQ ID NO: 8633 - DNA, 20 bp, Artificial Sequence
  sgRNA
  Ace2_11
tcagccagtcaaacaacggt

SEQ ID NO: 8634 - DNA, 20 bp, Artificial Sequence
  sgRNA
  Ace2_12
tctttcagccagtcaaacaa

SEQ ID NO: 8635 - DNA, 20 bp, Artificial Sequence
  sgRNA
  Ace2_13
gcatcagtaacatctatgtt

SEQ ID NO: 8636 - DNA, 20 bp, Artificial Sequence
  sgRNA
  Ace2_14
gagcagtagtaacagcaaca

SEQ ID NO: 8637 - DNA, 20 bp, Artificial Sequence
  sgRNA
  Ace2_15
ggttggaagtaattgagcag

SEQ ID NO: 8638 - DNA, 20 bp, Artificial Sequence
  sgRNA
  Ace2_16
tgaagacccactttgctgaa

SEQ ID NO: 8639 - DNA, 20 bp, Artificial Sequence
  sgRNA
  Ace2_17
tgttgtgatggcactggtag

SEQ ID NO: 8640 - DNA, 20 bp, Artificial Sequence
  sgRNA
  Ace2_18
caatgtccatcgagtcataa

SEQ ID NO: 8641 - DNA, 20 bp, Artificial Sequence
  sgRNA
  Ace2_19
tgtggtcctgaaaaacgaga

SEQ ID NO: 8642 - DNA, 20 bp, Artificial Sequence
  sgRNA
  Ace2_20
tctcaaattccactgaagct

SEQ ID NO: 8643 - DNA, 20 bp, Artificial Sequence
  sgRNA
  Ache_1
cagcagacctacattgccag

SEQ ID NO: 8644 - DNA, 20 bp, Artificial Sequence
  sgRNA
  Ache_2
aaatgtctgctaccagtacg

SEQ ID NO: 8645 - DNA, 20 bp, Artificial Sequence
  sgRNA
  Ache_3
gaccccgtaaaccagaaagt

SEQ ID NO: 8646 - DNA, 20 bp, Artificial Sequence
  sgRNA
  Ache_4
cagtatgtgcatgcccacgg

SEQ ID NO: 8647 - DNA, 20 bp, Artificial Sequence
  sgRNA
  Ache_5
gccgtcatacacatccaagg

SEQ ID NO: 8648 - DNA, 20 bp, Artificial Sequence
  sgRNA
  Ache_6
ggtatctatgaactaccgag

SEQ ID NO: 8649 - DNA, 20 bp, Artificial Sequence
  sgRNA
  Ache_7
cctcaagcaggctatcagct

SEQ ID NO: 8650 - DNA, 20 bp, Artificial Sequence
  sgRNA
  Ache_8
aatctacgtgagcccacagg

SEQ ID NO: 8651 - DNA, 20 bp, Artificial Sequence
  sgRNA
  Ache_9
tccgtggtgtagttcagcga

SEQ ID NO: 8652 - DNA, 20 bp, Artificial Sequence
  sgRNA
  Ache_10
gtatctatgaactaccgagt

SEQ ID NO: 8653 - DNA, 20 bp, Artificial Sequence
  sgRNA
  Ache_11
tcaacggcttgccttgcaat

SEQ ID NO: 8654 - DNA, 20 bp, Artificial Sequence
  sgRNA
  Ache_12
agttcagcgagggatccagg

SEQ ID NO: 8655 - DNA, 20 bp, Artificial Sequence
  sgRNA
  Ache_13
gtggagatttggagtctcga

SEQ ID NO: 8656 - DNA, 20 bp, Artificial Sequence
  sgRNA
  Ache_14
aaagatgtaggcatagaccc

SEQ ID NO: 8657 - DNA, 20 bp, Artificial Sequence
  sgRNA
  Ache_15
gcctccttggatgtgtatga

SEQ ID NO: 8658 - DNA, 20 bp, Artificial Sequence
  sgRNA
  Ache_16
gctgctggtgagggttcgag

SEQ ID NO: 8659 - DNA, 20 bp, Artificial Sequence
  sgRNA
  Ache_17
tcaggtgagtagggtcctca

SEQ ID NO: 8660 - DNA, 20 bp, Artificial Sequence
  sgRNA
  Ache_18
tccctcgctgaactacacca

SEQ ID NO: 8661 - DNA, 20 bp, Artificial Sequence
  sgRNA
  Ache_19
ggacagtatgtgcatgccca

SEQ ID NO: 8662 - DNA, 20 bp, Artificial Sequence
  sgRNA
  Ache_20
cttcgtgcctgtggtagacg

SEQ ID NO: 8663 - DNA, 20 bp, Artificial Sequence
  sgRNA
  Ackr1_1
aaggtctgagaatcgcgaag

SEQ ID NO: 8664 - DNA, 20 bp, Artificial Sequence
  sgRNA
  Ackr1_2
cattctggcagagttagcag

SEQ ID NO: 8665 - DNA, 20 bp, Artificial Sequence
  sgRNA
  Ackr1_3
ccagtagcccaggttgcata

SEQ ID NO: 8666 - DNA, 20 bp, Artificial Sequence
  sgRNA
  Ackr1_4
ctgaatattggtcaactccg

SEQ ID NO: 8667 - DNA, 20 bp, Artificial Sequence
  sgRNA
  Ackr1_5
gtagtcactcgagagttcat

SEQ ID NO: 8668 - DNA, 20 bp, Artificial Sequence
  sgRNA
  Ackr1_6
tccacaagacactaacccag

SEQ ID NO: 8669 - DNA, 20 bp, Artificial Sequence
  sgRNA
  Ackr1_7
gatccacaagacactaaccc

SEQ ID NO: 8670 - DNA, 20 bp, Artificial Sequence
  sgRNA
  Ackr1_8
tataccatacccagtagccc

SEQ ID NO: 8671 - DNA, 20 bp, Artificial Sequence
  sgRNA
  Ackr1_9
gcatcctatcaacagagctt

SEQ ID NO: 8672 - DNA, 20 bp, Artificial Sequence
  sgRNA
  Ackr1_10
ggtggtctgatggcagaaca

SEQ ID NO: 8673 - DNA, 20 bp, Artificial Sequence
  sgRNA
  Ackr1_11
attctggcagagttagcagt

SEQ ID NO: 8674 - DNA, 20 bp, Artificial Sequence
  sgRNA
  Ackr1_12
atccacaagacactaaccca

SEQ ID NO: 8675 - DNA, 20 bp, Artificial Sequence
  sgRNA
  Ackr1_13
acactggtgagcatgaagaa

SEQ ID NO: 8676 - DNA, 20 bp, Artificial Sequence
  sgRNA
  Ackr1_14
tgaggacaaggatctacggg

SEQ ID NO: 8677 - DNA, 20 bp, Artificial Sequence
  sgRNA
  Ackr1_15
tcaactccgtggcttcacct

SEQ ID NO: 8678 - DNA, 20 bp, Artificial Sequence
  sgRNA
  Ackr1_16
cacacagtgcagcatactca

SEQ ID NO: 8679 - DNA, 20 bp, Artificial Sequence
  sgRNA
  Ackr1_17
attgtaagcatcactggcca

SEQ ID NO: 8680 - DNA, 20 bp, Artificial Sequence
  sgRNA
  Ackr1_18
agacctgccaagcagattac

SEQ ID NO: 8681 - DNA, 20 bp, Artificial Sequence
  sgRNA
  Ackr1_19
agaagcctgtcttgtaggga

SEQ ID NO: 8682 - DNA, 20 bp, Artificial Sequence
  sgRNA
  Ackr1_20
cagtgctatcttcagcccct

SEQ ID NO: 8683 - DNA, 20 bp, Artificial Sequence
  sgRNA
  Ackr2_1
tgaccagaacgcaaccgatg

SEQ ID NO: 8684 - DNA, 20 bp, Artificial Sequence
  sgRNA
  Ackr2_2
gagtgcttatcaccttgcac

SEQ ID NO: 8685 - DNA, 20 bp, Artificial Sequence
  sgRNA
  Ackr2_3
aagatcaggctgtagacgac

SEQ ID NO: 8686 - DNA, 20 bp, Artificial Sequence
  sgRNA
  Ackr2_4
tccgtcttcgaggtgcagag

SEQ ID NO: 8687 - DNA, 20 bp, Artificial Sequence
  sgRNA
  Ackr2_5
cctgcaacgtatagtccaga

SEQ ID NO: 8688 - DNA, 20 bp, Artificial Sequence
  sgRNA
  Ackr2_6
gcaacgtatagtccagacgg

SEQ ID NO: 8689 - DNA, 20 bp, Artificial Sequence
  sgRNA
  Ackr2_7
gctgttctcggaaccgacgg

SEQ ID NO: 8690 - DNA, 20 bp, Artificial Sequence
  sgRNA
  Ackr2_8
gtatttgtccaggctcatgc

SEQ ID NO: 8691 - DNA, 20 bp, Artificial Sequence
  sgRNA
  Ackr2_9
ggttactgcccaggaagacg

SEQ ID NO: 8692 - DNA, 20 bp, Artificial Sequence
  sgRNA
  Ackr2_10
gcatgaatgaccttggggag

SEQ ID NO: 8693 - DNA, 20 bp, Artificial Sequence
  sgRNA
  Ackr2_11
gcatagtcactacaaacaag

SEQ ID NO: 8694 - DNA, 20 bp, Artificial Sequence
  sgRNA
  Ackr2_12
tctgcagtcaccgcttccgc

SEQ ID NO: 8695 - DNA, 20 bp, Artificial Sequence
  sgRNA
  Ackr2_13
tctgaggactcccttaacaa

SEQ ID NO: 8696 - DNA, 20 bp, Artificial Sequence
  sgRNA
  Ackr2_14
gctgctgttctcggaaccga

SEQ ID NO: 8697 - DNA, 20 bp, Artificial Sequence
  sgRNA
  Ackr2_15
gcgcaggtacagcttccaaa

SEQ ID NO: 8698 - DNA, 20 bp, Artificial Sequence
  sgRNA
  Ackr2_16
ctgaggactcccttaacaag

SEQ ID NO: 8699 - DNA, 20 bp, Artificial Sequence
  sgRNA
  Ackr2_17
catgagcctggacaaatacc

SEQ ID NO: 8700 - DNA, 20 bp, Artificial Sequence
  sgRNA
  Ackr2_18
tccactctgcacctcgaaga

SEQ ID NO: 8701 - DNA, 20 bp, Artificial Sequence
  sgRNA
  Ackr2_19
ccgcttccgccggtacctga

SEQ ID NO: 8702 - DNA, 20 bp, Artificial Sequence
  sgRNA
  Ackr2_20
tggtcagcatgaatgacctt

SEQ ID NO: 8703 - DNA, 20 bp, Artificial Sequence
  sgRNA
  Ackr3_1
acaccaagatgcatacaaca

SEQ ID NO: 8704 - DNA, 20 bp, Artificial Sequence
  sgRNA
  Ackr3_2
gcataaccagtggcccatgg

SEQ ID NO: 8705 - DNA, 20 bp, Artificial Sequence
  sgRNA
  Ackr3_3
ggtccacgctcatgcaggcg

SEQ ID NO: 8706 - DNA, 20 bp, Artificial Sequence
  sgRNA
  Ackr3_4
ccaacaatgagacctactgc

SEQ ID NO: 8707 - DNA, 20 bp, Artificial Sequence
  sgRNA
  Ackr3_5
ggatggtgatgacgacccac

SEQ ID NO: 8708 - DNA, 20 bp, Artificial Sequence
  sgRNA
  Ackr3_6
ggaagaagatgctcccaaag

SEQ ID NO: 8709 - DNA, 20 bp, Artificial Sequence
  sgRNA
  Ackr3_7
gttgacacagcagtgcacca

SEQ ID NO: 8710 - DNA, 20 bp, Artificial Sequence
  sgRNA
  Ackr3_8
cgagactgaccacccagacg

SEQ ID NO: 8711 - DNA, 20 bp, Artificial Sequence
  sgRNA
  Ackr3_9
atgcagtcgctgctgttaca

SEQ ID NO: 8712 - DNA, 20 bp, Artificial Sequence
  sgRNA
  Ackr3_10
gcttcatcaaccgcaactac

SEQ ID NO: 8713 - DNA, 20 bp, Artificial Sequence
  sgRNA
  Ackr3_11
caggtagtaggtatcaggca

SEQ ID NO: 8714 - DNA, 20 bp, Artificial Sequence
  sgRNA
  Ackr3_12
ttgatgtcagagtagttgcc

SEQ ID NO: 8715 - DNA, 20 bp, Artificial Sequence
  sgRNA
  Ackr3_13
tgatacctactacctgaaga

SEQ ID NO: 8716 - DNA, 20 bp, Artificial Sequence
  sgRNA
  Ackr3_14
tgatgaagctgtagagcacg

SEQ ID NO: 8717 - DNA, 20 bp, Artificial Sequence
  sgRNA
  Ackr3_15
tctccagctgacaggtaaac

SEQ ID NO: 8718 - DNA, 20 bp, Artificial Sequence
  sgRNA
  Ackr3_16
gcactgctacatcttgaacc

SEQ ID NO: 8719 - DNA, 20 bp, Artificial Sequence
  sgRNA
  Ackr3_17
gtctcgtgcagcataaccag

SEQ ID NO: 8720 - DNA, 20 bp, Artificial Sequence
  sgRNA
  Ackr3_18
gcaactactctgacatcaac

SEQ ID NO: 8721 - DNA, 20 bp, Artificial Sequence
  sgRNA
  Ackr3_19
tgtccagcagaaccacaaaa

SEQ ID NO: 8722 - DNA, 20 bp, Artificial Sequence
  sgRNA
  Ackr3_20
cacgagactgaccacccaga

SEQ ID NO: 8723 - DNA, 20 bp, Artificial Sequence
  sgRNA
  Ackr4_1
cagcaacagatgatccaaca

SEQ ID NO: 8724 - DNA, 20 bp, Artificial Sequence
  sgRNA
  Ackr4_2
caggttcaggatgtacacat

SEQ ID NO: 8725 - DNA, 20 bp, Artificial Sequence
  sgRNA
  Ackr4_3
agtaacgtcagccctgtaca

SEQ ID NO: 8726 - DNA, 20 bp, Artificial Sequence
  sgRNA
  Ackr4_4
actgtgtaaaaaaccagctg

SEQ ID NO: 8727 - DNA, 20 bp, Artificial Sequence
  sgRNA
  Ackr4_5
catcttgatgagcgccctgg

SEQ ID NO: 8728 - DNA, 20 bp, Artificial Sequence
  sgRNA
  Ackr4_6
tgtgctatgccagtaccgcc

SEQ ID NO: 8729 - DNA, 20 bp, Artificial Sequence
  sgRNA
  Ackr4_7
gtgctatgccagtaccgcca

SEQ ID NO: 8730 - DNA, 20 bp, Artificial Sequence
  sgRNA
  Ackr4_8
cagatgctggaaatcggcat

SEQ ID NO: 8731 - DNA, 20 bp, Artificial Sequence
  sgRNA
  Ackr4_9
gtaggaccctcagaatcaaa

SEQ ID NO: 8732 - DNA, 20 bp, Artificial Sequence
  sgRNA
  Ackr4_10
cctttgtcactgggctcgca

SEQ ID NO: 8733 - DNA, 20 bp, Artificial Sequence
  sgRNA
  Ackr4_11
gggtatgctcagcaagatgg

SEQ ID NO: 8734 - DNA, 20 bp, Artificial Sequence
  sgRNA
  Ackr4_12
gagaagacagagacagaacg

SEQ ID NO: 8735 - DNA, 20 bp, Artificial Sequence
  sgRNA
  Ackr4_13
ggcgtaaatcgccacaacta

SEQ ID NO: 8736 - DNA, 20 bp, Artificial Sequence
  sgRNA
  Ackr4_14
ctgcgatatgagcaaacgca

SEQ ID NO: 8737 - DNA, 20 bp, Artificial Sequence
  sgRNA
  Ackr4_15
taaaaagtctcgccccctca

SEQ ID NO: 8738 - DNA, 20 bp, Artificial Sequence
  sgRNA
  Ackr4_16
gatgctctctgtgacttgga

SEQ ID NO: 8739 - DNA, 20 bp, Artificial Sequence
  sgRNA
  Ackr4_17
gtaacaagtctgctacagcc

SEQ ID NO: 8740 - DNA, 20 bp, Artificial Sequence
  sgRNA
  Ackr4_18
tgtcaatgctgatacaagcc

SEQ ID NO: 8741 - DNA, 20 bp, Artificial Sequence
  sgRNA
  Ackr4_19
tatcgcagctggtgatcagc

SEQ ID NO: 8742 - DNA, 20 bp, Artificial Sequence
  sgRNA
  Ackr4_20
cagttaatgcagttcacgga

SEQ ID NO: 8743 - DNA, 20 bp, Artificial Sequence
  sgRNA
  Acp2_1
gggatttggtcagctaacca

SEQ ID NO: 8744 - DNA, 20 bp, Artificial Sequence
  sgRNA
  Acp2_2
acatggtggccaacgagaca

SEQ ID NO: 8745 - DNA, 20 bp, Artificial Sequence
  sgRNA
  Acp2_3
ttctgcagctgctcataacg

SEQ ID NO: 8746 - DNA, 20 bp, Artificial Sequence
  sgRNA
  Acp2_4
ttctgaacacctcttaccac

SEQ ID NO: 8747 - DNA, 20 bp, Artificial Sequence
  sgRNA
  Acp2_5
gccatggtagcgttgccgca

SEQ ID NO: 8748 - DNA, 20 bp, Artificial Sequence
  sgRNA
  Acp2_6
gttagctgaccaaatccctg

SEQ ID NO: 8749 - DNA, 20 bp, Artificial Sequence
  sgRNA
  Acp2_7
gcaacatggtggtagccagg

SEQ ID NO: 8750 - DNA, 20 bp, Artificial Sequence
  sgRNA
  Acp2_8
gcagcgtctgagccagctaa

SEQ ID NO: 8751 - DNA, 20 bp, Artificial Sequence
  sgRNA
  Acp2_9
gtatgggtggcatcaccgtt

SEQ ID NO: 8752 - DNA, 20 bp, Artificial Sequence
  sgRNA
  Acp2_10
ggaactggagaagagccgcc

SEQ ID NO: 8753 - DNA, 20 bp, Artificial Sequence
  sgRNA
  Acp2_11
gctgtagcatcccttcctgt

SEQ ID NO: 8754 - DNA, 20 bp, Artificial Sequence
  sgRNA
  Acp2_12
tgtgtcatacacattccaga

SEQ ID NO: 8755 - DNA, 20 bp, Artificial Sequence
  sgRNA
  Acp2_13
gtacagttcaaatatgtggc

SEQ ID NO: 8756 - DNA, 20 bp, Artificial Sequence
  sgRNA
  Acp2_14
ggttagctgaccaaatccct

SEQ ID NO: 8757 - DNA, 20 bp, Artificial Sequence
  sgRNA
  Acp2_15
gggcggcagaagcagcccat

SEQ ID NO: 8758 - DNA, 20 bp, Artificial Sequence
  sgRNA
  Acp2_16
tagctggctcagacgctgca

SEQ ID NO: 8759 - DNA, 20 bp, Artificial Sequence
  sgRNA
  Acp2_17
ctaccaccatgttgcagaca

SEQ ID NO: 8760 - DNA, 20 bp, Artificial Sequence
  sgRNA
  Acp2_18
tgaggagcaacactatgaga

SEQ ID NO: 8761 - DNA, 20 bp, Artificial Sequence
  sgRNA
  Acp2_19
gatccacgagcaagtacaga

SEQ ID NO: 8762 - DNA, 20 bp, Artificial Sequence
  sgRNA
  Acp2_20
gctaccaccatgttgcagac

SEQ ID NO: 8763 - DNA, 20 bp, Artificial Sequence
  sgRNA
  Acvr1_1
ggtggaaattctgtgttccg

SEQ ID NO: 8764 - DNA, 20 bp, Artificial Sequence
  sgRNA
  Acvr1_2
tgtgggagacagcactctag

SEQ ID NO: 8765 - DNA, 20 bp, Artificial Sequence
  sgRNA
  Acvr1_3
gctttcaggtttatgagcag

SEQ ID NO: 8766 - DNA, 20 bp, Artificial Sequence
  sgRNA
  Acvr1_4
attgtactgtccatagccag

SEQ ID NO: 8767 - DNA, 20 bp, Artificial Sequence
  sgRNA
  Acvr1_5
gctcgatgaaaccatccaag

SEQ ID NO: 8768 - DNA, 20 bp, Artificial Sequence
  sgRNA
  Acvr1_6
cggaacacagaatttccacc

SEQ ID NO: 8769 - DNA, 20 bp, Artificial Sequence
  sgRNA
  Acvr1_7
atactgcaaacaccaccgag

SEQ ID NO: 8770 - DNA, 20 bp, Artificial Sequence
  sgRNA
  Acvr1_8
acagtggtcctcgttcccgc

SEQ ID NO: 8771 - DNA, 20 bp, Artificial Sequence
  sgRNA
  Acvr1_9
ctatggacagtacaatccga

SEQ ID NO: 8772 - DNA, 20 bp, Artificial Sequence
  sgRNA
  Acvr1_10
ggtggtgatgagcccttcaa

SEQ ID NO: 8773 - DNA, 20 bp, Artificial Sequence
  sgRNA
  Acvr1_11
tcttctctgagcatcaacga

SEQ ID NO: 8774 - DNA, 20 bp, Artificial Sequence
  sgRNA
  Acvr1_12
tagagatatttgggacccaa

SEQ ID NO: 8775 - DNA, 20 bp, Artificial Sequence
  sgRNA
  Acvr1_13
gccggtatggagaagtatgg

SEQ ID NO: 8776 - DNA, 20 bp, Artificial Sequence
  sgRNA
  Acvr1_14
ggccaaacatacctaacaga

SEQ ID NO: 8777 - DNA, 20 bp, Artificial Sequence
  sgRNA
  Acvr1_15
taccatactccacgtctctg

SEQ ID NO: 8778 - DNA, 20 bp, Artificial Sequence
  sgRNA
  Acvr1_16
gggcctctcctgcgggaacg

SEQ ID NO: 8779 - DNA, 20 bp, Artificial Sequence
  sgRNA
  Acvr1_17
gaccaagcgctacatggctc

SEQ ID NO: 8780 - DNA, 20 bp, Artificial Sequence
  sgRNA
  Acvr1_18
tggccttatcatcctctcgg

SEQ ID NO: 8781 - DNA, 20 bp, Artificial Sequence
  sgRNA
  Acvr1_19
gcgcctgaaccccagagacg

SEQ ID NO: 8782 - DNA, 20 bp, Artificial Sequence
  sgRNA
  Acvr1_20
ggaaccacatcatagaatgg

SEQ ID NO: 8783 - DNA, 20 bp, Artificial Sequence
  sgRNA
  Acvr1b_1
gtgtctaccataaccgccag

SEQ ID NO: 8784 - DNA, 20 bp, Artificial Sequence
  sgRNA
  Acvr1b_2
tctacgacctctccacgtca

SEQ ID NO: 8785 - DNA, 20 bp, Artificial Sequence
  sgRNA
  Acvr1b_3
tgtacgtacctgcatcccca

SEQ ID NO: 8786 - DNA, 20 bp, Artificial Sequence
  sgRNA
  Acvr1b_4
caagaactcactcaccgctg

SEQ ID NO: 8787 - DNA, 20 bp, Artificial Sequence
  sgRNA
  Acvr1b_5
ctcccagtagacaagcccga

SEQ ID NO: 8788 - DNA, 20 bp, Artificial Sequence
  sgRNA
  Acvr1b_6
tgtcagtgaccgcatcatga

SEQ ID NO: 8789 - DNA, 20 bp, Artificial Sequence
  sgRNA
  Acvr1b_7
tgatgccgaccagctccaca

SEQ ID NO: 8790 - DNA, 20 bp, Artificial Sequence
  sgRNA
  Acvr1b_8
tcctcaatggaagggtcgga

SEQ ID NO: 8791 - DNA, 20 bp, Artificial Sequence
  sgRNA
  Acvr1b_9
ttcgcatctcctcaatggaa

SEQ ID NO: 8792 - DNA, 20 bp, Artificial Sequence
  sgRNA
  Acvr1b_10
gagggcactaagtcgtaata

SEQ ID NO: 8793 - DNA, 20 bp, Artificial Sequence
  sgRNA
  Acvr1b_11
tagacattgctccaaatcag

SEQ ID NO: 8794 - DNA, 20 bp, Artificial Sequence
  sgRNA
  Acvr1b_12
gcacgaagatgcaattctgg

SEQ ID NO: 8795 - DNA, 20 bp, Artificial Sequence
  sgRNA
  Acvr1b_13
gagagacacatctcgcaaga

SEQ ID NO: 8796 - DNA, 20 bp, Artificial Sequence
  sgRNA
  Acvr1b_14
agacattgctccaaatcaga

SEQ ID NO: 8797 - DNA, 20 bp, Artificial Sequence
  sgRNA
  Acvr1b_15
actgtgcgctggacaaaaag

SEQ ID NO: 8798 - DNA, 20 bp, Artificial Sequence
  sgRNA
  Acvr1b_16
ctaccataaccgccagaggt

SEQ ID NO: 8799 - DNA, 20 bp, Artificial Sequence
  sgRNA
  Acvr1b_17
agtatggcgtggtcgctgga

SEQ ID NO: 8800 - DNA, 20 bp, Artificial Sequence
  sgRNA
  Acvr1b_18
tcttctcttctcgtgaagaa

SEQ ID NO: 8801 - DNA, 20 bp, Artificial Sequence
  sgRNA
  Acvr1b_19
aagagattatcggcaagggc

SEQ ID NO: 8802 - DNA, 20 bp, Artificial Sequence
  sgRNA
  Acvr1b_20
ttgtatgtgaccagaagcta

SEQ ID NO: 8803 - DNA, 20 bp, Artificial Sequence
  sgRNA
  Acvr1c_1
gactaagagacacaacgtgg

SEQ ID NO: 8804 - DNA, 20 bp, Artificial Sequence
  sgRNA
  Acvr1c_2
tgagagatcttggttccgtg

SEQ ID NO: 8805 - DNA, 20 bp, Artificial Sequence
  sgRNA
  Acvr1c_3
cctgagcatttagttccggg

SEQ ID NO: 8806 - DNA, 20 bp, Artificial Sequence
  sgRNA
  Acvr1c_4
cgtaggaaaaggtcggtttg

SEQ ID NO: 8807 - DNA, 20 bp, Artificial Sequence
  sgRNA
  Acvr1c_5
tgagtgctggtacgccaacg

SEQ ID NO: 8808 - DNA, 20 bp, Artificial Sequence
  sgRNA
  Acvr1c_6
tgtcagctgcgatgaaaccg

SEQ ID NO: 8809 - DNA, 20 bp, Artificial Sequence
  sgRNA
  Acvr1c_7
cttgtgccatagctgactta

SEQ ID NO: 8810 - DNA, 20 bp, Artificial Sequence
  sgRNA
  Acvr1c_8
gatggtcttcttcacgcgca

SEQ ID NO: 8811 - DNA, 20 bp, Artificial Sequence
  sgRNA
  Acvr1c_9
tggttcaaagaacaatcgca

SEQ ID NO: 8812 - DNA, 20 bp, Artificial Sequence
  sgRNA
  Acvr1c_10
cccgttggttagcatgacgg

SEQ ID NO: 8813 - DNA, 20 bp, Artificial Sequence
  sgRNA
  Acvr1c_11
gcctccgtcatgctaaccaa

SEQ ID NO: 8814 - DNA, 20 bp, Artificial Sequence
  sgRNA
  Acvr1c_12
cccaacatgctccttccgtt

SEQ ID NO: 8815 - DNA, 20 bp, Artificial Sequence
  sgRNA
  Acvr1c_13
aagaaatcgtaggaaaaggt

SEQ ID NO: 8816 - DNA, 20 bp, Artificial Sequence
  sgRNA
  Acvr1c_14
gaccaaatctcccaaaccag

SEQ ID NO: 8817 - DNA, 20 bp, Artificial Sequence
  sgRNA
  Acvr1c_15
cctccgtcatgctaaccaac

SEQ ID NO: 8818 - DNA, 20 bp, Artificial Sequence
  sgRNA
  Acvr1c_16
atcctaaagtgggaaccaag

SEQ ID NO: 8819 - DNA, 20 bp, Artificial Sequence
  sgRNA
  Acvr1c_17
gctctgtgggaccaagtcga

SEQ ID NO: 8820 - DNA, 20 bp, Artificial Sequence
  sgRNA
  Acvr1c_18
atcacactgcaccttcccac

SEQ ID NO: 8821 - DNA, 20 bp, Artificial Sequence
  sgRNA
  Acvr1c_19
gagatcttggttccgtgagg

SEQ ID NO: 8822 - DNA, 20 bp, Artificial Sequence
  sgRNA
  Acvr1c_20
ctgagacacgagaacatcct

SEQ ID NO: 8823 - DNA, 20 bp, Artificial Sequence
  sgRNA
  Acvr2a_1
agagacagaaccaaccagac

SEQ ID NO: 8824 - DNA, 20 bp, Artificial Sequence
  sgRNA
  Acvr2a_2
ggtgtacagacatcacaaga

SEQ ID NO: 8825 - DNA, 20 bp, Artificial Sequence
  sgRNA
  Acvr2a_3
aggattggcatatttacatg

SEQ ID NO: 8826 - DNA, 20 bp, Artificial Sequence
  sgRNA
  Acvr2a_4
agctgttagaagtgaaagca

SEQ ID NO: 8827 - DNA, 20 bp, Artificial Sequence
  sgRNA
  Acvr2a_5
atatgccaatcctctagcca

SEQ ID NO: 8828 - DNA, 20 bp, Artificial Sequence
  sgRNA
  Acvr2a_6
gggtgctataaacttccaaa

SEQ ID NO: 8829 - DNA, 20 bp, Artificial Sequence
  sgRNA
  Acvr2a_7
aacgagaagccaattcccat

SEQ ID NO: 8830 - DNA, 20 bp, Artificial Sequence
  sgRNA
  Acvr2a_8
gtaccactaatgttaattgc

SEQ ID NO: 8831 - DNA, 20 bp, Artificial Sequence
  sgRNA
  Acvr2a_9
gcagaagccaggttatcagc

SEQ ID NO: 8832 - DNA, 20 bp, Artificial Sequence
  sgRNA
  Acvr2a_10
gacttcatattcattctgcc

SEQ ID NO: 8833 - DNA, 20 bp, Artificial Sequence
  sgRNA
  Acvr2a_11
ttcccataggactaatccca

SEQ ID NO: 8834 - DNA, 20 bp, Artificial Sequence
  sgRNA
  Acvr2a_12
gagtaggaacaagtacagga

SEQ ID NO: 8835 - DNA, 20 bp, Artificial Sequence
  sgRNA
  Acvr2a_13
gagaacatactacagttcat

SEQ ID NO: 8836 - DNA, 20 bp, Artificial Sequence
  sgRNA
  Acvr2a_14
tcctgcatatcttcaagaga

SEQ ID NO: 8837 - DNA, 20 bp, Artificial Sequence
  sgRNA
  Acvr2a_15
atggctccagaggtgttgga

SEQ ID NO: 8838 - DNA, 20 bp, Artificial Sequence
  sgRNA
  Acvr2a_16
ttatctttatcaccatagca

SEQ ID NO: 8839 - DNA, 20 bp, Artificial Sequence
  sgRNA
  Acvr2a_17
tgagtaggaacaagtacagg

SEQ ID NO: 8840 - DNA, 20 bp, Artificial Sequence
  sgRNA
  Acvr2a_18
gatatacctggcttaaaaga

SEQ ID NO: 8841 - DNA, 20 bp, Artificial Sequence
  sgRNA
  Acvr2a_19
tgggttggccttaaagttcg

SEQ ID NO: 8842 - DNA, 20 bp, Artificial Sequence
  sgRNA
  Acvr2a_20
gctatggtgataaagataaa

SEQ ID NO: 8843 - DNA, 20 bp, Artificial Sequence
  sgRNA
  Acvr2b_1
gtggaacgaactgtgccacg

SEQ ID NO: 8844 - DNA, 20 bp, Artificial Sequence
  sgRNA
  Acvr2b_2
ccgatgacgatacatccaga

SEQ ID NO: 8845 - DNA, 20 bp, Artificial Sequence
  sgRNA
  Acvr2b_3
gcagcagcagaagtacacct

SEQ ID NO: 8846 - DNA, 20 bp, Artificial Sequence
  sgRNA
  Acvr2b_4
catctactacaacgccaact

SEQ ID NO: 8847 - DNA, 20 bp, Artificial Sequence
  sgRNA
  Acvr2b_5
tggccaatctcctcctcgaa

SEQ ID NO: 8848 - DNA, 20 bp, Artificial Sequence
  sgRNA
  Acvr2b_6
gtgacatcgtctccgccacg

SEQ ID NO: 8849 - DNA, 20 bp, Artificial Sequence
  sgRNA
  Acvr2b_7
tggccctcaccacgacacca

SEQ ID NO: 8850 - DNA, 20 bp, Artificial Sequence
  sgRNA
  Acvr2b_8
gcccgagctgttgcgccacg

SEQ ID NO: 8851 - DNA, 20 bp, Artificial Sequence
  sgRNA
  Acvr2b_9
gctgaagagcgacctcaccg

SEQ ID NO: 8852 - DNA, 20 bp, Artificial Sequence
  sgRNA
  Acvr2b_10
tccccttgaggtaatccgtg

SEQ ID NO: 8853 - DNA, 20 bp, Artificial Sequence
  sgRNA
  Acvr2b_11
gcgtatcgacatgtacgcca

SEQ ID NO: 8854 - DNA, 20 bp, Artificial Sequence
  sgRNA
  Acvr2b_12
tggcgtacatgtcgatacgc

SEQ ID NO: 8855 - DNA, 20 bp, Artificial Sequence
  sgRNA
  Acvr2b_13
gtacatgtcgatacgcagga

SEQ ID NO: 8856 - DNA, 20 bp, Artificial Sequence
  sgRNA
  Acvr2b_14
atgagagagaggcctccaat

SEQ ID NO: 8857 - DNA, 20 bp, Artificial Sequence
  sgRNA
  Acvr2b_15
tggatgtccacatggccgta

SEQ ID NO: 8858 - DNA, 20 bp, Artificial Sequence
  sgRNA
  Acvr2b_16
gagcaggtccacattggtga

SEQ ID NO: 8859 - DNA, 20 bp, Artificial Sequence
  sgRNA
  Acvr2b_17
gcatctactacaacgccaac

SEQ ID NO: 8860 - DNA, 20 bp, Artificial Sequence
  sgRNA
  Acvr2b_18
gtacatgctgcccttcgagg

SEQ ID NO: 8861 - DNA, 20 bp, Artificial Sequence
  sgRNA
  Acvr2b_19
ccttctggatgtatcgtcat

SEQ ID NO: 8862 - DNA, 20 bp, Artificial Sequence
  sgRNA
  Acvr2b_20
gcctactcgctgctgcccat

SEQ ID NO: 8863 - DNA, 20 bp, Artificial Sequence
  sgRNA
  Acvrl1_1
tgccaaagatctccacatgt

SEQ ID NO: 8864 - DNA, 20 bp, Artificial Sequence
  sgRNA
  Acvrl1_2
gttgcgctggtagagtgtgt

SEQ ID NO: 8865 - DNA, 20 bp, Artificial Sequence
  sgRNA
  Acvrl1_3
gttccgcgaagtcatgtcgg

SEQ ID NO: 8866 - DNA, 20 bp, Artificial Sequence
  sgRNA
  Acvrl1_4
gccacaagcctagagcaccc

SEQ ID NO: 8867 - DNA, 20 bp, Artificial Sequence
  sgRNA
  Acvrl1_5
gatgtgctcatccagcacct

SEQ ID NO: 8868 - DNA, 20 bp, Artificial Sequence
  sgRNA
  Acvrl1_6
gcgactcttgaggtcacgat

SEQ ID NO: 8869 - DNA, 20 bp, Artificial Sequence
  sgRNA
  Acvrl1_7
cctctgcagaaagtcataga

SEQ ID NO: 8870 - DNA, 20 bp, Artificial Sequence
  sgRNA
  Acvrl1_8
cgagttccgcgaagtcatgt

SEQ ID NO: 8871 - DNA, 20 bp, Artificial Sequence
  sgRNA
  Acvrl1_9
tatcggcaacaacccccgag

SEQ ID NO: 8872 - DNA, 20 bp, Artificial Sequence
  sgRNA
  Acvrl1_10
cgatatggtgaggtgtggcg

SEQ ID NO: 8873 - DNA, 20 bp, Artificial Sequence
  sgRNA
  Acvrl1_11
tcgcctccgacatgacttcg

SEQ ID NO: 8874 - DNA, 20 bp, Artificial Sequence
  sgRNA
  Acvrl1_12
ggtaccatgtcatagaaagg

SEQ ID NO: 8875 - DNA, 20 bp, Artificial Sequence
  sgRNA
  Acvrl1_13
taggcttgtggcgtgtccgg

SEQ ID NO: 8876 - DNA, 20 bp, Artificial Sequence
  sgRNA
  Acvrl1_14
atcacccactaccatgaaca

SEQ ID NO: 8877 - DNA, 20 bp, Artificial Sequence
  sgRNA
  Acvrl1_15
cttgaggtcacgatgggcaa

SEQ ID NO: 8878 - DNA, 20 bp, Artificial Sequence
  sgRNA
  Acvrl1_16
agacacccaccatccctaac

SEQ ID NO: 8879 - DNA, 20 bp, Artificial Sequence
  sgRNA
  Acvrl1_17
cttagacacgacaacatcct

SEQ ID NO: 8880 - DNA, 20 bp, Artificial Sequence
  sgRNA
  Acvrl1_18
cctggacagcgactgtacta

SEQ ID NO: 8881 - DNA, 20 bp, Artificial Sequence
  sgRNA
  Acvrl1_19
cgcagccccgatagacctgg

SEQ ID NO: 8882 - DNA, 20 bp, Artificial Sequence
  sgRNA
  Acvrl1_20
acgactcaaagcagtctgtg

SEQ ID NO: 8883 - DNA, 20 bp, Artificial Sequence
  sgRNA
  Adam10_1
ggtttcatcaagactcgtgg

SEQ ID NO: 8884 - DNA, 20 bp, Artificial Sequence
  sgRNA
  Adam10_2
cccataaatacggcccacag

SEQ ID NO: 8885 - DNA, 20 bp, Artificial Sequence
  sgRNA
  Adam10_3
tatctgtggaaacgggatgg

SEQ ID NO: 8886 - DNA, 20 bp, Artificial Sequence
  sgRNA
  Adam10_4
caaacgagcagtctcacatg

SEQ ID NO: 8887 - DNA, 20 bp, Artificial Sequence
  sgRNA
  Adam10_5
atgtccagtgtaaatatgag

SEQ ID NO: 8888 - DNA, 20 bp, Artificial Sequence
  sgRNA
  Adam10_6
cataaatacggcccacaggg

SEQ ID NO: 8889 - DNA, 20 bp, Artificial Sequence
  sgRNA
  Adam10_7
ggatgattctgactgtgcaa

SEQ ID NO: 8890 - DNA, 20 bp, Artificial Sequence
  sgRNA
  Adam10_8
ggtctgtgaagacataggcc

SEQ ID NO: 8891 - DNA, 20 bp, Artificial Sequence
  sgRNA
  Adam10_9
gccctgatcatgttaatggc

SEQ ID NO: 8892 - DNA, 20 bp, Artificial Sequence
  sgRNA
  Adam10_10
gcacactgtgctgtacagca

SEQ ID NO: 8893 - DNA, 20 bp, Artificial Sequence
  sgRNA
  Adam10_11
ggaaatctagaagtaaaaac

SEQ ID NO: 8894 - DNA, 20 bp, Artificial Sequence
  sgRNA
  Adam10_12
tcgatgccaaccagccagag

SEQ ID NO: 8895 - DNA, 20 bp, Artificial Sequence
  sgRNA
  Adam10_13
gaaggtttcatcaagactcg

SEQ ID NO: 8896 - DNA, 20 bp, Artificial Sequence
  sgRNA
  Adam10_14
atagagttgtggactaaaaa

SEQ ID NO: 8897 - DNA, 20 bp, Artificial Sequence
  sgRNA
  Adam10_15
aagtgtccctcttcattcgt

SEQ ID NO: 8898 - DNA, 20 bp, Artificial Sequence
  sgRNA
  Adam10_16
gttcaacctacgaatgaaga

SEQ ID NO: 8899 - DNA, 20 bp, Artificial Sequence
  sgRNA
  Adam10_17
ttcgatgccaaccagccaga

SEQ ID NO: 8900 - DNA, 20 bp, Artificial Sequence
  sgRNA
  Adam10_18
tggtgttcttggtctggcct

SEQ ID NO: 8901 - DNA, 20 bp, Artificial Sequence
  sgRNA
  Adam10_19
cccatttgataactctctcg

SEQ ID NO: 8902 - DNA, 20 bp, Artificial Sequence
  sgRNA
  Adam10_20
agtcaaagtctgaaaagtgc

SEQ ID NO: 8903 - DNA, 20 bp, Artificial Sequence
  sgRNA
  Adam11_1
ggggtccggtaaatgaggtg

SEQ ID NO: 8904 - DNA, 20 bp, Artificial Sequence
  sgRNA
  Adam11_2
tctctgggcccagatataca

SEQ ID NO: 8905 - DNA, 20 bp, Artificial Sequence
  sgRNA
  Adam11_3
gtggcgctccacatactgcg

SEQ ID NO: 8906 - DNA, 20 bp, Artificial Sequence
  sgRNA
  Adam11_4
ctccgcgctagtaccttgag

SEQ ID NO: 8907 - DNA, 20 bp, Artificial Sequence
  sgRNA
  Adam11_5
gtacgacccgacccagcagg

SEQ ID NO: 8908 - DNA, 20 bp, Artificial Sequence
  sgRNA
  Adam11_6
ctgcagcgcgagaacttgcg

SEQ ID NO: 8909 - DNA, 20 bp, Artificial Sequence
  sgRNA
  Adam11_7
cccggcttatggtctaccgg

SEQ ID NO: 8910 - DNA, 20 bp, Artificial Sequence
  sgRNA
  Adam11_8
tcgggtcgtaccttccacga

SEQ ID NO: 8911 - DNA, 20 bp, Artificial Sequence
  sgRNA
  Adam11_9
agtgtcaccttctaccacca

SEQ ID NO: 8912 - DNA, 20 bp, Artificial Sequence
  sgRNA
  Adam11_10
atgatgatgttggtaccgct

SEQ ID NO: 8913 - DNA, 20 bp, Artificial Sequence
  sgRNA
  Adam11_11
ggagcgccacttcagccggg

SEQ ID NO: 8914 - DNA, 20 bp, Artificial Sequence
  sgRNA
  Adam11_12
tctggttgccatggaaacgt

SEQ ID NO: 8915 - DNA, 20 bp, Artificial Sequence
  sgRNA
  Adam11_13
cttatggtctaccggcggga

SEQ ID NO: 8916 - DNA, 20 bp, Artificial Sequence
  sgRNA
  Adam11_14
gtagaccataagccgggcca

SEQ ID NO: 8917 - DNA, 20 bp, Artificial Sequence
  sgRNA
  Adam11_15
ccgccggtagaccataagcc

SEQ ID NO: 8918 - DNA, 20 bp, Artificial Sequence
  sgRNA
  Adam11_16
cctaaccttcacaagctgga

SEQ ID NO: 8919 - DNA, 20 bp, Artificial Sequence
  sgRNA
  Adam11_17
gcttatggtctaccggcggg

SEQ ID NO: 8920 - DNA, 20 bp, Artificial Sequence
  sgRNA
  Adam11_18
tggaggccgctgtaaaaccc

SEQ ID NO: 8921 - DNA, 20 bp, Artificial Sequence
  sgRNA
  Adam11_19
gttggacaccagggtccgcc

SEQ ID NO: 8922 - DNA, 20 bp, Artificial Sequence
  sgRNA
  Adam11_20
gacattgcagagacctgcac

SEQ ID NO: 8923 - DNA, 20 bp, Artificial Sequence
  sgRNA
  Adam12_1
tccagtctagaaactcatgg

SEQ ID NO: 8924 - DNA, 20 bp, Artificial Sequence
  sgRNA
  Adam12_2
agagcatgacgaacatccaa

SEQ ID NO: 8925 - DNA, 20 bp, Artificial Sequence
  sgRNA
  Adam12_3
ggagatccttatggtaactg

SEQ ID NO: 8926 - DNA, 20 bp, Artificial Sequence
  sgRNA
  Adam12_4
ggagcctggtacttaccccg

SEQ ID NO: 8927 - DNA, 20 bp, Artificial Sequence
  sgRNA
  Adam12_5
gcatcatgaacccgtccacg

SEQ ID NO: 8928 - DNA, 20 bp, Artificial Sequence
  sgRNA
  Adam12_6
tcatcagcaggcctttcccg

SEQ ID NO: 8929 - DNA, 20 bp, Artificial Sequence
  sgRNA
  Adam12_7
ggattcctacagtcaagccc

SEQ ID NO: 8930 - DNA, 20 bp, Artificial Sequence
  sgRNA
  Adam12_8
gcagtgcacatgctcatgat

SEQ ID NO: 8931 - DNA, 20 bp, Artificial Sequence
  sgRNA
  Adam12_9
gataagctgagcattgtcgt

SEQ ID NO: 8932 - DNA, 20 bp, Artificial Sequence
  sgRNA
  Adam12_10
agtaccatcttgcagataat

SEQ ID NO: 8933 - DNA, 20 bp, Artificial Sequence
  sgRNA
  Adam12_11
catgcagtgccacggccgag

SEQ ID NO: 8934 - DNA, 20 bp, Artificial Sequence
  sgRNA
  Adam12_12
ggagaccagagcaagtactg

SEQ ID NO: 8935 - DNA, 20 bp, Artificial Sequence
  sgRNA
  Adam12_13
gtgatgacatgccagaccca

SEQ ID NO: 8936 - DNA, 20 bp, Artificial Sequence
  sgRNA
  Adam12_14
tgttcgtcatgctctcagct

SEQ ID NO: 8937 - DNA, 20 bp, Artificial Sequence
  sgRNA
  Adam12_15
ccactcctaccagcacgatc

SEQ ID NO: 8938 - DNA, 20 bp, Artificial Sequence
  sgRNA
  Adam12_16
gatgcagcctcctttctctg

SEQ ID NO: 8939 - DNA, 20 bp, Artificial Sequence
  sgRNA
  Adam12_17
ccaaacttgtcacagaaggg

SEQ ID NO: 8940 - DNA, 20 bp, Artificial Sequence
  sgRNA
  Adam12_18
aggtcactgcggcaccaagg

SEQ ID NO: 8941 - DNA, 20 bp, Artificial Sequence
  sgRNA
  Adam12_19
gtgcctcttcaacctaccag

SEQ ID NO: 8942 - DNA, 20 bp, Artificial Sequence
  sgRNA
  Adam12_20
gacacgggtggccatcatgt

SEQ ID NO: 8943 - DNA, 20 bp, Artificial Sequence
  sgRNA
  Adam15_1
gggggctgtcctgaacaacc

SEQ ID NO: 8944 - DNA, 20 bp, Artificial Sequence
  sgRNA
  Adam15_2
tggcacccgaatggtcagcg

SEQ ID NO: 8945 - DNA, 20 bp, Artificial Sequence
  sgRNA
  Adam15_3
gattgtggctgataattcag

SEQ ID NO: 8946 - DNA, 20 bp, Artificial Sequence
  sgRNA
  Adam15_4
tgttcccctgacttctccgg

SEQ ID NO: 8947 - DNA, 20 bp, Artificial Sequence
  sgRNA
  Adam15_5
gctgaaccggacactagaag

SEQ ID NO: 8948 - DNA, 20 bp, Artificial Sequence
  sgRNA
  Adam15_6
ggtaccacaccagagttggg

SEQ ID NO: 8949 - DNA, 20 bp, Artificial Sequence
  sgRNA
  Adam15_7
agggctacccggacattcaa

SEQ ID NO: 8950 - DNA, 20 bp, Artificial Sequence
  sgRNA
  Adam15_8
agtccaagatcggctctcgg

SEQ ID NO: 8951 - DNA, 20 bp, Artificial Sequence
  sgRNA
  Adam15_9
gtacgaggaccaataacaac

SEQ ID NO: 8952 - DNA, 20 bp, Artificial Sequence
  sgRNA
  Adam15_10
cgaggaccaataacaacagg

SEQ ID NO: 8953 - DNA, 20 bp, Artificial Sequence
  sgRNA
  Adam15_11
aacgaccaggacctccacag

SEQ ID NO: 8954 - DNA, 20 bp, Artificial Sequence
  sgRNA
  Adam15_12
agtctgtccggcgccagcgg

SEQ ID NO: 8955 - DNA, 20 bp, Artificial Sequence
  sgRNA
  Adam15_13
aaggcatgtagctaccacca

SEQ ID NO: 8956 - DNA, 20 bp, Artificial Sequence
  sgRNA
  Adam15_14
gatctgcctgagttctgccc

SEQ ID NO: 8957 - DNA, 20 bp, Artificial Sequence
  sgRNA
  Adam15_15
caggtgaaatggtcacagca

SEQ ID NO: 8958 - DNA, 20 bp, Artificial Sequence
  sgRNA
  Adam15_16
gcagtttaactgtgtcccgt

SEQ ID NO: 8959 - DNA, 20 bp, Artificial Sequence
  sgRNA
  Adam15_17
tcttggactgagcccaacag

SEQ ID NO: 8960 - DNA, 20 bp, Artificial Sequence
  sgRNA
  Adam15_18
gcactgtcatggggcagtcg

SEQ ID NO: 8961 - DNA, 20 bp, Artificial Sequence
  sgRNA
  Adam15_19
ggctaagagctgcatcatgg

SEQ ID NO: 8962 - DNA, 20 bp, Artificial Sequence
  sgRNA
  Adam15_20
ggcacccgaatggtcagcga

SEQ ID NO: 8963 - DNA, 20 bp, Artificial Sequence
  sgRNA
  Adam17_1
ggtgtgtggcaactccaggg

SEQ ID NO: 8964 - DNA, 20 bp, Artificial Sequence
  sgRNA
  Adam17_2
acacgtcgtgggataatgca

SEQ ID NO: 8965 - DNA, 20 bp, Artificial Sequence
  sgRNA
  Adam17_3
catcgacgtacggcacacac

SEQ ID NO: 8966 - DNA, 20 bp, Artificial Sequence
  sgRNA
  Adam17_4
gccccaaatgaggaccaagg

SEQ ID NO: 8967 - DNA, 20 bp, Artificial Sequence
  sgRNA
  Adam17_5
tccggtatatgtcatcaact

SEQ ID NO: 8968 - DNA, 20 bp, Artificial Sequence
  sgRNA
  Adam17_6
tgttcaggtacataataccc

SEQ ID NO: 8969 - DNA, 20 bp, Artificial Sequence
  sgRNA
  Adam17_7
acatataccggaacacgtcg

SEQ ID NO: 8970 - DNA, 20 bp, Artificial Sequence
  sgRNA
  Adam17_8
ggcgcagaagaagtgccagg

SEQ ID NO: 8971 - DNA, 20 bp, Artificial Sequence
  sgRNA
  Adam17_9
catataccggaacacgtcgt

SEQ ID NO: 8972 - DNA, 20 bp, Artificial Sequence
  sgRNA
  Adam17_10
gcatcgacgtacggcacaca

SEQ ID NO: 8973 - DNA, 20 bp, Artificial Sequence
  sgRNA
  Adam17_11
ggtacgtgaaaagatgagcc

SEQ ID NO: 8974 - DNA, 20 bp, Artificial Sequence
  sgRNA
  Adam17_12
tctccacaagaggtaaaacc

SEQ ID NO: 8975 - DNA, 20 bp, Artificial Sequence
  sgRNA
  Adam17_13
actcttggattagcttacgt

SEQ ID NO: 8976 - DNA, 20 bp, Artificial Sequence
  sgRNA
  Adam17_14
gggataatgcagggtttaaa

SEQ ID NO: 8977 - DNA, 20 bp, Artificial Sequence
  sgRNA
  Adam17_15
gctgaatattagctaaggag

SEQ ID NO: 8978 - DNA, 20 bp, Artificial Sequence
  sgRNA
  Adam17_16
gaacttcttcagtggtcacg

SEQ ID NO: 8979 - DNA, 20 bp, Artificial Sequence
  sgRNA
  Adam17_17
tcatcttcagcatctccggg

SEQ ID NO: 8980 - DNA, 20 bp, Artificial Sequence
  sgRNA
  Adam17_18
atattcagcagcactccata

SEQ ID NO: 8981 - DNA, 20 bp, Artificial Sequence
  sgRNA
  Adam17_19
atattgaagtgtctttcacc

SEQ ID NO: 8982 - DNA, 20 bp, Artificial Sequence
  sgRNA
  Adam17_20
caaatgtgagaaacgagtac

SEQ ID NO: 8983 - DNA, 20 bp, Artificial Sequence
  sgRNA
  Adam18_1
caggctcattgccattaccg

SEQ ID NO: 8984 - DNA, 20 bp, Artificial Sequence
  sgRNA
  Adam18_2
acgcccgaaatacatcggag

SEQ ID NO: 8985 - DNA, 20 bp, Artificial Sequence
  sgRNA
  Adam18_3
gctgcgaccatgaaacgtgc

SEQ ID NO: 8986 - DNA, 20 bp, Artificial Sequence
  sgRNA
  Adam18_4
gacttcacagaatattgcga

SEQ ID NO: 8987 - DNA, 20 bp, Artificial Sequence
  sgRNA
  Adam18_5
acttacagattggatcaccg

SEQ ID NO: 8988 - DNA, 20 bp, Artificial Sequence
  sgRNA
  Adam18_6
ttacagattggatcaccggg

SEQ ID NO: 8989 - DNA, 20 bp, Artificial Sequence
  sgRNA
  Adam18_7
attgcaccagaaatcggcca

SEQ ID NO: 8990 - DNA, 20 bp, Artificial Sequence
  sgRNA
  Adam18_8
tctgatctcatagacaaccc

SEQ ID NO: 8991 - DNA, 20 bp, Artificial Sequence
  sgRNA
  Adam18_9
gctccctgctgcattatgca

SEQ ID NO: 8992 - DNA, 20 bp, Artificial Sequence
  sgRNA
  Adam18_10
tctgcatctccgcccttgcg

SEQ ID NO: 8993 - DNA, 20 bp, Artificial Sequence
  sgRNA
  Adam18_11
ggatcatgaagagaaacgaa

SEQ ID NO: 8994 - DNA, 20 bp, Artificial Sequence
  sgRNA
  Adam18_12
acgccactaagaagtgcaaa

SEQ ID NO: 8995 - DNA, 20 bp, Artificial Sequence
  sgRNA
  Adam18_13
tggcagagacagcgcatacg

SEQ ID NO: 8996 - DNA, 20 bp, Artificial Sequence
  sgRNA
  Adam18_14
gcacttcatcaacatatcct

SEQ ID NO: 8997 - DNA, 20 bp, Artificial Sequence
  sgRNA
  Adam18_15
catacgtcattaccattgac

SEQ ID NO: 8998 - DNA, 20 bp, Artificial Sequence
  sgRNA
  Adam18_16
aatagaccacagattgacta

SEQ ID NO: 8999 - DNA, 20 bp, Artificial Sequence
  sgRNA
  Adam18_17
gactcgtactcggtaccttg

SEQ ID NO: 9000 - DNA, 20 bp, Artificial Sequence
  sgRNA
  Adam18_18
gcagatgctgagtgtcacaa

SEQ ID NO: 9001 - DNA, 20 bp, Artificial Sequence
  sgRNA
  Adam18_19
aagatagagccacgcaaggg

SEQ ID NO: 9002 - DNA, 20 bp, Artificial Sequence
  sgRNA
  Adam18_20
aggagacgcccgaaatacat

SEQ ID NO: 9003 - DNA, 20 bp, Artificial Sequence
  sgRNA
  Adam2_1
atgttggcgctacctatcaa

SEQ ID NO: 9004 - DNA, 20 bp, Artificial Sequence
  sgRNA
  Adam2_2
aagcaatggctacgaaacac

SEQ ID NO: 9005 - DNA, 20 bp, Artificial Sequence
  sgRNA
  Adam2_3
gaattactgtaagattaaag

SEQ ID NO: 9006 - DNA, 20 bp, Artificial Sequence
  sgRNA
  Adam2_4
tgcattactctacgccgaga

SEQ ID NO: 9007 - DNA, 20 bp, Artificial Sequence
  sgRNA
  Adam2_5
tgaacacgtgatctaccaag

SEQ ID NO: 9008 - DNA, 20 bp, Artificial Sequence
  sgRNA
  Adam2_6
atgaccttggggatattcca

SEQ ID NO: 9009 - DNA, 20 bp, Artificial Sequence
  sgRNA
  Adam2_7
ataggtagcgccaacataat

SEQ ID NO: 9010 - DNA, 20 bp, Artificial Sequence
  sgRNA
  Adam2_8
aaaccactggaagattccag

SEQ ID NO: 9011 - DNA, 20 bp, Artificial Sequence
  sgRNA
  Adam2_9
cttgggctatgattgcaacc

SEQ ID NO: 9012 - DNA, 20 bp, Artificial Sequence
  sgRNA
  Adam2_10
gtttccctggaatatcccca

SEQ ID NO: 9013 - DNA, 20 bp, Artificial Sequence
  sgRNA
  Adam2_11
ccactatcaatgctcccgcc

SEQ ID NO: 9014 - DNA, 20 bp, Artificial Sequence
  sgRNA
  Adam2_12
cctacaatctcaaaatcgaa

SEQ ID NO: 9015 - DNA, 20 bp, Artificial Sequence
  sgRNA
  Adam2_13
gatgtcacagagtactgcaa

SEQ ID NO: 9016 - DNA, 20 bp, Artificial Sequence
  sgRNA
  Adam2_14
acagccatcttacaagatgg

SEQ ID NO: 9017 - DNA, 20 bp, Artificial Sequence
  sgRNA
  Adam2_15
ggagctgtggaatctctgct

SEQ ID NO: 9018 - DNA, 20 bp, Artificial Sequence
  sgRNA
  Adam2_16
atccggtccgtcacaagcaa

SEQ ID NO: 9019 - DNA, 20 bp, Artificial Sequence
  sgRNA
  Adam2_17
ggccttcagtaactgcagca

SEQ ID NO: 9020 - DNA, 20 bp, Artificial Sequence
  sgRNA
  Adam2_18
catacgctagccccatgctg

SEQ ID NO: 9021 - DNA, 20 bp, Artificial Sequence
  sgRNA
  Adam2_19
tatattggcataaataacag

SEQ ID NO: 9022 - DNA, 20 bp, Artificial Sequence
  sgRNA
  Adam2_20
ggagccatctgacagcttac

SEQ ID NO: 9023 - DNA, 20 bp, Artificial Sequence
  sgRNA
  Adam20_1
taccaacataggctaaacca

SEQ ID NO: 9024 - DNA, 20 bp, Artificial Sequence
  sgRNA
  Adam20_2
aaaaccactatgaggaatgg

SEQ ID NO: 9025 - DNA, 20 bp, Artificial Sequence
  sgRNA
  Adam20_3
aactacagttactgaactcg

SEQ ID NO: 9026 - DNA, 20 bp, Artificial Sequence
  sgRNA
  Adam20_4
tgaaggaaatcttgtgcccg

SEQ ID NO: 9027 - DNA, 20 bp, Artificial Sequence
  sgRNA
  Adam20_5
atatacctattcaaaagcca

SEQ ID NO: 9028 - DNA, 20 bp, Artificial Sequence
  sgRNA
  Adam20_6
gcctggaaagtggctttgga

SEQ ID NO: 9029 - DNA, 20 bp, Artificial Sequence
  sgRNA
  Adam20_7
gttgacagtggccctccacc

SEQ ID NO: 9030 - DNA, 20 bp, Artificial Sequence
  sgRNA
  Adam20_8
ctgactcattacttgccaca

SEQ ID NO: 9031 - DNA, 20 bp, Artificial Sequence
  sgRNA
  Adam20_9
catcactgccactgcaaccg

SEQ ID NO: 9032 - DNA, 20 bp, Artificial Sequence
  sgRNA
  Adam20_10
gggaatggagttgttgacga

SEQ ID NO: 9033 - DNA, 20 bp, Artificial Sequence
  sgRNA
  Adam20_11
tctgatgcaaaaccactatg

SEQ ID NO: 9034 - DNA, 20 bp, Artificial Sequence
  sgRNA
  Adam20_12
tgggattcctcttctccagg

SEQ ID NO: 9035 - DNA, 20 bp, Artificial Sequence
  sgRNA
  Adam20_13
cactgtttccacttccaagg

SEQ ID NO: 9036 - DNA, 20 bp, Artificial Sequence
  sgRNA
  Adam20_14
catgactcagacatcctctg

SEQ ID NO: 9037 - DNA, 20 bp, Artificial Sequence
  sgRNA
  Adam20_15
agaggaatcccagcaacata

SEQ ID NO: 9038 - DNA, 20 bp, Artificial Sequence
  sgRNA
  Adam20_16
acaggcagcgccatcattaa

SEQ ID NO: 9039 - DNA, 20 bp, Artificial Sequence
  sgRNA
  Adam20_17
gggtccaccattcctcatag

SEQ ID NO: 9040 - DNA, 20 bp, Artificial Sequence
  sgRNA
  Adam20_18
tcaactccacaattatgaga

SEQ ID NO: 9041 - DNA, 20 bp, Artificial Sequence
  sgRNA
  Adam20_19
acatcactgccactgcaacc

SEQ ID NO: 9042 - DNA, 20 bp, Artificial Sequence
  sgRNA
  Adam20_20
gtaccaggtccatatgttgc

SEQ ID NO: 9043 - DNA, 20 bp, Artificial Sequence
  sgRNA
  Adam21_1
caaaacttgtcaaaggtacg

SEQ ID NO: 9044 - DNA, 20 bp, Artificial Sequence
  sgRNA
  Adam21_2
tcaactccacaatcaagagg

SEQ ID NO: 9045 - DNA, 20 bp, Artificial Sequence
  sgRNA
  Adam21_3
tgtacaatcatccaagacca

SEQ ID NO: 9046 - DNA, 20 bp, Artificial Sequence
  sgRNA
  Adam21_4
tccgttaaactacatagcat

SEQ ID NO: 9047 - DNA, 20 bp, Artificial Sequence
  sgRNA
  Adam21_5
gtacaatcatccaagaccag

SEQ ID NO: 9048 - DNA, 20 bp, Artificial Sequence
  sgRNA
  Adam21_6
gcatatggacaacatgtcta

SEQ ID NO: 9049 - DNA, 20 bp, Artificial Sequence
  sgRNA
  Adam21_7
ccgcctttctgcctgcacag

SEQ ID NO: 9050 - DNA, 20 bp, Artificial Sequence
  sgRNA
  Adam21_8
aaagtcacataagtatccag

SEQ ID NO: 9051 - DNA, 20 bp, Artificial Sequence
  sgRNA
  Adam21_9
gatctttcctactccacagg

SEQ ID NO: 9052 - DNA, 20 bp, Artificial Sequence
  sgRNA
  Adam21_10
gtggagttgaaaatttccaa

SEQ ID NO: 9053 - DNA, 20 bp, Artificial Sequence
  sgRNA
  Adam21_11
agaagacattcaccatcccc

SEQ ID NO: 9054 - DNA, 20 bp, Artificial Sequence
  sgRNA
  Adam21_12
taaccatgaccaacagtgca

SEQ ID NO: 9055 - DNA, 20 bp, Artificial Sequence
  sgRNA
  Adam21_13
gattgtacagacaagttcct

SEQ ID NO: 9056 - DNA, 20 bp, Artificial Sequence
  sgRNA
  Adam21_14
agactactgtaccaaccctt

SEQ ID NO: 9057 - DNA, 20 bp, Artificial Sequence
  sgRNA
  Adam21_15
gagtggacccagtctgtgag

SEQ ID NO: 9058 - DNA, 20 bp, Artificial Sequence
  sgRNA
  Adam21_16
tggagttgaaaatttccaag

SEQ ID NO: 9059 - DNA, 20 bp, Artificial Sequence
  sgRNA
  Adam21_17
actgtcactgtgactatggg

SEQ ID NO: 9060 - DNA, 20 bp, Artificial Sequence
  sgRNA
  Adam21_18
gcacacccatccccaaacaa

SEQ ID NO: 9061 - DNA, 20 bp, Artificial Sequence
  sgRNA
  Adam21_19
gccttcctgagacttgtaat

SEQ ID NO: 9062 - DNA, 20 bp, Artificial Sequence
  sgRNA
  Adam21_20
ttattgacctctcacagact

SEQ ID NO: 9063 - DNA, 20 bp, Artificial Sequence
  sgRNA
  Adam22_1
aactcacgaagggtaatcag

SEQ ID NO: 9064 - DNA, 20 bp, Artificial Sequence
  sgRNA
  Adam22_2
tgaataccataccagacgga

SEQ ID NO: 9065 - DNA, 20 bp, Artificial Sequence
  sgRNA
  Adam22_3
cgccgcccaagcgatagatg

SEQ ID NO: 9066 - DNA, 20 bp, Artificial Sequence
  sgRNA
  Adam22_4
gttcactcagtgcaatgtcg

SEQ ID NO: 9067 - DNA, 20 bp, Artificial Sequence
  sgRNA
  Adam22_5
ggacaaggcaagcttccggg

SEQ ID NO: 9068 - DNA, 20 bp, Artificial Sequence
  sgRNA
  Adam22_6
tatagcgactttcctcccgg

SEQ ID NO: 9069 - DNA, 20 bp, Artificial Sequence
  sgRNA
  Adam22_7
gtttcctcctctacattccg

SEQ ID NO: 9070 - DNA, 20 bp, Artificial Sequence
  sgRNA
  Adam22_8
ggagaacactgttattacca

SEQ ID NO: 9071 - DNA, 20 bp, Artificial Sequence
  sgRNA
  Adam22_9
agcacaaccagctcgacacg

SEQ ID NO: 9072 - DNA, 20 bp, Artificial Sequence
  sgRNA
  Adam22_10
atttgagagtagccggagcg

SEQ ID NO: 9073 - DNA, 20 bp, Artificial Sequence
  sgRNA
  Adam22_11
gagtttgtgctgcctccggg

SEQ ID NO: 9074 - DNA, 20 bp, Artificial Sequence
  sgRNA
  Adam22_12
gtgggctagtgactgagcga

SEQ ID NO: 9075 - DNA, 20 bp, Artificial Sequence
  sgRNA
  Adam22_13
acaacactctgccccttcaa

SEQ ID NO: 9076 - DNA, 20 bp, Artificial Sequence
  sgRNA
  Adam22_14
catctatcgcttgggcggcg

SEQ ID NO: 9077 - DNA, 20 bp, Artificial Sequence
  sgRNA
  Adam22_15
gttccaagcacatcatctga

SEQ ID NO: 9078 - DNA, 20 bp, Artificial Sequence
  sgRNA
  Adam22_16
caggacgtcgagaacgaaag

SEQ ID NO: 9079 - DNA, 20 bp, Artificial Sequence
  sgRNA
  Adam22_17
gcacaaccagctcgacacgc

SEQ ID NO: 9080 - DNA, 20 bp, Artificial Sequence
  sgRNA
  Adam22_18
atgcctccgcttccagacga

SEQ ID NO: 9081 - DNA, 20 bp, Artificial Sequence
  sgRNA
  Adam22_19
ctgcgcctcatctatcgctt

SEQ ID NO: 9082 - DNA, 20 bp, Artificial Sequence
  sgRNA
  Adam22_20
ggatgggattgtctgggcga

SEQ ID NO: 9083 - DNA, 20 bp, Artificial Sequence
  sgRNA
  Adam23_1
cgtgtgttctcgaataagag

SEQ ID NO: 9084 - DNA, 20 bp, Artificial Sequence
  sgRNA
  Adam23_2
tctgcagtttcattccagtg

SEQ ID NO: 9085 - DNA, 20 bp, Artificial Sequence
  sgRNA
  Adam23_3
tttgctatcttctgactacg

SEQ ID NO: 9086 - DNA, 20 bp, Artificial Sequence
  sgRNA
  Adam23_4
gaagtgttcgctctccaatg

SEQ ID NO: 9087 - DNA, 20 bp, Artificial Sequence
  sgRNA
  Adam23_5
gtatggtcttccaatggcgg

SEQ ID NO: 9088 - DNA, 20 bp, Artificial Sequence
  sgRNA
  Adam23_6
actggtgtattacatcaacc

SEQ ID NO: 9089 - DNA, 20 bp, Artificial Sequence
  sgRNA
  Adam23_7
ccttgaagttgaccgatacg

SEQ ID NO: 9090 - DNA, 20 bp, Artificial Sequence
  sgRNA
  Adam23_8
gaaactgcagaaaaaaccct

SEQ ID NO: 9091 - DNA, 20 bp, Artificial Sequence
  sgRNA
  Adam23_9
ctttaccccttgagtcaagt

SEQ ID NO: 9092 - DNA, 20 bp, Artificial Sequence
  sgRNA
  Adam23_10
taaagtctgctccggccacg

SEQ ID NO: 9093 - DNA, 20 bp, Artificial Sequence
  sgRNA
  Adam23_11
gcctccaaaaatcaccccca

SEQ ID NO: 9094 - DNA, 20 bp, Artificial Sequence
  sgRNA
  Adam23_12
agtgaaatcacagatgcagg

SEQ ID NO: 9095 - DNA, 20 bp, Artificial Sequence
  sgRNA
  Adam23_13
caaggaacagctcaacacca

SEQ ID NO: 9096 - DNA, 20 bp, Artificial Sequence
  sgRNA
  Adam23_14
gatctaagcacatcatggag

SEQ ID NO: 9097 - DNA, 20 bp, Artificial Sequence
  sgRNA
  Adam23_15
tggtatgcgcgtgagaagag

SEQ ID NO: 9098 - DNA, 20 bp, Artificial Sequence
  sgRNA
  Adam23_16
tatccatttccacattccgt

SEQ ID NO: 9099 - DNA, 20 bp, Artificial Sequence
  sgRNA
  Adam23_17
ggtaaagtctgctccggcca

SEQ ID NO: 9100 - DNA, 20 bp, Artificial Sequence
  sgRNA
  Adam23_18
gcacagatggcagtgaccag

SEQ ID NO: 9101 - DNA, 20 bp, Artificial Sequence
  sgRNA
  Adam23_19
gcagcatccgggatccagtt

SEQ ID NO: 9102 - DNA, 20 bp, Artificial Sequence
  sgRNA
  Adam23_20
ttagacgatgatacagacgt

SEQ ID NO: 9103 - DNA, 20 bp, Artificial Sequence
  sgRNA
  Adam25_1
aagtcaaaaggcatcctccg

SEQ ID NO: 9104 - DNA, 20 bp, Artificial Sequence
  sgRNA
  Adam25_2
ttccaatataggctaaacca

SEQ ID NO: 9105 - DNA, 20 bp, Artificial Sequence
  sgRNA
  Adam25_3
ctatgctacgtacctgcacg

SEQ ID NO: 9106 - DNA, 20 bp, Artificial Sequence
  sgRNA
  Adam25_4
ggttcagaagatggacagtg

SEQ ID NO: 9107 - DNA, 20 bp, Artificial Sequence
  sgRNA
  Adam25_5
ttaatggctccagcagacaa

SEQ ID NO: 9108 - DNA, 20 bp, Artificial Sequence
  sgRNA
  Adam25_6
aggcacagtttgccgacaag

SEQ ID NO: 9109 - DNA, 20 bp, Artificial Sequence
  sgRNA
  Adam25_7
ccatctttgagggtgcagct

SEQ ID NO: 9110 - DNA, 20 bp, Artificial Sequence
  sgRNA
  Adam25_8
ggtcccacccaaggttgcag

SEQ ID NO: 9111 - DNA, 20 bp, Artificial Sequence
  sgRNA
  Adam25_9
ctgtagttattcttactact

SEQ ID NO: 9112 - DNA, 20 bp, Artificial Sequence
  sgRNA
  Adam25_10
tgtgtgccatctcataactg

SEQ ID NO: 9113 - DNA, 20 bp, Artificial Sequence
  sgRNA
  Adam25_11
gatgggtcataatctgggta

SEQ ID NO: 9114 - DNA, 20 bp, Artificial Sequence
  sgRNA
  Adam25_12
gtgcagctgggcttacagca

SEQ ID NO: 9115 - DNA, 20 bp, Artificial Sequence
  sgRNA
  Adam25_13
cctaagacatgcaacatgaa

SEQ ID NO: 9116 - DNA, 20 bp, Artificial Sequence
  sgRNA
  Adam25_14
ggagttgatcgtctgttagg

SEQ ID NO: 9117 - DNA, 20 bp, Artificial Sequence
  sgRNA
  Adam25_15
acccaaggttgcagtggcag

SEQ ID NO: 9118 - DNA, 20 bp, Artificial Sequence
  sgRNA
  Adam25_16
tctgtcagtgcacatctcat

SEQ ID NO: 9119 - DNA, 20 bp, Artificial Sequence
  sgRNA
  Adam25_17
cgtattatagcacatgagat

SEQ ID NO: 9120 - DNA, 20 bp, Artificial Sequence
  sgRNA
  Adam25_18
ctgccactgcaaccttgggt

SEQ ID NO: 9121 - DNA, 20 bp, Artificial Sequence
  sgRNA
  Adam25_19
cacgttcaacaaccaatgcc

SEQ ID NO: 9122 - DNA, 20 bp, Artificial Sequence
  sgRNA
  Adam25_20
tcaactccacagttatgaga

SEQ ID NO: 9123 - DNA, 20 bp, Artificial Sequence
  sgRNA
  Adam28_1
cacctgtcaaggactacggt

SEQ ID NO: 9124 - DNA, 20 bp, Artificial Sequence
  sgRNA
  Adam28_2
cctacgcacaatcaacctgg

SEQ ID NO: 9125 - DNA, 20 bp, Artificial Sequence
  sgRNA
  Adam28_3
tcatacatacgagattagct

SEQ ID NO: 9126 - DNA, 20 bp, Artificial Sequence
  sgRNA
  Adam28_4
gatggccaattacatcaaca

SEQ ID NO: 9127 - DNA, 20 bp, Artificial Sequence
  sgRNA
  Adam28_5
ccactccaactaaggccacg

SEQ ID NO: 9128 - DNA, 20 bp, Artificial Sequence
  sgRNA
  Adam28_6
gctgctctgcacacaacccc

SEQ ID NO: 9129 - DNA, 20 bp, Artificial Sequence
  sgRNA
  Adam28_7
tccaagttctccgagctcaa

SEQ ID NO: 9130 - DNA, 20 bp, Artificial Sequence
  sgRNA
  Adam28_8
tttctcacagcattccccca

SEQ ID NO: 9131 - DNA, 20 bp, Artificial Sequence
  sgRNA
  Adam28_9
atgatgcgctatggctccaa

SEQ ID NO: 9132 - DNA, 20 bp, Artificial Sequence
  sgRNA
  Adam28_10
ccacaaatatgactgctagg

SEQ ID NO: 9133 - DNA, 20 bp, Artificial Sequence
  sgRNA
  Adam28_11
gatctgcctgaagtgtgtga

SEQ ID NO: 9134 - DNA, 20 bp, Artificial Sequence
  sgRNA
  Adam28_12
gttacaagcagaatgaaggt

SEQ ID NO: 9135 - DNA, 20 bp, Artificial Sequence
  sgRNA
  Adam28_13
ggaaaacttctctaagtgga

SEQ ID NO: 9136 - DNA, 20 bp, Artificial Sequence
  sgRNA
  Adam28_14
tcatatccaccccagtctgt

SEQ ID NO: 9137 - DNA, 20 bp, Artificial Sequence
  sgRNA
  Adam28_15
cagagggcagatcagacaca

SEQ ID NO: 9138 - DNA, 20 bp, Artificial Sequence
  sgRNA
  Adam28_16
gagtggaaatctggaccgat

SEQ ID NO: 9139 - DNA, 20 bp, Artificial Sequence
  sgRNA
  Adam28_17
atttctcacagcattccccc

SEQ ID NO: 9140 - DNA, 20 bp, Artificial Sequence
  sgRNA
  Adam28_18
ttggggactccaactctcat

SEQ ID NO: 9141 - DNA, 20 bp, Artificial Sequence
  sgRNA
  Adam28_19
tcagcacctgtcaaggacta

SEQ ID NO: 9142 - DNA, 20 bp, Artificial Sequence
  sgRNA
  Adam28_20
cctgaacaatgccaacagaa

SEQ ID NO: 9143 - DNA, 20 bp, Artificial Sequence
  sgRNA
  Adam29_1
aattgttgaattagtagtgg

SEQ ID NO: 9144 - DNA, 20 bp, Artificial Sequence
  sgRNA
  Adam29_2
aagtggcataggttccactg

SEQ ID NO: 9145 - DNA, 20 bp, Artificial Sequence
  sgRNA
  Adam29_3
tgcagtttgacatgcaacaa

SEQ ID NO: 9146 - DNA, 20 bp, Artificial Sequence
  sgRNA
  Adam29_4
agtcaccctccacataacct

SEQ ID NO: 9147 - DNA, 20 bp, Artificial Sequence
  sgRNA
  Adam29_5
cctctaatcatacagttagg

SEQ ID NO: 9148 - DNA, 20 bp, Artificial Sequence
  sgRNA
  Adam29_6
tggatcacaaatccccccag

SEQ ID NO: 9149 - DNA, 20 bp, Artificial Sequence
  sgRNA
  Adam29_7
gatcccagtggaagttgcag

SEQ ID NO: 9150 - DNA, 20 bp, Artificial Sequence
  sgRNA
  Adam29_8
gcaataggctgagaccccac

SEQ ID NO: 9151 - DNA, 20 bp, Artificial Sequence
  sgRNA
  Adam29_9
caataggctgagaccccaca

SEQ ID NO: 9152 - DNA, 20 bp, Artificial Sequence
  sgRNA
  Adam29_10
gcagcaaagtccaaaggcac

SEQ ID NO: 9153 - DNA, 20 bp, Artificial Sequence
  sgRNA
  Adam29_11
gtagaagatggaattccctg

SEQ ID NO: 9154 - DNA, 20 bp, Artificial Sequence
  sgRNA
  Adam29_12
cctgcattctgtaattacag

SEQ ID NO: 9155 - DNA, 20 bp, Artificial Sequence
  sgRNA
  Adam29_13
gttggtgaagcagatcgtga

SEQ ID NO: 9156 - DNA, 20 bp, Artificial Sequence
  sgRNA
  Adam29_14
gcctccaaaacaggaactga

SEQ ID NO: 9157 - DNA, 20 bp, Artificial Sequence
  sgRNA
  Adam29_15
ctgccactgcaacttccact

SEQ ID NO: 9158 - DNA, 20 bp, Artificial Sequence
  sgRNA
  Adam29_16
tcttaattgaggtagactcg

SEQ ID NO: 9159 - DNA, 20 bp, Artificial Sequence
  sgRNA
  Adam29_17
tagaagatggaattccctgt

SEQ ID NO: 9160 - DNA, 20 bp, Artificial Sequence
  sgRNA
  Adam29_18
tgctgaatttgggtatcggt

SEQ ID NO: 9161 - DNA, 20 bp, Artificial Sequence
  sgRNA
  Adam29_19
agcatcatctggacattcat

SEQ ID NO: 9162 - DNA, 20 bp, Artificial Sequence
  sgRNA
  Adam29_20
ctaccacagttccatagaag

SEQ ID NO: 9163 - DNA, 20 bp, Artificial Sequence
  sgRNA
  Adam30_1
cgtggtgtatctcgtaactg

SEQ ID NO: 9164 - DNA, 20 bp, Artificial Sequence
  sgRNA
  Adam30_2
ccagaccagtgtaattacgt

SEQ ID NO: 9165 - DNA, 20 bp, Artificial Sequence
  sgRNA
  Adam30_3
caaagctacatatcgtagag

SEQ ID NO: 9166 - DNA, 20 bp, Artificial Sequence
  sgRNA
  Adam30_4
aaagaaactcaatgcatcac

SEQ ID NO: 9167 - DNA, 20 bp, Artificial Sequence
  sgRNA
  Adam30_5
cctgacaagtgcaatagccg

SEQ ID NO: 9168 - DNA, 20 bp, Artificial Sequence
  sgRNA
  Adam30_6
gcatcgtcagaaacagccag

SEQ ID NO: 9169 - DNA, 20 bp, Artificial Sequence
  sgRNA
  Adam30_7
atataaatggaaccagtccg

SEQ ID NO: 9170 - DNA, 20 bp, Artificial Sequence
  sgRNA
  Adam30_8
tcatggggacaggacgtaca

SEQ ID NO: 9171 - DNA, 20 bp, Artificial Sequence
  sgRNA
  Adam30_9
gtacctcctgtggtcgtaat

SEQ ID NO: 9172 - DNA, 20 bp, Artificial Sequence
  sgRNA
  Adam30_10
ggaactccatgcagaaacgg

SEQ ID NO: 9173 - DNA, 20 bp, Artificial Sequence
  sgRNA
  Adam30_11
ccatcctagacatattgcca

SEQ ID NO: 9174 - DNA, 20 bp, Artificial Sequence
  sgRNA
  Adam30_12
aatgcatcaccggcttcccg

SEQ ID NO: 9175 - DNA, 20 bp, Artificial Sequence
  sgRNA
  Adam30_13
cctatgtcaggtaccccatg

SEQ ID NO: 9176 - DNA, 20 bp, Artificial Sequence
  sgRNA
  Adam30_14
tatactgtccacttatctga

SEQ ID NO: 9177 - DNA, 20 bp, Artificial Sequence
  sgRNA
  Adam30_15
ctaccaaatcgagcccctca

SEQ ID NO: 9178 - DNA, 20 bp, Artificial Sequence
  sgRNA
  Adam30_16
tttatgacagcaaagcccag

SEQ ID NO: 9179 - DNA, 20 bp, Artificial Sequence
  sgRNA
  Adam30_17
tcatacctcttacagataga

SEQ ID NO: 9180 - DNA, 20 bp, Artificial Sequence
  sgRNA
  Adam30_18
atactgtccacttatctgag

SEQ ID NO: 9181 - DNA, 20 bp, Artificial Sequence
  sgRNA
  Adam30_19
tgttcactgcttcgtaacac

SEQ ID NO: 9182 - DNA, 20 bp, Artificial Sequence
  sgRNA
  Adam30_20
atgcgtgtaaaaaatactga

SEQ ID NO: 9183 - DNA, 20 bp, Artificial Sequence
  sgRNA
  Adam32_1
atctgaccacaactccaatg

SEQ ID NO: 9184 - DNA, 20 bp, Artificial Sequence
  sgRNA
  Adam32_2
aacgagtacccaaattacat

SEQ ID NO: 9185 - DNA, 20 bp, Artificial Sequence
  sgRNA
  Adam32_3
ctatctagagatgagtattg

SEQ ID NO: 9186 - DNA, 20 bp, Artificial Sequence
  sgRNA
  Adam32_4
ggaagaacttacatcgccct

SEQ ID NO: 9187 - DNA, 20 bp, Artificial Sequence
  sgRNA
  Adam32_5
gcctgctatgaagaaatcca

SEQ ID NO: 9188 - DNA, 20 bp, Artificial Sequence
  sgRNA
  Adam32_6
gcacttacacgtatgtcagc

SEQ ID NO: 9189 - DNA, 20 bp, Artificial Sequence
  sgRNA
  Adam32_7
ctatgaggaacactgaagcg

SEQ ID NO: 9190 - DNA, 20 bp, Artificial Sequence
  sgRNA
  Adam32_8
tggaaaggcttgaaacagtg

SEQ ID NO: 9191 - DNA, 20 bp, Artificial Sequence
  sgRNA
  Adam32_9
agaaaaacatcaatgtaggc

SEQ ID NO: 9192 - DNA, 20 bp, Artificial Sequence
  sgRNA
  Adam32_10
acatgggagcaacgtatcct

SEQ ID NO: 9193 - DNA, 20 bp, Artificial Sequence
  sgRNA
  Adam32_11
gtaccccaaggatatgacct

SEQ ID NO: 9194 - DNA, 20 bp, Artificial Sequence
  sgRNA
  Adam32_12
tcatctgcttcaccaactgt

SEQ ID NO: 9195 - DNA, 20 bp, Artificial Sequence
  sgRNA
  Adam32_13
gatgcaaaggactgcagcag

SEQ ID NO: 9196 - DNA, 20 bp, Artificial Sequence
  sgRNA
  Adam32_14
gtcaatatcctacgacaaaa

SEQ ID NO: 9197 - DNA, 20 bp, Artificial Sequence
  sgRNA
  Adam32_15
ttaggttcacaacagctatc

SEQ ID NO: 9198 - DNA, 20 bp, Artificial Sequence
  sgRNA
  Adam32_16
tcatccaagtgccacgggaa

SEQ ID NO: 9199 - DNA, 20 bp, Artificial Sequence
  sgRNA
  Adam32_17
tcagtgttcctcataggcac

SEQ ID NO: 9200 - DNA, 20 bp, Artificial Sequence
  sgRNA
  Adam32_18
caggtgagttcattaaaaga

SEQ ID NO: 9201 - DNA, 20 bp, Artificial Sequence
  sgRNA
  Adam32_19
ttgtttatagttacatcagg

SEQ ID NO: 9202 - DNA, 20 bp, Artificial Sequence
  sgRNA
  Adam32_20
atactcatctctagatagag

SEQ ID NO: 9203 - DNA, 20 bp, Artificial Sequence
  sgRNA
  Adam33_1
acctcgcacagcaatcaccg

SEQ ID NO: 9204 - DNA, 20 bp, Artificial Sequence
  sgRNA
  Adam33_2
ggtcgcggctattgcctaga

SEQ ID NO: 9205 - DNA, 20 bp, Artificial Sequence
  sgRNA
  Adam33_3
tgtggagggcatatgccgcg

SEQ ID NO: 9206 - DNA, 20 bp, Artificial Sequence
  sgRNA
  Adam33_4
gccaattgcgtggaccaggt

SEQ ID NO: 9207 - DNA, 20 bp, Artificial Sequence
  sgRNA
  Adam33_5
ccagtaggtaaacatctgcg

SEQ ID NO: 9208 - DNA, 20 bp, Artificial Sequence
  sgRNA
  Adam33_6
tttcctacagtggcgccgcg

SEQ ID NO: 9209 - DNA, 20 bp, Artificial Sequence
  sgRNA
  Adam33_7
aacccacgagatcttccgga

SEQ ID NO: 9210 - DNA, 20 bp, Artificial Sequence
  sgRNA
  Adam33_8
ctccatccggaagatctcgt

SEQ ID NO: 9211 - DNA, 20 bp, Artificial Sequence
  sgRNA
  Adam33_9
actaagatgccctcttcgat

SEQ ID NO: 9212 - DNA, 20 bp, Artificial Sequence
  sgRNA
  Adam33_10
aggacgacaaggcgtgcccg

SEQ ID NO: 9213 - DNA, 20 bp, Artificial Sequence
  sgRNA
  Adam33_11
ctgcaggcgctgaagacgcg

SEQ ID NO: 9214 - DNA, 20 bp, Artificial Sequence
  sgRNA
  Adam33_12
ccgcgaagtggtttgccgag

SEQ ID NO: 9215 - DNA, 20 bp, Artificial Sequence
  sgRNA
  Adam33_13
gctgcgaaggtcaaatccaa

SEQ ID NO: 9216 - DNA, 20 bp, Artificial Sequence
  sgRNA
  Adam33_14
cctggaggttgccaattgcg

SEQ ID NO: 9217 - DNA, 20 bp, Artificial Sequence
  sgRNA
  Adam33_15
acattgagcccccgcacgca

SEQ ID NO: 9218 - DNA, 20 bp, Artificial Sequence
  sgRNA
  Adam33_16
tctccaacacctcggcgccg

SEQ ID NO: 9219 - DNA, 20 bp, Artificial Sequence
  sgRNA
  Adam33_17
ccaagaagccgtttccgcag

SEQ ID NO: 9220 - DNA, 20 bp, Artificial Sequence
  sgRNA
  Adam33_18
gatgcgactgagatcctgct

SEQ ID NO: 9221 - DNA, 20 bp, Artificial Sequence
  sgRNA
  Adam33_19
tgactgcctgccataacggt

SEQ ID NO: 9222 - DNA, 20 bp, Artificial Sequence
  sgRNA
  Adam33_20
gtacctggaactgtacatag

SEQ ID NO: 9223 - DNA, 20 bp, Artificial Sequence
  sgRNA
  Adam39_1
caaatattgccagatcatgg

SEQ ID NO: 9224 - DNA, 20 bp, Artificial Sequence
  sgRNA
  Adam39_2
aagtcaataggcatcctccg

SEQ ID NO: 9225 - DNA, 20 bp, Artificial Sequence
  sgRNA
  Adam39_3
aatgaaaaaaaccacgtgca

SEQ ID NO: 9226 - DNA, 20 bp, Artificial Sequence
  sgRNA
  Adam39_4
ctccaacataggccacacca

SEQ ID NO: 9227 - DNA, 20 bp, Artificial Sequence
  sgRNA
  Adam39_5
aggcacagtttgccgaaaaa

SEQ ID NO: 9228 - DNA, 20 bp, Artificial Sequence
  sgRNA
  Adam39_6
ttatgttacgtccctgcacg

SEQ ID NO: 9229 - DNA, 20 bp, Artificial Sequence
  sgRNA
  Adam39_7
tattcaatatctctagccag

SEQ ID NO: 9230 - DNA, 20 bp, Artificial Sequence
  sgRNA
  Adam39_8
cctttcatgctgcatgtagt

SEQ ID NO: 9231 - DNA, 20 bp, Artificial Sequence
  sgRNA
  Adam39_9
ttaatggctccagcagataa

SEQ ID NO: 9232 - DNA, 20 bp, Artificial Sequence
  sgRNA
  Adam39_10
ggagttgattgtctgttagg

SEQ ID NO: 9233 - DNA, 20 bp, Artificial Sequence
  sgRNA
  Adam39_11
gtgcagctgcgcttacaaca

SEQ ID NO: 9234 - DNA, 20 bp, Artificial Sequence
  sgRNA
  Adam39_12
tcaactccacagttataaga

SEQ ID NO: 9235 - DNA, 20 bp, Artificial Sequence
  sgRNA
  Adam39_13
tgtttgccatcttataactg

SEQ ID NO: 9236 - DNA, 20 bp, Artificial Sequence
  sgRNA
  Adam39_14
cccactacatgcagcatgaa

SEQ ID NO: 9237 - DNA, 20 bp, Artificial Sequence
  sgRNA
  Adam39_15
ttgtgcatacacttggcagt

SEQ ID NO: 9238 - DNA, 20 bp, Artificial Sequence
  sgRNA
  Adam39_16
tctagccagaggtacagatg

SEQ ID NO: 9239 - DNA, 20 bp, Artificial Sequence
  sgRNA
  Adam39_17
ttcgagataccattatctgc

SEQ ID NO: 9240 - DNA, 20 bp, Artificial Sequence
  sgRNA
  Adam39_18
acaccactgccactgcaacc

SEQ ID NO: 9241 - DNA, 20 bp, Artificial Sequence
  sgRNA
  Adam39_19
tccaatcacaaaattcaact

SEQ ID NO: 9242 - DNA, 20 bp, Artificial Sequence
  sgRNA
  Adam39_20
caccactgccactgcaaccg

SEQ ID NO: 9243 - DNA, 20 bp, Artificial Sequence
  sgRNA
  Adam7_1
agctaagaaaacgaatttgg

SEQ ID NO: 9244 - DNA, 20 bp, Artificial Sequence
  sgRNA
  Adam7_2
gggttgttgagtatgcatgc

SEQ ID NO: 9245 - DNA, 20 bp, Artificial Sequence
  sgRNA
  Adam7_3
taacaacactgcatgaacga

SEQ ID NO: 9246 - DNA, 20 bp, Artificial Sequence
  sgRNA
  Adam7_4
ctaccaatcactcctgcgtg

SEQ ID NO: 9247 - DNA, 20 bp, Artificial Sequence
  sgRNA
  Adam7_5
attcctgcaaggaaacccgt

SEQ ID NO: 9248 - DNA, 20 bp, Artificial Sequence
  sgRNA
  Adam7_6
ctctcctcgagaaatacggg

SEQ ID NO: 9249 - DNA, 20 bp, Artificial Sequence
  sgRNA
  Adam7_7
catttgtgtgcgtcacagca

SEQ ID NO: 9250 - DNA, 20 bp, Artificial Sequence
  sgRNA
  Adam7_8
ttattgatccttcctcacac

SEQ ID NO: 9251 - DNA, 20 bp, Artificial Sequence
  sgRNA
  Adam7_9
ggatggatatcggtcaagat

SEQ ID NO: 9252 - DNA, 20 bp, Artificial Sequence
  sgRNA
  Adam7_10
agctctcctcgagaaatacg

SEQ ID NO: 9253 - DNA, 20 bp, Artificial Sequence
  sgRNA
  Adam7_11
gggaagatatactgctcggg

SEQ ID NO: 9254 - DNA, 20 bp, Artificial Sequence
  sgRNA
  Adam7_12
agtaaaattgagccccacgc

SEQ ID NO: 9255 - DNA, 20 bp, Artificial Sequence
  sgRNA
  Adam7_13
ttgaacctggatacccaaag

SEQ ID NO: 9256 - DNA, 20 bp, Artificial Sequence
  sgRNA
  Adam7_14
ttatggggctgtgtcccacc

SEQ ID NO: 9257 - DNA, 20 bp, Artificial Sequence
  sgRNA
  Adam7_15
gagcactgctcattccgggt

SEQ ID NO: 9258 - DNA, 20 bp, Artificial Sequence
  sgRNA
  Adam7_16
gggaaatgtgtgatgggcga

SEQ ID NO: 9259 - DNA, 20 bp, Artificial Sequence
  sgRNA
  Adam7_17
tcttcagggtgaatgaccag

SEQ ID NO: 9260 - DNA, 20 bp, Artificial Sequence
  sgRNA
  Adam7_18
aagacgagttccaagccaac

SEQ ID NO: 9261 - DNA, 20 bp, Artificial Sequence
  sgRNA
  Adam7_19
gctctcctcgagaaatacgg

SEQ ID NO: 9262 - DNA, 20 bp, Artificial Sequence
  sgRNA
  Adam7_20
tgctaccaatcactcctgcg

SEQ ID NO: 9263 - DNA, 20 bp, Artificial Sequence
  sgRNA
  Adam8_1
gatgctactgtcctgaacca

SEQ ID NO: 9264 - DNA, 20 bp, Artificial Sequence
  sgRNA
  Adam8_2
ataccaacctgaatgaccta

SEQ ID NO: 9265 - DNA, 20 bp, Artificial Sequence
  sgRNA
  Adam8_3
tgctaaatgcaacaaccatg

SEQ ID NO: 9266 - DNA, 20 bp, Artificial Sequence
  sgRNA
  Adam8_4
tcctcccattgcagcccgga

SEQ ID NO: 9267 - DNA, 20 bp, Artificial Sequence
  sgRNA
  Adam8_5
ggtggctgcgatggtcatcg

SEQ ID NO: 9268 - DNA, 20 bp, Artificial Sequence
  sgRNA
  Adam8_6
tgtggagcgctgtactgtga

SEQ ID NO: 9269 - DNA, 20 bp, Artificial Sequence
  sgRNA
  Adam8_7
agttccccaggatattcagc

SEQ ID NO: 9270 - DNA, 20 bp, Artificial Sequence
  sgRNA
  Adam8_8
ggccatgtggaagggtacga

SEQ ID NO: 9271 - DNA, 20 bp, Artificial Sequence
  sgRNA
  Adam8_9
ggtttcactatgggtcttgg

SEQ ID NO: 9272 - DNA, 20 bp, Artificial Sequence
  sgRNA
  Adam8_10
caccacccaactgtgtacag

SEQ ID NO: 9273 - DNA, 20 bp, Artificial Sequence
  sgRNA
  Adam8_11
cattggtgtagcctccacca

SEQ ID NO: 9274 - DNA, 20 bp, Artificial Sequence
  sgRNA
  Adam8_12
gctaaaggtatagcaggagt

SEQ ID NO: 9275 - DNA, 20 bp, Artificial Sequence
  sgRNA
  Adam8_13
gcagcctgccagctaagaac

SEQ ID NO: 9276 - DNA, 20 bp, Artificial Sequence
  sgRNA
  Adam8_14
ctctggatgctgatgaagag

SEQ ID NO: 9277 - DNA, 20 bp, Artificial Sequence
  sgRNA
  Adam8_15
caaccccctattctacacaa

SEQ ID NO: 9278 - DNA, 20 bp, Artificial Sequence
  sgRNA
  Adam8_16
tggaggagttctgtgatggc

SEQ ID NO: 9279 - DNA, 20 bp, Artificial Sequence
  sgRNA
  Adam8_17
cggttgatcctgcagacaga

SEQ ID NO: 9280 - DNA, 20 bp, Artificial Sequence
  sgRNA
  Adam8_18
ctacacctgctgaatatcct

SEQ ID NO: 9281 - DNA, 20 bp, Artificial Sequence
  sgRNA
  Adam8_19
ccacatacaactccacatag

SEQ ID NO: 9282 - DNA, 20 bp, Artificial Sequence
  sgRNA
  Adam8_20
atcctcccattgcagcccgg

SEQ ID NO: 9283 - DNA, 20 bp, Artificial Sequence
  sgRNA
  Adam9_1
ccacgcaggtgggatcaatg

SEQ ID NO: 9284 - DNA, 20 bp, Artificial Sequence
  sgRNA
  Adam9_2
gattcgcttagcaaactacc

SEQ ID NO: 9285 - DNA, 20 bp, Artificial Sequence
  sgRNA
  Adam9_3
accagcttattaccacagga

SEQ ID NO: 9286 - DNA, 20 bp, Artificial Sequence
  sgRNA
  Adam9_4
gtttacacctacgacaagga

SEQ ID NO: 9287 - DNA, 20 bp, Artificial Sequence
  sgRNA
  Adam9_5
agtcgaggcaccaaatgctg

SEQ ID NO: 9288 - DNA, 20 bp, Artificial Sequence
  sgRNA
  Adam9_6
cctggtggatgccatccatg

SEQ ID NO: 9289 - DNA, 20 bp, Artificial Sequence
  sgRNA
  Adam9_7
gttccgacgttccagaccca

SEQ ID NO: 9290 - DNA, 20 bp, Artificial Sequence
  sgRNA
  Adam9_8
tctaccacagacccgctatg

SEQ ID NO: 9291 - DNA, 20 bp, Artificial Sequence
  sgRNA
  Adam9_9
cctaatcgtcccccttgttg

SEQ ID NO: 9292 - DNA, 20 bp, Artificial Sequence
  sgRNA
  Adam9_10
ttgcctctctgcgactaagg

SEQ ID NO: 9293 - DNA, 20 bp, Artificial Sequence
  sgRNA
  Adam9_11
gctcctccaattatattgat

SEQ ID NO: 9294 - DNA, 20 bp, Artificial Sequence
  sgRNA
  Adam9_12
ctagtatctccagaccacca

SEQ ID NO: 9295 - DNA, 20 bp, Artificial Sequence
  sgRNA
  Adam9_13
gctggtactattccaaacac

SEQ ID NO: 9296 - DNA, 20 bp, Artificial Sequence
  sgRNA
  Adam9_14
ccttagtcgcagagaggcaa

SEQ ID NO: 9297 - DNA, 20 bp, Artificial Sequence
  sgRNA
  Adam9_15
aagttaacgttgaataaggg

SEQ ID NO: 9298 - DNA, 20 bp, Artificial Sequence
  sgRNA
  Adam9_16
ggagggagtgcagaattccg

SEQ ID NO: 9299 - DNA, 20 bp, Artificial Sequence
  sgRNA
  Adam9_17
gtatgttcaaggagccacgc

SEQ ID NO: 9300 - DNA, 20 bp, Artificial Sequence
  sgRNA
  Adam9_18
aagtgtgagctgttgtgcag

SEQ ID NO: 9301 - DNA, 20 bp, Artificial Sequence
  sgRNA
  Adam9_19
cagccaccttagtcgcagag

SEQ ID NO: 9302 - DNA, 20 bp, Artificial Sequence
  sgRNA
  Adam9_20
ttatcaagagagatgaacta

SEQ ID NO: 9303 - DNA, 20 bp, Artificial Sequence
  sgRNA
  Adcy2_1
cggggcaccatacctcacgt

SEQ ID NO: 9304 - DNA, 20 bp, Artificial Sequence
  sgRNA
  Adcy2_2
catggttagtatgatagctg

SEQ ID NO: 9305 - DNA, 20 bp, Artificial Sequence
  sgRNA
  Adcy2_3
gaatgggaagattagcacca

SEQ ID NO: 9306 - DNA, 20 bp, Artificial Sequence
  sgRNA
  Adcy2_4
cactctggagcacttgaatg

SEQ ID NO: 9307 - DNA, 20 bp, Artificial Sequence
  sgRNA
  Adcy2_5
gtcgatatcaacatgcgcgt

SEQ ID NO: 9308 - DNA, 20 bp, Artificial Sequence
  sgRNA
  Adcy2_6
ggtcgatatcaacatgcgcg

SEQ ID NO: 9309 - DNA, 20 bp, Artificial Sequence
  sgRNA
  Adcy2_7
gcaattacatgtgtcccgat

SEQ ID NO: 9310 - DNA, 20 bp, Artificial Sequence
  sgRNA
  Adcy2_8
agctgtggtgacgatcgtga

SEQ ID NO: 9311 - DNA, 20 bp, Artificial Sequence
  sgRNA
  Adcy2_9
gggtacagcactcagacccg

SEQ ID NO: 9312 - DNA, 20 bp, Artificial Sequence
  sgRNA
  Adcy2_10
gcagcaggaagacgatgaga

SEQ ID NO: 9313 - DNA, 20 bp, Artificial Sequence
  sgRNA
  Adcy2_11
gcatgtggaccagttcacca

SEQ ID NO: 9314 - DNA, 20 bp, Artificial Sequence
  sgRNA
  Adcy2_12
ggcgtatgcaaactccacca

SEQ ID NO: 9315 - DNA, 20 bp, Artificial Sequence
  sgRNA
  Adcy2_13
acactgtcaacgtcgctagt

SEQ ID NO: 9316 - DNA, 20 bp, Artificial Sequence
  sgRNA
  Adcy2_14
catgacacagacacaatcgt

SEQ ID NO: 9317 - DNA, 20 bp, Artificial Sequence
  sgRNA
  Adcy2_15
gcgggaggagatcgaaacca

SEQ ID NO: 9318 - DNA, 20 bp, Artificial Sequence
  sgRNA
  Adcy2_16
aacgacttcaaacttcgagt

SEQ ID NO: 9319 - DNA, 20 bp, Artificial Sequence
  sgRNA
  Adcy2_17
agacctcgacacactctgga

SEQ ID NO: 9320 - DNA, 20 bp, Artificial Sequence
  sgRNA
  Adcy2_18
gcacatgaacaggtatccca

SEQ ID NO: 9321 - DNA, 20 bp, Artificial Sequence
  sgRNA
  Adcy2_19
tgtcctggatgcatacagcc

SEQ ID NO: 9322 - DNA, 20 bp, Artificial Sequence
  sgRNA
  Adcy2_20
gctgcctgctcacattgcca

SEQ ID NO: 9323 - DNA, 20 bp, Artificial Sequence
  sgRNA
  Adcy3_1
tgcccacgatgatagcacac

SEQ ID NO: 9324 - DNA, 20 bp, Artificial Sequence
  sgRNA
  Adcy3_2
ctacgtggtagtgatgtgcg

SEQ ID NO: 9325 - DNA, 20 bp, Artificial Sequence
  sgRNA
  Adcy3_3
actggagtggacatgcgtgt

SEQ ID NO: 9326 - DNA, 20 bp, Artificial Sequence
  sgRNA
  Adcy3_4
catacctgacattctcgtgc

SEQ ID NO: 9327 - DNA, 20 bp, Artificial Sequence
  sgRNA
  Adcy3_5
cggcttgcctgactaccggg

SEQ ID NO: 9328 - DNA, 20 bp, Artificial Sequence
  sgRNA
  Adcy3_6
ggaccgagtgagccgcaaag

SEQ ID NO: 9329 - DNA, 20 bp, Artificial Sequence
  sgRNA
  Adcy3_7
gatggaaacacgctactcgg

SEQ ID NO: 9330 - DNA, 20 bp, Artificial Sequence
  sgRNA
  Adcy3_8
gaggagagcatcaacaacgg

SEQ ID NO: 9331 - DNA, 20 bp, Artificial Sequence
  sgRNA
  Adcy3_9
gctgggatggagctggacgg

SEQ ID NO: 9332 - DNA, 20 bp, Artificial Sequence
  sgRNA
  Adcy3_10
agagatggaaacacgctact

SEQ ID NO: 9333 - DNA, 20 bp, Artificial Sequence
  sgRNA
  Adcy3_11
gatcctgaccatctgctcga

SEQ ID NO: 9334 - DNA, 20 bp, Artificial Sequence
  sgRNA
  Adcy3_12
aaggtcagccgcataaagcg

SEQ ID NO: 9335 - DNA, 20 bp, Artificial Sequence
  sgRNA
  Adcy3_13
tgttacactgccccaccaag

SEQ ID NO: 9336 - DNA, 20 bp, Artificial Sequence
  sgRNA
  Adcy3_14
acaccaggcgtacaggttga

SEQ ID NO: 9337 - DNA, 20 bp, Artificial Sequence
  sgRNA
  Adcy3_15
ggagtacttggaaggcacca

SEQ ID NO: 9338 - DNA, 20 bp, Artificial Sequence
  sgRNA
  Adcy3_16
atacggtcaatgtggccagc

SEQ ID NO: 9339 - DNA, 20 bp, Artificial Sequence
  sgRNA
  Adcy3_17
ttccatcctgcccaagcacg

SEQ ID NO: 9340 - DNA, 20 bp, Artificial Sequence
  sgRNA
  Adcy3_18
ggacccatgaaatttctgtg

SEQ ID NO: 9341 - DNA, 20 bp, Artificial Sequence
  sgRNA
  Adcy3_19
ctacctgtgtgctatcatcg

SEQ ID NO: 9342 - DNA, 20 bp, Artificial Sequence
  sgRNA
  Adcy3_20
ggcagaccgcaagcaccgca

SEQ ID NO: 9343 - DNA, 20 bp, Artificial Sequence
  sgRNA
  Adcy5_1
tttacggattaagatcctcg

SEQ ID NO: 9344 - DNA, 20 bp, Artificial Sequence
  sgRNA
  Adcy5_2
ccgctctaagaagttcccgt

SEQ ID NO: 9345 - DNA, 20 bp, Artificial Sequence
  sgRNA
  Adcy5_3
agtgcacacacccacaatgt

SEQ ID NO: 9346 - DNA, 20 bp, Artificial Sequence
  sgRNA
  Adcy5_4
gacgaagaccctccactaag

SEQ ID NO: 9347 - DNA, 20 bp, Artificial Sequence
  sgRNA
  Adcy5_5
gcttccgctctaagtccgcc

SEQ ID NO: 9348 - DNA, 20 bp, Artificial Sequence
  sgRNA
  Adcy5_6
cgcagtagtaacaatccccg

SEQ ID NO: 9349 - DNA, 20 bp, Artificial Sequence
  sgRNA
  Adcy5_7
gcgtcgaggaaaaggccgag

SEQ ID NO: 9350 - DNA, 20 bp, Artificial Sequence
  sgRNA
  Adcy5_8
ggtcctggtggaacgctgca

SEQ ID NO: 9351 - DNA, 20 bp, Artificial Sequence
  sgRNA
  Adcy5_9
gatggtgaataccccgacca

SEQ ID NO: 9352 - DNA, 20 bp, Artificial Sequence
  sgRNA
  Adcy5_10
ggtgaacgtgaacatgcgcg

SEQ ID NO: 9353 - DNA, 20 bp, Artificial Sequence
  sgRNA
  Adcy5_11
cgaccatgcccactgctgcg

SEQ ID NO: 9354 - DNA, 20 bp, Artificial Sequence
  sgRNA
  Adcy5_12
ggtcatgctggctttccacg

SEQ ID NO: 9355 - DNA, 20 bp, Artificial Sequence
  sgRNA
  Adcy5_13
ggtaggctatctggagcggg

SEQ ID NO: 9356 - DNA, 20 bp, Artificial Sequence
  sgRNA
  Adcy5_14
atgccctcggaggcgctgcg

SEQ ID NO: 9357 - DNA, 20 bp, Artificial Sequence
  sgRNA
  Adcy5_15
tgacttacttcctcaatgga

SEQ ID NO: 9358 - DNA, 20 bp, Artificial Sequence
  sgRNA
  Adcy5_16
ccgacgggaacttcttagag

SEQ ID NO: 9359 - DNA, 20 bp, Artificial Sequence
  sgRNA
  Adcy5_17
ggacacaatccgcctcactg

SEQ ID NO: 9360 - DNA, 20 bp, Artificial Sequence
  sgRNA
  Adcy5_18
gcccgggactggcatcgtcg

SEQ ID NO: 9361 - DNA, 20 bp, Artificial Sequence
  sgRNA
  Adcy5_19
gggctacgctgcacagacag

SEQ ID NO: 9362 - DNA, 20 bp, Artificial Sequence
  sgRNA
  Adcy5_20
cgtgggggtagccattggcg

SEQ ID NO: 9363 - DNA, 20 bp, Artificial Sequence
  sgRNA
  Adcy6_1
ccggatacatcgcctcggag

SEQ ID NO: 9364 - DNA, 20 bp, Artificial Sequence
  sgRNA
  Adcy6_2
ctcacgggtgcacagcaccg

SEQ ID NO: 9365 - DNA, 20 bp, Artificial Sequence
  sgRNA
  Adcy6_3
gagtaccacaaaaaggacag

SEQ ID NO: 9366 - DNA, 20 bp, Artificial Sequence
  sgRNA
  Adcy6_4
cccgaggttacatccaggcg

SEQ ID NO: 9367 - DNA, 20 bp, Artificial Sequence
  sgRNA
  Adcy6_5
tggcagctagaacctggtat

SEQ ID NO: 9368 - DNA, 20 bp, Artificial Sequence
  sgRNA
  Adcy6_6
gctaccagctggagtgtcga

SEQ ID NO: 9369 - DNA, 20 bp, Artificial Sequence
  sgRNA
  Adcy6_7
ggagctcgaggcaaacaacg

SEQ ID NO: 9370 - DNA, 20 bp, Artificial Sequence
  sgRNA
  Adcy6_8
cggaaagtagatcctcgctt

SEQ ID NO: 9371 - DNA, 20 bp, Artificial Sequence
  sgRNA
  Adcy6_9
ctagcagccgtgcaagtcgg

SEQ ID NO: 9372 - DNA, 20 bp, Artificial Sequence
  sgRNA
  Adcy6_10
acgcattgcgttcaccacca

SEQ ID NO: 9373 - DNA, 20 bp, Artificial Sequence
  sgRNA
  Adcy6_11
actgcggctcgcatgcgaat

SEQ ID NO: 9374 - DNA, 20 bp, Artificial Sequence
  sgRNA
  Adcy6_12
ggaaggactgatgccccgct

SEQ ID NO: 9375 - DNA, 20 bp, Artificial Sequence
  sgRNA
  Adcy6_13
gatgctgaacttaacaccag

SEQ ID NO: 9376 - DNA, 20 bp, Artificial Sequence
  sgRNA
  Adcy6_14
ggcgctgagacacttcagca

SEQ ID NO: 9377 - DNA, 20 bp, Artificial Sequence
  sgRNA
  Adcy6_15
aaccgagaagattccaaccg

SEQ ID NO: 9378 - DNA, 20 bp, Artificial Sequence
  sgRNA
  Adcy6_16
gtagtgtgtgcagacaccga

SEQ ID NO: 9379 - DNA, 20 bp, Artificial Sequence
  sgRNA
  Adcy6_17
gttgtcaaagatggcggccg

SEQ ID NO: 9380 - DNA, 20 bp, Artificial Sequence
  sgRNA
  Adcy6_18
ccacccacatggagtcctgg

SEQ ID NO: 9381 - DNA, 20 bp, Artificial Sequence
  sgRNA
  Adcy6_19
ggtgatgtagacgaagaaca

SEQ ID NO: 9382 - DNA, 20 bp, Artificial Sequence
  sgRNA
  Adcy6_20
gaccacctacttcctcaacg

SEQ ID NO: 9383 - DNA, 20 bp, Artificial Sequence
  sgRNA
  Adcy7_1
ccatgtctagcactcaactg

SEQ ID NO: 9384 - DNA, 20 bp, Artificial Sequence
  sgRNA
  Adcy7_2
gtcgtgtacctacctatcag

SEQ ID NO: 9385 - DNA, 20 bp, Artificial Sequence
  sgRNA
  Adcy7_3
gcacggagcctagtaccatg

SEQ ID NO: 9386 - DNA, 20 bp, Artificial Sequence
  sgRNA
  Adcy7_4
ctccgggaatgtgctatgtg

SEQ ID NO: 9387 - DNA, 20 bp, Artificial Sequence
  sgRNA
  Adcy7_5
gattgactactactgccgct

SEQ ID NO: 9388 - DNA, 20 bp, Artificial Sequence
  sgRNA
  Adcy7_6
cgaagtcgtagcgagcccgg

SEQ ID NO: 9389 - DNA, 20 bp, Artificial Sequence
  sgRNA
  Adcy7_7
tctccacacgaagcttccga

SEQ ID NO: 9390 - DNA, 20 bp, Artificial Sequence
  sgRNA
  Adcy7_8
ggatattcgtgtgaatgccg

SEQ ID NO: 9391 - DNA, 20 bp, Artificial Sequence
  sgRNA
  Adcy7_9
gatattcgtgtgaatgccgt

SEQ ID NO: 9392 - DNA, 20 bp, Artificial Sequence
  sgRNA
  Adcy7_10
gatccgtcggaagcttcgtg

SEQ ID NO: 9393 - DNA, 20 bp, Artificial Sequence
  sgRNA
  Adcy7_11
ctttgacgttgatcagccca

SEQ ID NO: 9394 - DNA, 20 bp, Artificial Sequence
  sgRNA
  Adcy7_12
tcttccacagacagtccaag

SEQ ID NO: 9395 - DNA, 20 bp, Artificial Sequence
  sgRNA
  Adcy7_13
tcaaatgcatccagatccgt

SEQ ID NO: 9396 - DNA, 20 bp, Artificial Sequence
  sgRNA
  Adcy7_14
gggcgctacttcctaaatga

SEQ ID NO: 9397 - DNA, 20 bp, Artificial Sequence
  sgRNA
  Adcy7_15
tcgtgtggagaagcgccagc

SEQ ID NO: 9398 - DNA, 20 bp, Artificial Sequence
  sgRNA
  Adcy7_16
ttgagggtctcagctccacc

SEQ ID NO: 9399 - DNA, 20 bp, Artificial Sequence
  sgRNA
  Adcy7_17
ccagccacacccttgctccg

SEQ ID NO: 9400 - DNA, 20 bp, Artificial Sequence
  sgRNA
  Adcy7_18
tcagctctaggctcatccgc

SEQ ID NO: 9401 - DNA, 20 bp, Artificial Sequence
  sgRNA
  Adcy7_19
tgctgctcacactctcccgg

SEQ ID NO: 9402 - DNA, 20 bp, Artificial Sequence
  sgRNA
  Adcy7_20
gctctccggtgctctccatg

SEQ ID NO: 9403 - DNA, 20 bp, Artificial Sequence
  sgRNA
  Adcy9_1
atgtcatgacatgcacaaag

SEQ ID NO: 9404 - DNA, 20 bp, Artificial Sequence
  sgRNA
  Adcy9_2
tgtacgcccggcattatgcg

SEQ ID NO: 9405 - DNA, 20 bp, Artificial Sequence
  sgRNA
  Adcy9_3
gatggtgaacatgcgtgttg

SEQ ID NO: 9406 - DNA, 20 bp, Artificial Sequence
  sgRNA
  Adcy9_4
tctgctgcatcttaaagggg

SEQ ID NO: 9407 - DNA, 20 bp, Artificial Sequence
  sgRNA
  Adcy9_5
gttatgactttgactaccga

SEQ ID NO: 9408 - DNA, 20 bp, Artificial Sequence
  sgRNA
  Adcy9_6
tctcttgcaggatctcacag

SEQ ID NO: 9409 - DNA, 20 bp, Artificial Sequence
  sgRNA
  Adcy9_7
gagggaccgtgaatgtcaag

SEQ ID NO: 9410 - DNA, 20 bp, Artificial Sequence
  sgRNA
  Adcy9_8
gtctgcaccaaagacggcca

SEQ ID NO: 9411 - DNA, 20 bp, Artificial Sequence
  sgRNA
  Adcy9_9
gctcagcagctcccagtgca

SEQ ID NO: 9412 - DNA, 20 bp, Artificial Sequence
  sgRNA
  Adcy9_10
ctaccggctgcactaccatg

SEQ ID NO: 9413 - DNA, 20 bp, Artificial Sequence
  sgRNA
  Adcy9_11
gatacggcactccacaccag

SEQ ID NO: 9414 - DNA, 20 bp, Artificial Sequence
  sgRNA
  Adcy9_12
cggatgttcttgaacctgag

SEQ ID NO: 9415 - DNA, 20 bp, Artificial Sequence
  sgRNA
  Adcy9_13
gatgtgtgaatagacagcca

SEQ ID NO: 9416 - DNA, 20 bp, Artificial Sequence
  sgRNA
  Adcy9_14
cctgcaagagaagggacggt

SEQ ID NO: 9417 - DNA, 20 bp, Artificial Sequence
  sgRNA
  Adcy9_15
gaggtgagctgcgactcaag

SEQ ID NO: 9418 - DNA, 20 bp, Artificial Sequence
  sgRNA
  Adcy9_16
ggttatgactttgactaccg

SEQ ID NO: 9419 - DNA, 20 bp, Artificial Sequence
  sgRNA
  Adcy9_17
aattctgtgctgagtccaag

SEQ ID NO: 9420 - DNA, 20 bp, Artificial Sequence
  sgRNA
  Adcy9_18
gtgaatgcacacgtgaagca

SEQ ID NO: 9421 - DNA, 20 bp, Artificial Sequence
  sgRNA
  Adcy9_19
ataatgccgggcgtacagct

SEQ ID NO: 9422 - DNA, 20 bp, Artificial Sequence
  sgRNA
  Adcy9_20
tgcgtgttggggttcacacg

SEQ ID NO: 9423 - DNA, 20 bp, Artificial Sequence
  sgRNA
  Adcyap1r1_1
ccaggattattactacctgt

SEQ ID NO: 9424 - DNA, 20 bp, Artificial Sequence
  sgRNA
  Adcyap1r1_2
gtctggatgacagaaaccat

SEQ ID NO: 9425 - DNA, 20 bp, Artificial Sequence
  sgRNA
  Adcyap1r1_3
ggctctactttgatgatgcg

SEQ ID NO: 9426 - DNA, 20 bp, Artificial Sequence
  sgRNA
  Adcyap1r1_4
tgtgggacaatatcacatgt

SEQ ID NO: 9427 - DNA, 20 bp, Artificial Sequence
  sgRNA
  Adcyap1r1_5
agtccccaagaaagcccgag

SEQ ID NO: 9428 - DNA, 20 bp, Artificial Sequence
  sgRNA
  Adcyap1r1_6
cgtgggccggaactgcactg

SEQ ID NO: 9429 - DNA, 20 bp, Artificial Sequence
  sgRNA
  Adcyap1r1_7
ggtgaaccgttacttcacta

SEQ ID NO: 9430 - DNA, 20 bp, Artificial Sequence
  sgRNA
  Adcyap1r1_8
gcacaagatgaccatggcag

SEQ ID NO: 9431 - DNA, 20 bp, Artificial Sequence
  sgRNA
  Adcyap1r1_9
ggtcttccggatcttcaacc

SEQ ID NO: 9432 - DNA, 20 bp, Artificial Sequence
  sgRNA
  Adcyap1r1_10
gaagcggcacaagatgacca

SEQ ID NO: 9433 - DNA, 20 bp, Artificial Sequence
  sgRNA
  Adcyap1r1_11
gtgaaggccctctacacagt

SEQ ID NO: 9434 - DNA, 20 bp, Artificial Sequence
  sgRNA
  Adcyap1r1_12
tctccaccagcagtgtaaag

SEQ ID NO: 9435 - DNA, 20 bp, Artificial Sequence
  sgRNA
  Adcyap1r1_13
aatgctactgcaagccacag

SEQ ID NO: 9436 - DNA, 20 bp, Artificial Sequence
  sgRNA
  Adcyap1r1_14
ccattatagagccaactaca

SEQ ID NO: 9437 - DNA, 20 bp, Artificial Sequence
  sgRNA
  Adcyap1r1_15
tgaagatccggaagacctca

SEQ ID NO: 9438 - DNA, 20 bp, Artificial Sequence
  sgRNA
  Adcyap1r1_16
tgatattgtcccacatgcca

SEQ ID NO: 9439 - DNA, 20 bp, Artificial Sequence
  sgRNA
  Adcyap1r1_17
gtacagccaccacaaagccc

SEQ ID NO: 9440 - DNA, 20 bp, Artificial Sequence
  sgRNA
  Adcyap1r1_18
gccagcagtggagtgaacgg

SEQ ID NO: 9441 - DNA, 20 bp, Artificial Sequence
  sgRNA
  Adcyap1r1_19
tgttggaagcctgctcaaat

SEQ ID NO: 9442 - DNA, 20 bp, Artificial Sequence
  sgRNA
  Adcyap1r1_20
actggtataccatcattggc

SEQ ID NO: 9443 - DNA, 20 bp, Artificial Sequence
  sgRNA
  Adipor2_1
gcaccaacttgatgatacaa

SEQ ID NO: 9444 - DNA, 20 bp, Artificial Sequence
  sgRNA
  Adipor2_2
aacatttggacacatctcct

SEQ ID NO: 9445 - DNA, 20 bp, Artificial Sequence
  sgRNA
  Adipor2_3
cgtgagggatcactcgccat

SEQ ID NO: 9446 - DNA, 20 bp, Artificial Sequence
  sgRNA
  Adipor2_4
caggcccgaaaggaaggcat

SEQ ID NO: 9447 - DNA, 20 bp, Artificial Sequence
  sgRNA
  Adipor2_5
aatccggtagcacatcgtga

SEQ ID NO: 9448 - DNA, 20 bp, Artificial Sequence
  sgRNA
  Adipor2_6
gctcttaaaacaggcccgaa

SEQ ID NO: 9449 - DNA, 20 bp, Artificial Sequence
  sgRNA
  Adipor2_7
gtcgggagaccccttctgag

SEQ ID NO: 9450 - DNA, 20 bp, Artificial Sequence
  sgRNA
  Adipor2_8
tgcattatgtcatctcagaa

SEQ ID NO: 9451 - DNA, 20 bp, Artificial Sequence
  sgRNA
  Adipor2_9
gtgtcatgatgacaattccc

SEQ ID NO: 9452 - DNA, 20 bp, Artificial Sequence
  sgRNA
  Adipor2_10
ggtattgctcttctgatcat

SEQ ID NO: 9453 - DNA, 20 bp, Artificial Sequence
  sgRNA
  Adipor2_11
catctcagaagggttcctga

SEQ ID NO: 9454 - DNA, 20 bp, Artificial Sequence
  sgRNA
  Adipor2_12
gactccgtggaagtgaacaa

SEQ ID NO: 9455 - DNA, 20 bp, Artificial Sequence
  sgRNA
  Adipor2_13
ccatcatgctatggaacgaa

SEQ ID NO: 9456 - DNA, 20 bp, Artificial Sequence
  sgRNA
  Adipor2_14
cagccattatcgtctctcag

SEQ ID NO: 9457 - DNA, 20 bp, Artificial Sequence
  sgRNA
  Adipor2_15
tcatgaaacgaaattcctgc

SEQ ID NO: 9458 - DNA, 20 bp, Artificial Sequence
  sgRNA
  Adipor2_16
gaccccccgatactgagggg

SEQ ID NO: 9459 - DNA, 20 bp, Artificial Sequence
  sgRNA
  Adipor2_17
tttcgtttcatgattggcgg

SEQ ID NO: 9460 - DNA, 20 bp, Artificial Sequence
  sgRNA
  Adipor2_18
gctctgaccccccgatactg

SEQ ID NO: 9461 - DNA, 20 bp, Artificial Sequence
  sgRNA
  Adipor2_19
tgccacccctcagtatcggg

SEQ ID NO: 9462 - DNA, 20 bp, Artificial Sequence
  sgRNA
  Adipor2_20
ggcctcctatgccttccttt

SEQ ID NO: 9463 - DNA, 20 bp, Artificial Sequence
  sgRNA
  Adora1_1
gggtgtcaggcctaccacaa

SEQ ID NO: 9464 - DNA, 20 bp, Artificial Sequence
  sgRNA
  Adora1_2
ctgctatgaactcaccggag

SEQ ID NO: 9465 - DNA, 20 bp, Artificial Sequence
  sgRNA
  Adora1_3
ccaggtagataagaaccatg

SEQ ID NO: 9466 - DNA, 20 bp, Artificial Sequence
  sgRNA
  Adora1_4
tggcccaatgttgataagga

SEQ ID NO: 9467 - DNA, 20 bp, Artificial Sequence
  sgRNA
  Adora1_5
aggttgttccagccaaacat

SEQ ID NO: 9468 - DNA, 20 bp, Artificial Sequence
  sgRNA
  Adora1_6
gcttgggctggcatcggaag

SEQ ID NO: 9469 - DNA, 20 bp, Artificial Sequence
  sgRNA
  Adora1_7
ggtgacccccagaagtacta

SEQ ID NO: 9470 - DNA, 20 bp, Artificial Sequence
  sgRNA
  Adora1_8
attgccatcttcctcacaca

SEQ ID NO: 9471 - DNA, 20 bp, Artificial Sequence
  sgRNA
  Adora1_9
ggatcaggtagaagacctcc

SEQ ID NO: 9472 - DNA, 20 bp, Artificial Sequence
  sgRNA
  Adora1_10
gacagtggtgactcagcggc

SEQ ID NO: 9473 - DNA, 20 bp, Artificial Sequence
  sgRNA
  Adora1_11
tgcttgctattgctgtggat

SEQ ID NO: 9474 - DNA, 20 bp, Artificial Sequence
  sgRNA
  Adora1_12
gagcacctcgatgccaatgt

SEQ ID NO: 9475 - DNA, 20 bp, Artificial Sequence
  sgRNA
  Adora1_13
gggatatcttcctcaatggg

SEQ ID NO: 9476 - DNA, 20 bp, Artificial Sequence
  sgRNA
  Adora1_14
tgttgataaggatggccagt

SEQ ID NO: 9477 - DNA, 20 bp, Artificial Sequence
  sgRNA
  Adora1_15
gaacaagcctggatagccaa

SEQ ID NO: 9478 - DNA, 20 bp, Artificial Sequence
  sgRNA
  Adora1_16
agacagtggtgactcagcgg

SEQ ID NO: 9479 - DNA, 20 bp, Artificial Sequence
  sgRNA
  Adora1_17
catggttcttatctacctgg

SEQ ID NO: 9480 - DNA, 20 bp, Artificial Sequence
  sgRNA
  Adora1_18
tggattctctcccttgtggt

SEQ ID NO: 9481 - DNA, 20 bp, Artificial Sequence
  sgRNA
  Adora1_19
tgggtgtcaggcctaccaca

SEQ ID NO: 9482 - DNA, 20 bp, Artificial Sequence
  sgRNA
  Adora1_20
gtgacccccagaagtactac

SEQ ID NO: 9483 - DNA, 20 bp, Artificial Sequence
  sgRNA
  Adora2a_1
tgtcgatggcaatagccaag

SEQ ID NO: 9484 - DNA, 20 bp, Artificial Sequence
  sgRNA
  Adora2a_2
ctccacaaagacctgcggcg

SEQ ID NO: 9485 - DNA, 20 bp, Artificial Sequence
  sgRNA
  Adora2a_3
ggagagccaacccctaccag

SEQ ID NO: 9486 - DNA, 20 bp, Artificial Sequence
  sgRNA
  Adora2a_4
atggccaggtacatgagcca

SEQ ID NO: 9487 - DNA, 20 bp, Artificial Sequence
  sgRNA
  Adora2a_5
tcgccatccgaattccactc

SEQ ID NO: 9488 - DNA, 20 bp, Artificial Sequence
  sgRNA
  Adora2a_6
ggttcggatgatcttccgga

SEQ ID NO: 9489 - DNA, 20 bp, Artificial Sequence
  sgRNA
  Adora2a_7
gcggaactcccggatcctgt

SEQ ID NO: 9490 - DNA, 20 bp, Artificial Sequence
  sgRNA
  Adora2a_8
gagccccacgatgatggcca

SEQ ID NO: 9491 - DNA, 20 bp, Artificial Sequence
  sgRNA
  Adora2a_9
ggagtgctccccactctgga

SEQ ID NO: 9492 - DNA, 20 bp, Artificial Sequence
  sgRNA
  Adora2a_10
ccagatgatcccctaggcca

SEQ ID NO: 9493 - DNA, 20 bp, Artificial Sequence
  sgRNA
  Adora2a_11
gggctgccaaaaaaatcctt

SEQ ID NO: 9494 - DNA, 20 bp, Artificial Sequence
  sgRNA
  Adora2a_12
gtaagaagctctacatcccc

SEQ ID NO: 9495 - DNA, 20 bp, Artificial Sequence
  sgRNA
  Adora2a_13
ctccaccatgatgtacaccg

SEQ ID NO: 9496 - DNA, 20 bp, Artificial Sequence
  sgRNA
  Adora2a_14
tggagagccaacccctacca

SEQ ID NO: 9497 - DNA, 20 bp, Artificial Sequence
  sgRNA
  Adora2a_15
gcaagagcaccctggcctag

SEQ ID NO: 9498 - DNA, 20 bp, Artificial Sequence
  sgRNA
  Adora2a_16
gtgacgggtatgagggcgaa

SEQ ID NO: 9499 - DNA, 20 bp, Artificial Sequence
  sgRNA
  Adora2a_17
ggcaaactctgaagaccatg

SEQ ID NO: 9500 - DNA, 20 bp, Artificial Sequence
  sgRNA
  Adora2a_18
ggatcatctggcccagggta

SEQ ID NO: 9501 - DNA, 20 bp, Artificial Sequence
  sgRNA
  Adora2a_19
cttcgtggtatctctggcgg

SEQ ID NO: 9502 - DNA, 20 bp, Artificial Sequence
  sgRNA
  Adora2a_20
tagtaaaccatgtaattcat

SEQ ID NO: 9503 - DNA, 20 bp, Artificial Sequence
  sgRNA
  Adora2b_1
tcactgggacacgagcgaga

SEQ ID NO: 9504 - DNA, 20 bp, Artificial Sequence
  sgRNA
  Adora2b_2
ttctcaaagagacatgtcac

SEQ ID NO: 9505 - DNA, 20 bp, Artificial Sequence
  sgRNA
  Adora2b_3
caacgtgctggtgtgcgccg

SEQ ID NO: 9506 - DNA, 20 bp, Artificial Sequence
  sgRNA
  Adora2b_4
ctttctggtatccctggcga

SEQ ID NO: 9507 - DNA, 20 bp, Artificial Sequence
  sgRNA
  Adora2b_5
ttactgttccaccccaggaa

SEQ ID NO: 9508 - DNA, 20 bp, Artificial Sequence
  sgRNA
  Adora2b_6
ggtcgacagccaccgccaag

SEQ ID NO: 9509 - DNA, 20 bp, Artificial Sequence
  sgRNA
  Adora2b_7
ggacgcgaatggccagatat

SEQ ID NO: 9510 - DNA, 20 bp, Artificial Sequence
  sgRNA
  Adora2b_8
gcaccagcacgaagcaggcg

SEQ ID NO: 9511 - DNA, 20 bp, Artificial Sequence
  sgRNA
  Adora2b_9
tgcactcgaggctcccaccg

SEQ ID NO: 9512 - DNA, 20 bp, Artificial Sequence
  sgRNA
  Adora2b_10
gcggaagtctcggttcctgt

SEQ ID NO: 9513 - DNA, 20 bp, Artificial Sequence
  sgRNA
  Adora2b_11
gccacattcatcacccactt

SEQ ID NO: 9514 - DNA, 20 bp, Artificial Sequence
  sgRNA
  Adora2b_12
ggttatcgctgcgctggcgg

SEQ ID NO: 9515 - DNA, 20 bp, Artificial Sequence
  sgRNA
  Adora2b_13
tggctgcgtggatctcccgc

SEQ ID NO: 9516 - DNA, 20 bp, Artificial Sequence
  sgRNA
  Adora2b_14
gccaggccgagaccaagggt

SEQ ID NO: 9517 - DNA, 20 bp, Artificial Sequence
  sgRNA
  Adora2b_15
gataccagaaagtagttggt

SEQ ID NO: 9518 - DNA, 20 bp, Artificial Sequence
  sgRNA
  Adora2b_16
tgatcttgtggaaactgtag

SEQ ID NO: 9519 - DNA, 20 bp, Artificial Sequence
  sgRNA
  Adora2b_17
gcttcagcgcatggaactga

SEQ ID NO: 9520 - DNA, 20 bp, Artificial Sequence
  sgRNA
  Adora2b_18
ggccaaggacaagcccaagt

SEQ ID NO: 9521 - DNA, 20 bp, Artificial Sequence
  sgRNA
  Adora2b_19
accccattgtctatgcctac

SEQ ID NO: 9522 - DNA, 20 bp, Artificial Sequence
  sgRNA
  Adora2b_20
atccctggcgacggcagacg

SEQ ID NO: 9523 - DNA, 20 bp, Artificial Sequence
  sgRNA
  Adora3_1
ggagacaatgaaatagaacg

SEQ ID NO: 9524 - DNA, 20 bp, Artificial Sequence
  sgRNA
  Adora3_2
ttgctgtagaccgatacctg

SEQ ID NO: 9525 - DNA, 20 bp, Artificial Sequence
  sgRNA
  Adora3_3
cacaacggcacagagcccga

SEQ ID NO: 9526 - DNA, 20 bp, Artificial Sequence
  sgRNA
  Adora3_4
aggctgacagcaatggccaa

SEQ ID NO: 9527 - DNA, 20 bp, Artificial Sequence
  sgRNA
  Adora3_5
gttcatcatggagttcgcgt

SEQ ID NO: 9528 - DNA, 20 bp, Artificial Sequence
  sgRNA
  Adora3_6
ggttcatcatggagttcgcg

SEQ ID NO: 9529 - DNA, 20 bp, Artificial Sequence
  sgRNA
  Adora3_7
aatccaaactgaccacggaa

SEQ ID NO: 9530 - DNA, 20 bp, Artificial Sequence
  sgRNA
  Adora3_8
gcactggctgacattgccgt

SEQ ID NO: 9531 - DNA, 20 bp, Artificial Sequence
  sgRNA
  Adora3_9
tcagcttgacccgcaggtat

SEQ ID NO: 9532 - DNA, 20 bp, Artificial Sequence
  sgRNA
  Adora3_10
tctattccagccaaacatgg

SEQ ID NO: 9533 - DNA, 20 bp, Artificial Sequence
  sgRNA
  Adora3_11
tgacacacatgacaaccagg

SEQ ID NO: 9534 - DNA, 20 bp, Artificial Sequence
  sgRNA
  Adora3_12
gttcagccagtccgtctccg

SEQ ID NO: 9535 - DNA, 20 bp, Artificial Sequence
  sgRNA
  Adora3_13
catgtaatccaaactgacca

SEQ ID NO: 9536 - DNA, 20 bp, Artificial Sequence
  sgRNA
  Adora3_14
gatgacacacatgacaacca

SEQ ID NO: 9537 - DNA, 20 bp, Artificial Sequence
  sgRNA
  Adora3_15
aggtgtgaccagcaccccaa

SEQ ID NO: 9538 - DNA, 20 bp, Artificial Sequence
  sgRNA
  Adora3_16
tttctattccagccaaacat

SEQ ID NO: 9539 - DNA, 20 bp, Artificial Sequence
  sgRNA
  Adora3_17
ggcaatgtcagccagtgcta

SEQ ID NO: 9540 - DNA, 20 bp, Artificial Sequence
  sgRNA
  Adora3_18
cactggctgacattgccgtt

SEQ ID NO: 9541 - DNA, 20 bp, Artificial Sequence
  sgRNA
  Adora3_19
gaacatcacctacatcacca

SEQ ID NO: 9542 - DNA, 20 bp, Artificial Sequence
  sgRNA
  Adora3_20
gtttgagtccaaagaatctg

SEQ ID NO: 9543 - DNA, 20 bp, Artificial Sequence
  sgRNA
  Adra1a_1
tatgtactgtcgagtctacg

SEQ ID NO: 9544 - DNA, 20 bp, Artificial Sequence
  sgRNA
  Adra1a_2
gaccatctgccaaatcaatg

SEQ ID NO: 9545 - DNA, 20 bp, Artificial Sequence
  sgRNA
  Adra1a_3
actcaccaatgggcatcacg

SEQ ID NO: 9546 - DNA, 20 bp, Artificial Sequence
  sgRNA
  Adra1a_4
cacaccaatgtatcggtcga

SEQ ID NO: 9547 - DNA, 20 bp, Artificial Sequence
  sgRNA
  Adra1a_5
ggtagctcacaccaatgtat

SEQ ID NO: 9548 - DNA, 20 bp, Artificial Sequence
  sgRNA
  Adra1a_6
gtaatcctggccgatccctg

SEQ ID NO: 9549 - DNA, 20 bp, Artificial Sequence
  sgRNA
  Adra1a_7
atctccatcgaccgatacat

SEQ ID NO: 9550 - DNA, 20 bp, Artificial Sequence
  sgRNA
  Adra1a_8
ataagactcacttctccgtg

SEQ ID NO: 9551 - DNA, 20 bp, Artificial Sequence
  sgRNA
  Adra1a_9
aatccgcctgtaccacagcc

SEQ ID NO: 9552 - DNA, 20 bp, Artificial Sequence
  sgRNA
  Adra1a_10
ggtgttctgcaacatctggg

SEQ ID NO: 9553 - DNA, 20 bp, Artificial Sequence
  sgRNA
  Adra1a_11
gtagcccaggatctcaaaga

SEQ ID NO: 9554 - DNA, 20 bp, Artificial Sequence
  sgRNA
  Adra1a_12
accccaccattgtcacccag

SEQ ID NO: 9555 - DNA, 20 bp, Artificial Sequence
  sgRNA
  Adra1a_13
ggcatggtgcgtatcccggt

SEQ ID NO: 9556 - DNA, 20 bp, Artificial Sequence
  sgRNA
  Adra1a_14
ggaaaacttgagcagcctca

SEQ ID NO: 9557 - DNA, 20 bp, Artificial Sequence
  sgRNA
  Adra1a_15
tgaactcctggctggagcat

SEQ ID NO: 9558 - DNA, 20 bp, Artificial Sequence
  sgRNA
  Adra1a_16
ggcggattggtccttcggca

SEQ ID NO: 9559 - DNA, 20 bp, Artificial Sequence
  sgRNA
  Adra1a_17
gattcgcagcacattctgaa

SEQ ID NO: 9560 - DNA, 20 bp, Artificial Sequence
  sgRNA
  Adra1a_18
gccgatgacaggccaccgag

SEQ ID NO: 9561 - DNA, 20 bp, Artificial Sequence
  sgRNA
  Adra1a_19
cttcccgaatttcaagccac

SEQ ID NO: 9562 - DNA, 20 bp, Artificial Sequence
  sgRNA
  Adra1a_20
agacagatggagtccgtgaa

SEQ ID NO: 9563 - DNA, 20 bp, Artificial Sequence
  sgRNA
  Adra1b_1
agtatcgcaccccaatgtag

SEQ ID NO: 9564 - DNA, 20 bp, Artificial Sequence
  sgRNA
  Adra1b_2
tcttggccacgatgtagact

SEQ ID NO: 9565 - DNA, 20 bp, Artificial Sequence
  sgRNA
  Adra1b_3
cattccgactacaatgccca

SEQ ID NO: 9566 - DNA, 20 bp, Artificial Sequence
  sgRNA
  Adra1b_4
accttgaatacggcgtccgg

SEQ ID NO: 9567 - DNA, 20 bp, Artificial Sequence
  sgRNA
  Adra1b_5
gccccagctggacgtcacca

SEQ ID NO: 9568 - DNA, 20 bp, Artificial Sequence
  sgRNA
  Adra1b_6
gtactgccgagtctacatcg

SEQ ID NO: 9569 - DNA, 20 bp, Artificial Sequence
  sgRNA
  Adra1b_7
gcgcttacacctaccggccg

SEQ ID NO: 9570 - DNA, 20 bp, Artificial Sequence
  sgRNA
  Adra1b_8
tgtaagcgcagcctcctaga

SEQ ID NO: 9571 - DNA, 20 bp, Artificial Sequence
  sgRNA
  Adra1b_9
cttgaagcccggctgcccgt

SEQ ID NO: 9572 - DNA, 20 bp, Artificial Sequence
  sgRNA
  Adra1b_10
gctgcatgagcggcagccag

SEQ ID NO: 9573 - DNA, 20 bp, Artificial Sequence
  sgRNA
  Adra1b_11
tgaccaggatgaccgccagt

SEQ ID NO: 9574 - DNA, 20 bp, Artificial Sequence
  sgRNA
  Adra1b_12
gcgccttcatgcgtatcctg

SEQ ID NO: 9575 - DNA, 20 bp, Artificial Sequence
  sgRNA
  Adra1b_13
gccggttgcaggccaccgac

SEQ ID NO: 9576 - DNA, 20 bp, Artificial Sequence
  sgRNA
  Adra1b_14
accccacgctggtcacccgc

SEQ ID NO: 9577 - DNA, 20 bp, Artificial Sequence
  sgRNA
  Adra1b_15
agcctcctagacggcgacgg

SEQ ID NO: 9578 - DNA, 20 bp, Artificial Sequence
  sgRNA
  Adra1b_16
gagtctacatcgtggccaag

SEQ ID NO: 9579 - DNA, 20 bp, Artificial Sequence
  sgRNA
  Adra1b_17
ccagtagccgagcacttcca

SEQ ID NO: 9580 - DNA, 20 bp, Artificial Sequence
  sgRNA
  Adra1b_18
gaggctgcgcttacacctac

SEQ ID NO: 9581 - DNA, 20 bp, Artificial Sequence
  sgRNA
  Adra1b_19
ggacaccctcagcagtacca

SEQ ID NO: 9582 - DNA, 20 bp, Artificial Sequence
  sgRNA
  Adra1b_20
tctttgtcgtcattgggcgc

SEQ ID NO: 9583 - DNA, 20 bp, Artificial Sequence
  sgRNA
  Adra1d_1
tgcgcgcgaccacatacacg

SEQ ID NO: 9584 - DNA, 20 bp, Artificial Sequence
  sgRNA
  Adra1d_2
ctagcgccaaaggaaatcca

SEQ ID NO: 9585 - DNA, 20 bp, Artificial Sequence
  sgRNA
  Adra1d_3
ggttccttccaacctagtag

SEQ ID NO: 9586 - DNA, 20 bp, Artificial Sequence
  sgRNA
  Adra1d_4
tgagggaatcactcacccag

SEQ ID NO: 9587 - DNA, 20 bp, Artificial Sequence
  sgRNA
  Adra1d_5
gcagcatagcacgtccaccg

SEQ ID NO: 9588 - DNA, 20 bp, Artificial Sequence
  sgRNA
  Adra1d_6
cctcagctgaaaccatcaga

SEQ ID NO: 9589 - DNA, 20 bp, Artificial Sequence
  sgRNA
  Adra1d_7
tttcatcgtgaacctagcag

SEQ ID NO: 9590 - DNA, 20 bp, Artificial Sequence
  sgRNA
  Adra1d_8
atctctgtggaccggtacgt

SEQ ID NO: 9591 - DNA, 20 bp, Artificial Sequence
  sgRNA
  Adra1d_9
actcaccactagccccccga

SEQ ID NO: 9592 - DNA, 20 bp, Artificial Sequence
  sgRNA
  Adra1d_10
cgaggacaaccagagctcca

SEQ ID NO: 9593 - DNA, 20 bp, Artificial Sequence
  sgRNA
  Adra1d_11
attcacctcgccgcttgccg

SEQ ID NO: 9594 - DNA, 20 bp, Artificial Sequence
  sgRNA
  Adra1d_12
tggtgaccgtctgcaagtgg

SEQ ID NO: 9595 - DNA, 20 bp, Artificial Sequence
  sgRNA
  Adra1d_13
ggaaaacttgagcagcctta

SEQ ID NO: 9596 - DNA, 20 bp, Artificial Sequence
  sgRNA
  Adra1d_14
gcgtttctgcggcatcaccg

SEQ ID NO: 9597 - DNA, 20 bp, Artificial Sequence
  sgRNA
  Adra1d_15
tgaccacgatcactgccatg

SEQ ID NO: 9598 - DNA, 20 bp, Artificial Sequence
  sgRNA
  Adra1d_16
ctgcaaccgccacttgcaga

SEQ ID NO: 9599 - DNA, 20 bp, Artificial Sequence
  sgRNA
  Adra1d_17
ccgcagaaacgctcatccgg

SEQ ID NO: 9600 - DNA, 20 bp, Artificial Sequence
  sgRNA
  Adra1d_18
cgtagactcgccagaggcgg

SEQ ID NO: 9601 - DNA, 20 bp, Artificial Sequence
  sgRNA
  Adra1d_19
gggctccgtagacacgccgg

SEQ ID NO: 9602 - DNA, 20 bp, Artificial Sequence
  sgRNA
  Adra1d_20
aagcagcctccactcccgga

SEQ ID NO: 9603 - DNA, 20 bp, Artificial Sequence
  sgRNA
  Adra2a_1
ccagtaacccataacctcgt

SEQ ID NO: 9604 - DNA, 20 bp, Artificial Sequence
  sgRNA
  Adra2a_2
ggggcaccgttaagctgggt

SEQ ID NO: 9605 - DNA, 20 bp, Artificial Sequence
  sgRNA
  Adra2a_3
gcaagatcaacgaccagaag

SEQ ID NO: 9606 - DNA, 20 bp, Artificial Sequence
  sgRNA
  Adra2a_4
gacagccgagatgacccaca

SEQ ID NO: 9607 - DNA, 20 bp, Artificial Sequence
  sgRNA
  Adra2a_5
cccagcttaacggtgccccg

SEQ ID NO: 9608 - DNA, 20 bp, Artificial Sequence
  sgRNA
  Adra2a_6
acctacacgctcatagcggt

SEQ ID NO: 9609 - DNA, 20 bp, Artificial Sequence
  sgRNA
  Adra2a_7
tccagcgcatccccatcgcg

SEQ ID NO: 9610 - DNA, 20 bp, Artificial Sequence
  sgRNA
  Adra2a_8
tgaaggcgcgtcggaagtcg

SEQ ID NO: 9611 - DNA, 20 bp, Artificial Sequence
  sgRNA
  Adra2a_9
tttcacctacacgctcatag

SEQ ID NO: 9612 - DNA, 20 bp, Artificial Sequence
  sgRNA
  Adra2a_10
cctgcgtgatggaccagtag

SEQ ID NO: 9613 - DNA, 20 bp, Artificial Sequence
  sgRNA
  Adra2a_11
gaagaaggaaccgatggacg

SEQ ID NO: 9614 - DNA, 20 bp, Artificial Sequence
  sgRNA
  Adra2a_12
aacgggaccgaagcgcccgg

SEQ ID NO: 9615 - DNA, 20 bp, Artificial Sequence
  sgRNA
  Adra2a_13
atgatggccttgatgcgacg

SEQ ID NO: 9616 - DNA, 20 bp, Artificial Sequence
  sgRNA
  Adra2a_14
tatgtcatctcctcgtccat

SEQ ID NO: 9617 - DNA, 20 bp, Artificial Sequence
  sgRNA
  Adra2a_15
aggcgcgaagaaggaaccga

SEQ ID NO: 9618 - DNA, 20 bp, Artificial Sequence
  sgRNA
  Adra2a_16
acctcgttggccaaagaaaa

SEQ ID NO: 9619 - DNA, 20 bp, Artificial Sequence
  sgRNA
  Adra2a_17
gccgaccgctatgagcgtgt

SEQ ID NO: 9620 - DNA, 20 bp, Artificial Sequence
  sgRNA
  Adra2a_18
cctgcaggtgacactgacgc

SEQ ID NO: 9621 - DNA, 20 bp, Artificial Sequence
  sgRNA
  Adra2a_19
tcggaagtcgtggttgaaga

SEQ ID NO: 9622 - DNA, 20 bp, Artificial Sequence
  sgRNA
  Adra2a_20
gctcatagcggtcggctgcc

SEQ ID NO: 9623 - DNA, 20 bp, Artificial Sequence
  sgRNA
  Adra2b_1
agaggtctcggagctaagag

SEQ ID NO: 9624 - DNA, 20 bp, Artificial Sequence
  sgRNA
  Adra2b_2
ggtagacgagaatcatgatg

SEQ ID NO: 9625 - DNA, 20 bp, Artificial Sequence
  sgRNA
  Adra2b_3
tcttggttgagctcacactg

SEQ ID NO: 9626 - DNA, 20 bp, Artificial Sequence
  sgRNA
  Adra2b_4
gacggctgcaatgagccaca

SEQ ID NO: 9627 - DNA, 20 bp, Artificial Sequence
  sgRNA
  Adra2b_5
ggatccttcgaaaggcacgg

SEQ ID NO: 9628 - DNA, 20 bp, Artificial Sequence
  sgRNA
  Adra2b_6
aatgcatcatcctcaccgtg

SEQ ID NO: 9629 - DNA, 20 bp, Artificial Sequence
  sgRNA
  Adra2b_7
ggatgataagagtagccact

SEQ ID NO: 9630 - DNA, 20 bp, Artificial Sequence
  sgRNA
  Adra2b_8
ggcagcagccgacatcctag

SEQ ID NO: 9631 - DNA, 20 bp, Artificial Sequence
  sgRNA
  Adra2b_9
tcagtccaggaccagaagaa

SEQ ID NO: 9632 - DNA, 20 bp, Artificial Sequence
  sgRNA
  Adra2b_10
atgatgcatttgatgcggcg

SEQ ID NO: 9633 - DNA, 20 bp, Artificial Sequence
  sgRNA
  Adra2b_11
gcaccgagtagggctcctgg

SEQ ID NO: 9634 - DNA, 20 bp, Artificial Sequence
  sgRNA
  Adra2b_12
tcgcccttgtagatgagggg

SEQ ID NO: 9635 - DNA, 20 bp, Artificial Sequence
  sgRNA
  Adra2b_13
ctaccgcccctcatctacaa

SEQ ID NO: 9636 - DNA, 20 bp, Artificial Sequence
  sgRNA
  Adra2b_14
gctcctggtggaccatggcg

SEQ ID NO: 9637 - DNA, 20 bp, Artificial Sequence
  sgRNA
  Adra2b_15
catcagtctggacagatact

SEQ ID NO: 9638 - DNA, 20 bp, Artificial Sequence
  sgRNA
  Adra2b_16
acttccgccgtgcctttcga

SEQ ID NO: 9639 - DNA, 20 bp, Artificial Sequence
  sgRNA
  Adra2b_17
acgtagcgtggccagcaccc

SEQ ID NO: 9640 - DNA, 20 bp, Artificial Sequence
  sgRNA
  Adra2b_18
gcctctccgacagaagatag

SEQ ID NO: 9641 - DNA, 20 bp, Artificial Sequence
  sgRNA
  Adra2b_19
gtgagctcaaccaagaagcc

SEQ ID NO: 9642 - DNA, 20 bp, Artificial Sequence
  sgRNA
  Adra2b_20
gctcgttggccagagagaaa

SEQ ID NO: 9643 - DNA, 20 bp, Artificial Sequence
  sgRNA
  Adra2c_1
ctatgcgcgcatctaccgcg

SEQ ID NO: 9644 - DNA, 20 bp, Artificial Sequence
  sgRNA
  Adra2c_2
tgtaccaggtctcatcgttg

SEQ ID NO: 9645 - DNA, 20 bp, Artificial Sequence
  sgRNA
  Adra2c_3
cttgcgtcaccgaccagtag

SEQ ID NO: 9646 - DNA, 20 bp, Artificial Sequence
  sgRNA
  Adra2c_4
tggcacccagtcggtccccg

SEQ ID NO: 9647 - DNA, 20 bp, Artificial Sequence
  sgRNA
  Adra2c_5
cgtacgctcagcgagaaacg

SEQ ID NO: 9648 - DNA, 20 bp, Artificial Sequence
  sgRNA
  Adra2c_6
ctactggtcggtgacgcaag

SEQ ID NO: 9649 - DNA, 20 bp, Artificial Sequence
  sgRNA
  Adra2c_7
acgcgacaggaagaactcga

SEQ ID NO: 9650 - DNA, 20 bp, Artificial Sequence
  sgRNA
  Adra2c_8
caccaggaagaggttctgcg

SEQ ID NO: 9651 - DNA, 20 bp, Artificial Sequence
  sgRNA
  Adra2c_9
tagtctggaccgctactggt

SEQ ID NO: 9652 - DNA, 20 bp, Artificial Sequence
  sgRNA
  Adra2c_10
tcgagttcttcctgtcgcgt

SEQ ID NO: 9653 - DNA, 20 bp, Artificial Sequence
  sgRNA
  Adra2c_11
cacttgcccgaagtaccagt

SEQ ID NO: 9654 - DNA, 20 bp, Artificial Sequence
  sgRNA
  Adra2c_12
cgtccccgaccacagagaat

SEQ ID NO: 9655 - DNA, 20 bp, Artificial Sequence
  sgRNA
  Adra2c_13
tccggctccacttcagtgcg

SEQ ID NO: 9656 - DNA, 20 bp, Artificial Sequence
  sgRNA
  Adra2c_14
atggtggccttgacacggcg

SEQ ID NO: 9657 - DNA, 20 bp, Artificial Sequence
  sgRNA
  Adra2c_15
atgagagcagtgcggccgag

SEQ ID NO: 9658 - DNA, 20 bp, Artificial Sequence
  sgRNA
  Adra2c_16
ggtagaacgagacgagaggc

SEQ ID NO: 9659 - DNA, 20 bp, Artificial Sequence
  sgRNA
  Adra2c_17
ggctccacttcagtgcgcgg

SEQ ID NO: 9660 - DNA, 20 bp, Artificial Sequence
  sgRNA
  Adra2c_18
ccagtagcggtccagactaa

SEQ ID NO: 9661 - DNA, 20 bp, Artificial Sequence
  sgRNA
  Adra2c_19
tcaagcatatcctctttcga

SEQ ID NO: 9662 - DNA, 20 bp, Artificial Sequence
  sgRNA
  Adra2c_20
tcatcgttgaggccgcactg

SEQ ID NO: 9663 - DNA, 20 bp, Artificial Sequence
  sgRNA
  Adrb1_1
tggccatcgccaagaccccg

SEQ ID NO: 9664 - DNA, 20 bp, Artificial Sequence
  sgRNA
  Adrb1_2
gtacctgcgggtgttccgcg

SEQ ID NO: 9665 - DNA, 20 bp, Artificial Sequence
  sgRNA
  Adrb1_3
gcctttcggggccaccatcg

SEQ ID NO: 9666 - DNA, 20 bp, Artificial Sequence
  sgRNA
  Adrb1_4
ctgcgatttcgtcaccaaca

SEQ ID NO: 9667 - DNA, 20 bp, Artificial Sequence
  sgRNA
  Adrb1_5
attcgagcctggacgagccg

SEQ ID NO: 9668 - DNA, 20 bp, Artificial Sequence
  sgRNA
  Adrb1_6
gtagaaggagacgacggacg

SEQ ID NO: 9669 - DNA, 20 bp, Artificial Sequence
  sgRNA
  Adrb1_7
tcgtcgtcgtcgtcgtccga

SEQ ID NO: 9670 - DNA, 20 bp, Artificial Sequence
  sgRNA
  Adrb1_8
cagcagtaggcccatacccg

SEQ ID NO: 9671 - DNA, 20 bp, Artificial Sequence
  sgRNA
  Adrb1_9
gggcacgtagaaggagacga

SEQ ID NO: 9672 - DNA, 20 bp, Artificial Sequence
  sgRNA
  Adrb1_10
tctgctcgcgcagagccacg

SEQ ID NO: 9673 - DNA, 20 bp, Artificial Sequence
  sgRNA
  Adrb1_11
gtagcgaaagggcgacgtga

SEQ ID NO: 9674 - DNA, 20 bp, Artificial Sequence
  sgRNA
  Adrb1_12
gatccggcaccaggtcgcgg

SEQ ID NO: 9675 - DNA, 20 bp, Artificial Sequence
  sgRNA
  Adrb1_13
cgttggccagcgagtctgcg

SEQ ID NO: 9676 - DNA, 20 bp, Artificial Sequence
  sgRNA
  Adrb1_14
gaacacccgcaggtacacga

SEQ ID NO: 9677 - DNA, 20 bp, Artificial Sequence
  sgRNA
  Adrb1_15
gttccgcgaggcccaaaaac

SEQ ID NO: 9678 - DNA, 20 bp, Artificial Sequence
  sgRNA
  Adrb1_16
gctcgaatcgctgtccacag

SEQ ID NO: 9679 - DNA, 20 bp, Artificial Sequence
  sgRNA
  Adrb1_17
ccgcagccccgacttccgca

SEQ ID NO: 9680 - DNA, 20 bp, Artificial Sequence
  sgRNA
  Adrb1_18
gaccagatcagcgctggcca

SEQ ID NO: 9681 - DNA, 20 bp, Artificial Sequence
  sgRNA
  Adrb1_19
ccagcggccccacaccacga

SEQ ID NO: 9682 - DNA, 20 bp, Artificial Sequence
  sgRNA
  Adrb1_20
acttggggtcgttgtagcag

SEQ ID NO: 9683 - DNA, 20 bp, Artificial Sequence
  sgRNA
  Adrb2_1
agctatcgattgttacaccg

SEQ ID NO: 9684 - DNA, 20 bp, Artificial Sequence
  sgRNA
  Adrb2_2
tctagtcatgggcctagcgg

SEQ ID NO: 9685 - DNA, 20 bp, Artificial Sequence
  sgRNA
  Adrb2_3
gccagaccacgacgtcactc

SEQ ID NO: 9686 - DNA, 20 bp, Artificial Sequence
  sgRNA
  Adrb2_4
tggaggaccttcggagtccg

SEQ ID NO: 9687 - DNA, 20 bp, Artificial Sequence
  sgRNA
  Adrb2_5
gctagagtagccgttcccat

SEQ ID NO: 9688 - DNA, 20 bp, Artificial Sequence
  sgRNA
  Adrb2_6
tctggcgctcggcttccgtt

SEQ ID NO: 9689 - DNA, 20 bp, Artificial Sequence
  sgRNA
  Adrb2_7
gacttcttgctggcacccaa

SEQ ID NO: 9690 - DNA, 20 bp, Artificial Sequence
  sgRNA
  Adrb2_8
tcaggaacgggacgaagcgt

SEQ ID NO: 9691 - DNA, 20 bp, Artificial Sequence
  sgRNA
  Adrb2_9
ccaggacgataaccgacatg

SEQ ID NO: 9692 - DNA, 20 bp, Artificial Sequence
  sgRNA
  Adrb2_10
ggactccgacagtagataag

SEQ ID NO: 9693 - DNA, 20 bp, Artificial Sequence
  sgRNA
  Adrb2_11
cgtagcccaaccagttaagg

SEQ ID NO: 9694 - DNA, 20 bp, Artificial Sequence
  sgRNA
  Adrb2_12
gcgtgtgctgatctagtcat

SEQ ID NO: 9695 - DNA, 20 bp, Artificial Sequence
  sgRNA
  Adrb2_13
tgtgacgcacaacacatcaa

SEQ ID NO: 9696 - DNA, 20 bp, Artificial Sequence
  sgRNA
  Adrb2_14
ggctactctagcaatagcaa

SEQ ID NO: 9697 - DNA, 20 bp, Artificial Sequence
  sgRNA
  Adrb2_15
cggcagaacggactacacag

SEQ ID NO: 9698 - DNA, 20 bp, Artificial Sequence
  sgRNA
  Adrb2_16
ggaggatgtaaacttcctta

SEQ ID NO: 9699 - DNA, 20 bp, Artificial Sequence
  sgRNA
  Adrb2_17
acgatattgacaatgaagaa

SEQ ID NO: 9700 - DNA, 20 bp, Artificial Sequence
  sgRNA
  Adrb2_18
gaccaagaataaggcccgag

SEQ ID NO: 9701 - DNA, 20 bp, Artificial Sequence
  sgRNA
  Adrb2_19
gactagatcagcacacgcca

SEQ ID NO: 9702 - DNA, 20 bp, Artificial Sequence
  sgRNA
  Adrb2_20
tcaatcctcttatctactgt

SEQ ID NO: 9703 - DNA, 20 bp, Artificial Sequence
  sgRNA
  Adrb3_1
ctatgctcgagtgttcgttg

SEQ ID NO: 9704 - DNA, 20 bp, Artificial Sequence
  sgRNA
  Adrb3_2
cagtgaagtcacgaacacgt

SEQ ID NO: 9705 - DNA, 20 bp, Artificial Sequence
  sgRNA
  Adrb3_3
atggccagtcagcgccaatg

SEQ ID NO: 9706 - DNA, 20 bp, Artificial Sequence
  sgRNA
  Adrb3_4
cgtgccgtaacgcaaagggt

SEQ ID NO: 9707 - DNA, 20 bp, Artificial Sequence
  sgRNA
  Adrb3_5
acaccaggacaactgccgcg

SEQ ID NO: 9708 - DNA, 20 bp, Artificial Sequence
  sgRNA
  Adrb3_6
aatgagacctaaggtgcgca

SEQ ID NO: 9709 - DNA, 20 bp, Artificial Sequence
  sgRNA
  Adrb3_7
ccagcgtgccgtaacgcaaa

SEQ ID NO: 9710 - DNA, 20 bp, Artificial Sequence
  sgRNA
  Adrb3_8
tcgcaaccagtttcgcccaa

SEQ ID NO: 9711 - DNA, 20 bp, Artificial Sequence
  sgRNA
  Adrb3_9
gctgggaaggtgactgcgcg

SEQ ID NO: 9712 - DNA, 20 bp, Artificial Sequence
  sgRNA
  Adrb3_10
agggcgatgaaaactccgct

SEQ ID NO: 9713 - DNA, 20 bp, Artificial Sequence
  sgRNA
  Adrb3_11
gggccctctctagttcccag

SEQ ID NO: 9714 - DNA, 20 bp, Artificial Sequence
  sgRNA
  Adrb3_12
ccagtgcagccaacaccagt

SEQ ID NO: 9715 - DNA, 20 bp, Artificial Sequence
  sgRNA
  Adrb3_13
ggagtggcattcctgtgcct

SEQ ID NO: 9716 - DNA, 20 bp, Artificial Sequence
  sgRNA
  Adrb3_14
acgaagagcatcacaaggag

SEQ ID NO: 9717 - DNA, 20 bp, Artificial Sequence
  sgRNA
  Adrb3_15
actgggccgcttctcgcccg

SEQ ID NO: 9718 - DNA, 20 bp, Artificial Sequence
  sgRNA
  Adrb3_16
gcgaaactggttgcgaactg

SEQ ID NO: 9719 - DNA, 20 bp, Artificial Sequence
  sgRNA
  Adrb3_17
tggtactcctggcaacccac

SEQ ID NO: 9720 - DNA, 20 bp, Artificial Sequence
  sgRNA
  Adrb3_18
cgtcttctgtgtagctacgg

SEQ ID NO: 9721 - DNA, 20 bp, Artificial Sequence
  sgRNA
  Adrb3_19
gaggcaaaggaacagcagcg

SEQ ID NO: 9722 - DNA, 20 bp, Artificial Sequence
  sgRNA
  Adrb3_20
cgatggctatgattaccagc

SEQ ID NO: 9723 - DNA, 20 bp, Artificial Sequence
  sgRNA
  Ager_1
ccttacggtagactcggact

SEQ ID NO: 9724 - DNA, 20 bp, Artificial Sequence
  sgRNA
  Ager_2
ccactggaattgtcgatgag

SEQ ID NO: 9725 - DNA, 20 bp, Artificial Sequence
  sgRNA
  Ager_3
agacgggactctttacactg

SEQ ID NO: 9726 - DNA, 20 bp, Artificial Sequence
  sgRNA
  Ager_4
acttgtgctaagctgtaagg

SEQ ID NO: 9727 - DNA, 20 bp, Artificial Sequence
  sgRNA
  Ager_5
ggagtagtagccctgctcgt

SEQ ID NO: 9728 - DNA, 20 bp, Artificial Sequence
  sgRNA
  Ager_6
ttatccagtggacctgagga

SEQ ID NO: 9729 - DNA, 20 bp, Artificial Sequence
  sgRNA
  Ager_7
gggaaacttctgattcccga

SEQ ID NO: 9730 - DNA, 20 bp, Artificial Sequence
  sgRNA
  Ager_8
cctcgtgccccacctcaggg

SEQ ID NO: 9731 - DNA, 20 bp, Artificial Sequence
  sgRNA
  Ager_9
agtagtagccctgctcgtcg

SEQ ID NO: 9732 - DNA, 20 bp, Artificial Sequence
  sgRNA
  Ager_10
tgagggcacctatagctgcg

SEQ ID NO: 9733 - DNA, 20 bp, Artificial Sequence
  sgRNA
  Ager_11
attcgagccacgctgtccca

SEQ ID NO: 9734 - DNA, 20 bp, Artificial Sequence
  sgRNA
  Ager_12
gtcgggcaactaacaggcga

SEQ ID NO: 9735 - DNA, 20 bp, Artificial Sequence
  sgRNA
  Ager_13
ggtggaatagtcgctcctgg

SEQ ID NO: 9736 - DNA, 20 bp, Artificial Sequence
  sgRNA
  Ager_14
gctgaatcagtcagaggaag

SEQ ID NO: 9737 - DNA, 20 bp, Artificial Sequence
  sgRNA
  Ager_15
cccctcatcgacaattccag

SEQ ID NO: 9738 - DNA, 20 bp, Artificial Sequence
  sgRNA
  Ager_16
gtgttcaggggtctgcgccg

SEQ ID NO: 9739 - DNA, 20 bp, Artificial Sequence
  sgRNA
  Ager_17
tccggtgtcgggcaactaac

SEQ ID NO: 9740 - DNA, 20 bp, Artificial Sequence
  sgRNA
  Ager_18
gtagactcggactcggtagt

SEQ ID NO: 9741 - DNA, 20 bp, Artificial Sequence
  sgRNA
  Ager_19
tgtcgggcaactaacaggcg

SEQ ID NO: 9742 - DNA, 20 bp, Artificial Sequence
  sgRNA
  Ager_20
gtgtaaagagtcccgtctca

SEQ ID NO: 9743 - DNA, 20 bp, Artificial Sequence
  sgRNA
  Agtr1a_1
gggccagcggtattccatag

SEQ ID NO: 9744 - DNA, 20 bp, Artificial Sequence
  sgRNA
  Agtr1a_2
acacgtgagcaggaacacgc

SEQ ID NO: 9745 - DNA, 20 bp, Artificial Sequence
  sgRNA
  Agtr1a_3
tggttaggcccagtcctatg

SEQ ID NO: 9746 - DNA, 20 bp, Artificial Sequence
  sgRNA
  Agtr1a_4
ttacatgaagctgaagactg

SEQ ID NO: 9747 - DNA, 20 bp, Artificial Sequence
  sgRNA
  Agtr1a_5
ataccgctatggaataccgc

SEQ ID NO: 9748 - DNA, 20 bp, Artificial Sequence
  sgRNA
  Agtr1a_6
gctgagctcatgttatctga

SEQ ID NO: 9749 - DNA, 20 bp, Artificial Sequence
  sgRNA
  Agtr1a_7
ctttggccaccagcatcgtg

SEQ ID NO: 9750 - DNA, 20 bp, Artificial Sequence
  sgRNA
  Agtr1a_8
gcggtatagacagcccacag

SEQ ID NO: 9751 - DNA, 20 bp, Artificial Sequence
  sgRNA
  Agtr1a_9
tcatcgggtggacaatggcc

SEQ ID NO: 9752 - DNA, 20 bp, Artificial Sequence
  sgRNA
  Agtr1a_10
tggccaccagcatcgtgcgg

SEQ ID NO: 9753 - DNA, 20 bp, Artificial Sequence
  sgRNA
  Agtr1a_11
ggaatgtgaatatttggtgg

SEQ ID NO: 9754 - DNA, 20 bp, Artificial Sequence
  sgRNA
  Agtr1a_12
aattcaagatgactgcccca

SEQ ID NO: 9755 - DNA, 20 bp, Artificial Sequence
  sgRNA
  Agtr1a_13
aactgtgcctgccagccctg

SEQ ID NO: 9756 - DNA, 20 bp, Artificial Sequence
  sgRNA
  Agtr1a_14
tcaacgctccccataggact

SEQ ID NO: 9757 - DNA, 20 bp, Artificial Sequence
  sgRNA
  Agtr1a_15
ggaaagggaacaggaagccc

SEQ ID NO: 9758 - DNA, 20 bp, Artificial Sequence
  sgRNA
  Agtr1a_16
ggcctaaccaagaacatcct

SEQ ID NO: 9759 - DNA, 20 bp, Artificial Sequence
  sgRNA
  Agtr1a_17
tagcggtatagacagcccac

SEQ ID NO: 9760 - DNA, 20 bp, Artificial Sequence
  sgRNA
  Agtr1a_18
tttgctgactttgcccctgt

SEQ ID NO: 9761 - DNA, 20 bp, Artificial Sequence
  sgRNA
  Agtr1a_19
ctttcttctaaatctcgccc

SEQ ID NO: 9762 - DNA, 20 bp, Artificial Sequence
  sgRNA
  Agtr1a_20
agcggtatagacagcccaca

SEQ ID NO: 9763 - DNA, 20 bp, Artificial Sequence
  sgRNA
  Agtr1b_1
ataccgctatggaataccag

SEQ ID NO: 9764 - DNA, 20 bp, Artificial Sequence
  sgRNA
  Agtr1b_2
tggtcagacccagtccaatg

SEQ ID NO: 9765 - DNA, 20 bp, Artificial Sequence
  sgRNA
  Agtr1b_3
tggcgaccagcattgtgcgt

SEQ ID NO: 9766 - DNA, 20 bp, Artificial Sequence
  sgRNA
  Agtr1b_4
aaattcagaagaatacgcca

SEQ ID NO: 9767 - DNA, 20 bp, Artificial Sequence
  sgRNA
  Agtr1b_5
agctcatgttatctgaaggg

SEQ ID NO: 9768 - DNA, 20 bp, Artificial Sequence
  sgRNA
  Agtr1b_6
gggccactggtattccatag

SEQ ID NO: 9769 - DNA, 20 bp, Artificial Sequence
  sgRNA
  Agtr1b_7
cagaactcaacactccccat

SEQ ID NO: 9770 - DNA, 20 bp, Artificial Sequence
  sgRNA
  Agtr1b_8
ccagaaagccataaaacaga

SEQ ID NO: 9771 - DNA, 20 bp, Artificial Sequence
  sgRNA
  Agtr1b_9
tttccttctgaatcttgccc

SEQ ID NO: 9772 - DNA, 20 bp, Artificial Sequence
  sgRNA
  Agtr1b_10
ataacatgagctcgtctgcc

SEQ ID NO: 9773 - DNA, 20 bp, Artificial Sequence
  sgRNA
  Agtr1b_11
aatatattcccccaaaggcc

SEQ ID NO: 9774 - DNA, 20 bp, Artificial Sequence
  sgRNA
  Agtr1b_12
gcggtataaactgcccacag

SEQ ID NO: 9775 - DNA, 20 bp, Artificial Sequence
  sgRNA
  Agtr1b_13
tcattgggtggacaatggct

SEQ ID NO: 9776 - DNA, 20 bp, Artificial Sequence
  sgRNA
  Agtr1b_14
aattgtgcctgccagccttg

SEQ ID NO: 9777 - DNA, 20 bp, Artificial Sequence
  sgRNA
  Agtr1b_15
caaaaagcataaatcagcca

SEQ ID NO: 9778 - DNA, 20 bp, Artificial Sequence
  sgRNA
  Agtr1b_16
aatccaagatgactgcccca

SEQ ID NO: 9779 - DNA, 20 bp, Artificial Sequence
  sgRNA
  Agtr1b_17
tcaacactccccattggact

SEQ ID NO: 9780 - DNA, 20 bp, Artificial Sequence
  sgRNA
  Agtr1b_18
gttaaaataagctatgcaga

SEQ ID NO: 9781 - DNA, 20 bp, Artificial Sequence
  sgRNA
  Agtr1b_19
ctggatgtgctcattcagct

SEQ ID NO: 9782 - DNA, 20 bp, Artificial Sequence
  sgRNA
  Agtr1b_20
gtgggcagtttataccgcta

SEQ ID NO: 9783 - DNA, 20 bp, Artificial Sequence
  sgRNA
  Agtr2_1
gtacctatcgacactcatgc

SEQ ID NO: 9784 - DNA, 20 bp, Artificial Sequence
  sgRNA
  Agtr2_2
acaagccatacaccaaacaa

SEQ ID NO: 9785 - DNA, 20 bp, Artificial Sequence
  sgRNA
  Agtr2_3
actgagcatatttctcgggt

SEQ ID NO: 9786 - DNA, 20 bp, Artificial Sequence
  sgRNA
  Agtr2_4
tttgtgtgagcaattaaagg

SEQ ID NO: 9787 - DNA, 20 bp, Artificial Sequence
  sgRNA
  Agtr2_5
gagtgtcgataggtaccaat

SEQ ID NO: 9788 - DNA, 20 bp, Artificial Sequence
  sgRNA
  Agtr2_6
actacataagatgcttgcca

SEQ ID NO: 9789 - DNA, 20 bp, Artificial Sequence
  sgRNA
  Agtr2_7
gcttccaaatgcttatctga

SEQ ID NO: 9790 - DNA, 20 bp, Artificial Sequence
  sgRNA
  Agtr2_8
gttgcgttgagattatcaaa

SEQ ID NO: 9791 - DNA, 20 bp, Artificial Sequence
  sgRNA
  Agtr2_9
tgggaactctaaacacactg

SEQ ID NO: 9792 - DNA, 20 bp, Artificial Sequence
  sgRNA
  Agtr2_10
ttacctgcatgagtgtcgat

SEQ ID NO: 9793 - DNA, 20 bp, Artificial Sequence
  sgRNA
  Agtr2_11
cttgccttggagccaagtaa

SEQ ID NO: 9794 - DNA, 20 bp, Artificial Sequence
  sgRNA
  Agtr2_12
gctgctggtaatgtttctgc

SEQ ID NO: 9795 - DNA, 20 bp, Artificial Sequence
  sgRNA
  Agtr2_13
tgctgaagactaatagctat

SEQ ID NO: 9796 - DNA, 20 bp, Artificial Sequence
  sgRNA
  Agtr2_14
cacccgagaaatatgctcag

SEQ ID NO: 9797 - DNA, 20 bp, Artificial Sequence
  sgRNA
  Agtr2_15
attcacacctaagtattcaa

SEQ ID NO: 9798 - DNA, 20 bp, Artificial Sequence
  sgRNA
  Agtr2_16
aataggttgcccagagaggg

SEQ ID NO: 9799 - DNA, 20 bp, Artificial Sequence
  sgRNA
  Agtr2_17
cgttgagattatcaaaagga

SEQ ID NO: 9800 - DNA, 20 bp, Artificial Sequence
  sgRNA
  Agtr2_18
aagaaggtcagaacatggaa

SEQ ID NO: 9801 - DNA, 20 bp, Artificial Sequence
  sgRNA
  Agtr2_19
ataggttgcccagagaggga

SEQ ID NO: 9802 - DNA, 20 bp, Artificial Sequence
  sgRNA
  Agtr2_20
gaaaagggtagatgaccgat

SEQ ID NO: 9803 - DNA, 20 bp, Artificial Sequence
  sgRNA
  Ajap1_1
ttcaacgatttcgacttccg

SEQ ID NO: 9804 - DNA, 20 bp, Artificial Sequence
  sgRNA
  Ajap1_2
tgcgaagtggacccccaacg

SEQ ID NO: 9805 - DNA, 20 bp, Artificial Sequence
  sgRNA
  Ajap1_3
gccaccctcggacccaaagg

SEQ ID NO: 9806 - DNA, 20 bp, Artificial Sequence
  sgRNA
  Ajap1_4
gcaaacacggaagacaacgg

SEQ ID NO: 9807 - DNA, 20 bp, Artificial Sequence
  sgRNA
  Ajap1_5
cgagacgctgcactcgaccg

SEQ ID NO: 9808 - DNA, 20 bp, Artificial Sequence
  sgRNA
  Ajap1_6
ggataggcatctcatccctg

SEQ ID NO: 9809 - DNA, 20 bp, Artificial Sequence
  sgRNA
  Ajap1_7
ggaaagacatccagcccccg

SEQ ID NO: 9810 - DNA, 20 bp, Artificial Sequence
  sgRNA
  Ajap1_8
cgttgtgctaaccccaacag

SEQ ID NO: 9811 - DNA, 20 bp, Artificial Sequence
  sgRNA
  Ajap1_9
gccatgacactgcagactaa

SEQ ID NO: 9812 - DNA, 20 bp, Artificial Sequence
  sgRNA
  Ajap1_10
ccagcccccgaggatcttag

SEQ ID NO: 9813 - DNA, 20 bp, Artificial Sequence
  sgRNA
  Ajap1_11
ggtcgagtgcagcgtctcgt

SEQ ID NO: 9814 - DNA, 20 bp, Artificial Sequence
  sgRNA
  Ajap1_12
ggtctcccctaagatcctcg

SEQ ID NO: 9815 - DNA, 20 bp, Artificial Sequence
  sgRNA
  Ajap1_13
atgaggccgtcgcagaggcg

SEQ ID NO: 9816 - DNA, 20 bp, Artificial Sequence
  sgRNA
  Ajap1_14
ggaggatgaggccgtcgcag

SEQ ID NO: 9817 - DNA, 20 bp, Artificial Sequence
  sgRNA
  Ajap1_15
ggagagttgccagaacttga

SEQ ID NO: 9818 - DNA, 20 bp, Artificial Sequence
  sgRNA
  Ajap1_16
gaacttgacggacttcaccc

SEQ ID NO: 9819 - DNA, 20 bp, Artificial Sequence
  sgRNA
  Ajap1_17
gtgaagatgtccacactgct

SEQ ID NO: 9820 - DNA, 20 bp, Artificial Sequence
  sgRNA
  Ajap1_18
gtgttctcacgagtgtgtca

SEQ ID NO: 9821 - DNA, 20 bp, Artificial Sequence
  sgRNA
  Ajap1_19
tggtggggccgaaaccacca

SEQ ID NO: 9822 - DNA, 20 bp, Artificial Sequence
  sgRNA
  Ajap1_20
gagtacaagtccacattcaa

SEQ ID NO: 9823 - DNA, 20 bp, Artificial Sequence
  sgRNA
  Akp3_1
tgttcgacttagccatcgag

SEQ ID NO: 9824 - DNA, 20 bp, Artificial Sequence
  sgRNA
  Akp3_2
gtgtgaacatatgtgcccga

SEQ ID NO: 9825 - DNA, 20 bp, Artificial Sequence
  sgRNA
  Akp3_3
ctgtccccagacatacagtg

SEQ ID NO: 9826 - DNA, 20 bp, Artificial Sequence
  sgRNA
  Akp3_4
gttgcactggtcgaatctcg

SEQ ID NO: 9827 - DNA, 20 bp, Artificial Sequence
  sgRNA
  Akp3_5
gtgaagtcggagacccacgg

SEQ ID NO: 9828 - DNA, 20 bp, Artificial Sequence
  sgRNA
  Akp3_6
gcaaccttcccgcagcgcag

SEQ ID NO: 9829 - DNA, 20 bp, Artificial Sequence
  sgRNA
  Akp3_7
ggtggtggtcaccacaccta

SEQ ID NO: 9830 - DNA, 20 bp, Artificial Sequence
  sgRNA
  Akp3_8
ctgtgcccagatggtgacca

SEQ ID NO: 9831 - DNA, 20 bp, Artificial Sequence
  sgRNA
  Akp3_9
gaccccacacaggtaggcgg

SEQ ID NO: 9832 - DNA, 20 bp, Artificial Sequence
  sgRNA
  Akp3_10
tctggcgctgttatggaccg

SEQ ID NO: 9833 - DNA, 20 bp, Artificial Sequence
  sgRNA
  Akp3_11
agttggtcttgaccccacac

SEQ ID NO: 9834 - DNA, 20 bp, Artificial Sequence
  sgRNA
  Akp3_12
ccgtgggtctccgacttcac

SEQ ID NO: 9835 - DNA, 20 bp, Artificial Sequence
  sgRNA
  Akp3_13
gctcccctcaatgctctgga

SEQ ID NO: 9836 - DNA, 20 bp, Artificial Sequence
  sgRNA
  Akp3_14
ctggaacaagaaggcagccg

SEQ ID NO: 9837 - DNA, 20 bp, Artificial Sequence
  sgRNA
  Akp3_15
agtgaaccgcaattggtatg

SEQ ID NO: 9838 - DNA, 20 bp, Artificial Sequence
  sgRNA
  Akp3_16
ttggtggctacacacttcga

SEQ ID NO: 9839 - DNA, 20 bp, Artificial Sequence
  sgRNA
  Akp3_17
cccaggctatgtcggtacag

SEQ ID NO: 9840 - DNA, 20 bp, Artificial Sequence
  sgRNA
  Akp3_18
gagctggctggccctctcga

SEQ ID NO: 9841 - DNA, 20 bp, Artificial Sequence
  sgRNA
  Akp3_19
acaactcattcagaaggccc

SEQ ID NO: 9842 - DNA, 20 bp, Artificial Sequence
  sgRNA
  Akp3_20
gagactggaaccagattgga

SEQ ID NO: 9843 - DNA, 20 bp, Artificial Sequence
  sgRNA
  Alcam_1
tgcaagtaggaacgcgactg

SEQ ID NO: 9844 - DNA, 20 bp, Artificial Sequence
  sgRNA
  Alcam_2
ctgaacaccttgactagggt

SEQ ID NO: 9845 - DNA, 20 bp, Artificial Sequence
  sgRNA
  Alcam_3
ggttgtcttgtactccaagg

SEQ ID NO: 9846 - DNA, 20 bp, Artificial Sequence
  sgRNA
  Alcam_4
actttcaggaaaagcccgat

SEQ ID NO: 9847 - DNA, 20 bp, Artificial Sequence
  sgRNA
  Alcam_5
gctttggaaacccttccacg

SEQ ID NO: 9848 - DNA, 20 bp, Artificial Sequence
  sgRNA
  Alcam_6
gtagacgacaccagcaacga

SEQ ID NO: 9849 - DNA, 20 bp, Artificial Sequence
  sgRNA
  Alcam_7
agtagacgacaccagcaacg

SEQ ID NO: 9850 - DNA, 20 bp, Artificial Sequence
  sgRNA
  Alcam_8
ctgcctcttgatctccgccg

SEQ ID NO: 9851 - DNA, 20 bp, Artificial Sequence
  sgRNA
  Alcam_9
gagacggcaaggcatgacaa

SEQ ID NO: 9852 - DNA, 20 bp, Artificial Sequence
  sgRNA
  Alcam_10
ctataatctgccacgtggaa

SEQ ID NO: 9853 - DNA, 20 bp, Artificial Sequence
  sgRNA
  Alcam_11
atgtgagacgcaatgccaca

SEQ ID NO: 9854 - DNA, 20 bp, Artificial Sequence
  sgRNA
  Alcam_12
gatttatccttaaacccaag

SEQ ID NO: 9855 - DNA, 20 bp, Artificial Sequence
  sgRNA
  Alcam_13
ttaatgttacattctcctca

SEQ ID NO: 9856 - DNA, 20 bp, Artificial Sequence
  sgRNA
  Alcam_14
ggttctgaggtacatcgaga

SEQ ID NO: 9857 - DNA, 20 bp, Artificial Sequence
  sgRNA
  Alcam_15
aatgctcactcattgacaaa

SEQ ID NO: 9858 - DNA, 20 bp, Artificial Sequence
  sgRNA
  Alcam_16
gcttggtcacctccccactt

SEQ ID NO: 9859 - DNA, 20 bp, Artificial Sequence
  sgRNA
  Alcam_17
gccattccccaaacactgaa

SEQ ID NO: 9860 - DNA, 20 bp, Artificial Sequence
  sgRNA
  Alcam_18
gtataccgtgacttcctcct

SEQ ID NO: 9861 - DNA, 20 bp, Artificial Sequence
  sgRNA
  Alcam_19
taaaactataatctgccacg

SEQ ID NO: 9862 - DNA, 20 bp, Artificial Sequence
  sgRNA
  Alcam_20
agtctccttatattaatggc

SEQ ID NO: 9863 - DNA, 20 bp, Artificial Sequence
  sgRNA
  Alk_1
tgggcaacatatctccccga

SEQ ID NO: 9864 - DNA, 20 bp, Artificial Sequence
  sgRNA
  Alk_2
gaattccaacttgagcgtgg

SEQ ID NO: 9865 - DNA, 20 bp, Artificial Sequence
  sgRNA
  Alk_3
tacacttaccatatcgactg

SEQ ID NO: 9866 - DNA, 20 bp, Artificial Sequence
  sgRNA
  Alk_4
ggggtgtacaggatacccaa

SEQ ID NO: 9867 - DNA, 20 bp, Artificial Sequence
  sgRNA
  Alk_5
gcatagacgcggaagagcga

SEQ ID NO: 9868 - DNA, 20 bp, Artificial Sequence
  sgRNA
  Alk_6
gcttgatattcacttccccg

SEQ ID NO: 9869 - DNA, 20 bp, Artificial Sequence
  sgRNA
  Alk_7
catgcgccccaaagaccccg

SEQ ID NO: 9870 - DNA, 20 bp, Artificial Sequence
  sgRNA
  Alk_8
actactggaccgtattcgat

SEQ ID NO: 9871 - DNA, 20 bp, Artificial Sequence
  sgRNA
  Alk_9
ggttgcagctccggagtacg

SEQ ID NO: 9872 - DNA, 20 bp, Artificial Sequence
  sgRNA
  Alk_10
cgtttcctctcaaaaccccg

SEQ ID NO: 9873 - DNA, 20 bp, Artificial Sequence
  sgRNA
  Alk_11
agttccagcaggatgaagcg

SEQ ID NO: 9874 - DNA, 20 bp, Artificial Sequence
  sgRNA
  Alk_12
tgcaggcgcgaataactgag

SEQ ID NO: 9875 - DNA, 20 bp, Artificial Sequence
  sgRNA
  Alk_13
ccatagttgacattgccgca

SEQ ID NO: 9876 - DNA, 20 bp, Artificial Sequence
  sgRNA
  Alk_14
tgcgccccaaagaccccgag

SEQ ID NO: 9877 - DNA, 20 bp, Artificial Sequence
  sgRNA
  Alk_15
tggcaaccggagcttgtcgg

SEQ ID NO: 9878 - DNA, 20 bp, Artificial Sequence
  sgRNA
  Alk_16
gctgcaaccgatcagcgcgc

SEQ ID NO: 9879 - DNA, 20 bp, Artificial Sequence
  sgRNA
  Alk_17
ggtggattctccacggcgaa

SEQ ID NO: 9880 - DNA, 20 bp, Artificial Sequence
  sgRNA
  Alk_18
aatccaccgccgacaagctc

SEQ ID NO: 9881 - DNA, 20 bp, Artificial Sequence
  sgRNA
  Alk_19
agccagttctcctagtcccg

SEQ ID NO: 9882 - DNA, 20 bp, Artificial Sequence
  sgRNA
  Alk_20
acatccttgtcggtcagcaa

SEQ ID NO: 9883 - DNA, 20 bp, Artificial Sequence
  sgRNA
  Alpi_1
aaactaaggtattacccatg

SEQ ID NO: 9884 - DNA, 20 bp, Artificial Sequence
  sgRNA
  Alpi_2
aaggccaactacaagaccat

SEQ ID NO: 9885 - DNA, 20 bp, Artificial Sequence
  sgRNA
  Alpi_3
agccggcacctacgcacaca

SEQ ID NO: 9886 - DNA, 20 bp, Artificial Sequence
  sgRNA
  Alpi_4
acagtaaccagtctggaacc

SEQ ID NO: 9887 - DNA, 20 bp, Artificial Sequence
  sgRNA
  Alpi_5
gacgtggccatatttgcgcg

SEQ ID NO: 9888 - DNA, 20 bp, Artificial Sequence
  sgRNA
  Alpi_6
gggagtggtgaccacgacca

SEQ ID NO: 9889 - DNA, 20 bp, Artificial Sequence
  sgRNA
  Alpi_7
ccatgaggtgagttactgct

SEQ ID NO: 9890 - DNA, 20 bp, Artificial Sequence
  sgRNA
  Alpi_8
tattgaccaaggccaccatg

SEQ ID NO: 9891 - DNA, 20 bp, Artificial Sequence
  sgRNA
  Alpi_9
gttcgactctgccatcgaaa

SEQ ID NO: 9892 - DNA, 20 bp, Artificial Sequence
  sgRNA
  Alpi_10
gcgcacgtcatggcattcgc

SEQ ID NO: 9893 - DNA, 20 bp, Artificial Sequence
  sgRNA
  Alpi_11
ttagagccctacaccgactg

SEQ ID NO: 9894 - DNA, 20 bp, Artificial Sequence
  sgRNA
  Alpi_12
tgaactttcggcctccaccg

SEQ ID NO: 9895 - DNA, 20 bp, Artificial Sequence
  sgRNA
  Alpi_13
gcagccgtcctgcagtgcag

SEQ ID NO: 9896 - DNA, 20 bp, Artificial Sequence
  sgRNA
  Alpi_14
ggccaccaccacaaacaacg

SEQ ID NO: 9897 - DNA, 20 bp, Artificial Sequence
  sgRNA
  Alpi_15
ccacctctgtcatctccgcc

SEQ ID NO: 9898 - DNA, 20 bp, Artificial Sequence
  sgRNA
  Alpi_16
gtctactgaggggtttcggt

SEQ ID NO: 9899 - DNA, 20 bp, Artificial Sequence
  sgRNA
  Alpi_17
ctcagtagacccttccctgg

SEQ ID NO: 9900 - DNA, 20 bp, Artificial Sequence
  sgRNA
  Alpi_18
atgcctgaatgagctctgat

SEQ ID NO: 9901 - DNA, 20 bp, Artificial Sequence
  sgRNA
  Alpi_19
cagccaccaggatcctaaag

SEQ ID NO: 9902 - DNA, 20 bp, Artificial Sequence
  sgRNA
  Alpi_20
cctgcctctgcactgcagga

SEQ ID NO: 9903 - DNA, 20 bp, Artificial Sequence
  sgRNA
  Alpl_1
ggataacgagatgccaccag

SEQ ID NO: 9904 - DNA, 20 bp, Artificial Sequence
  sgRNA
  Alpl_2
ctaggaggcaggattgacca

SEQ ID NO: 9905 - DNA, 20 bp, Artificial Sequence
  sgRNA
  Alpl_3
acctaagaggtagtccaccc

SEQ ID NO: 9906 - DNA, 20 bp, Artificial Sequence
  sgRNA
  Alpl_4
gttgcatcgcgtgcgctctg

SEQ ID NO: 9907 - DNA, 20 bp, Artificial Sequence
  sgRNA
  Alpl_5
atccgagtaccagtcccgat

SEQ ID NO: 9908 - DNA, 20 bp, Artificial Sequence
  sgRNA
  Alpl_6
tgtggcgtgaaggccaacga

SEQ ID NO: 9909 - DNA, 20 bp, Artificial Sequence
  sgRNA
  Alpl_7
cattcggtggatacaccccc

SEQ ID NO: 9910 - DNA, 20 bp, Artificial Sequence
  sgRNA
  Alpl_8
cacgccacacaagtaggcag

SEQ ID NO: 9911 - DNA, 20 bp, Artificial Sequence
  sgRNA
  Alpl_9
tgtggcgtggttcacccgag

SEQ ID NO: 9912 - DNA, 20 bp, Artificial Sequence
  sgRNA
  Alpl_10
ggtctttgccaagggcccga

SEQ ID NO: 9913 - DNA, 20 bp, Artificial Sequence
  sgRNA
  Alpl_11
tgggcattgtgactaccact

SEQ ID NO: 9914 - DNA, 20 bp, Artificial Sequence
  sgRNA
  Alpl_12
agtggtagtcacaatgccca

SEQ ID NO: 9915 - DNA, 20 bp, Artificial Sequence
  sgRNA
  Alpl_13
gctgtcagggacctgagcgt

SEQ ID NO: 9916 - DNA, 20 bp, Artificial Sequence
  sgRNA
  Alpl_14
ggtcacatccatcctgcgct

SEQ ID NO: 9917 - DNA, 20 bp, Artificial Sequence
  sgRNA
  Alpl_15
ccaccatctcggagagcgaa

SEQ ID NO: 9918 - DNA, 20 bp, Artificial Sequence
  sgRNA
  Alpl_16
aggcccgttaccatatagga

SEQ ID NO: 9919 - DNA, 20 bp, Artificial Sequence
  sgRNA
  Alpl_17
ccttaccctcatgatgtccg

SEQ ID NO: 9920 - DNA, 20 bp, Artificial Sequence
  sgRNA
  Alpl_18
cttgtccgtgtcgctcacca

SEQ ID NO: 9921 - DNA, 20 bp, Artificial Sequence
  sgRNA
  Alpl_19
gcccttaaggattcgggcag

SEQ ID NO: 9922 - DNA, 20 bp, Artificial Sequence
  sgRNA
  Alpl_20
ccgtgggtctcatggcgcag

SEQ ID NO: 9923 - DNA, 20 bp, Artificial Sequence
  sgRNA
  Alppl2_1
caacacgacatggggtaacg

SEQ ID NO: 9924 - DNA, 20 bp, Artificial Sequence
  sgRNA
  Alppl2_2
gtgcatccgagtaccaacca

SEQ ID NO: 9925 - DNA, 20 bp, Artificial Sequence
  sgRNA
  Alppl2_3
aatgcaagttattacccatg

SEQ ID NO: 9926 - DNA, 20 bp, Artificial Sequence
  sgRNA
  Alppl2_4
gataggctacagtttcatgg

SEQ ID NO: 9927 - DNA, 20 bp, Artificial Sequence
  sgRNA
  Alppl2_5
acctcgatactatacggcaa

SEQ ID NO: 9928 - DNA, 20 bp, Artificial Sequence
  sgRNA
  Alppl2_6
gggagtggtgaccaccacgt

SEQ ID NO: 9929 - DNA, 20 bp, Artificial Sequence
  sgRNA
  Alppl2_7
tgaacttgcggccaccaccg

SEQ ID NO: 9930 - DNA, 20 bp, Artificial Sequence
  sgRNA
  Alppl2_8
accgttgccgtatagtatcg

SEQ ID NO: 9931 - DNA, 20 bp, Artificial Sequence
  sgRNA
  Alppl2_9
ctgtcgtcagagacccacag

SEQ ID NO: 9932 - DNA, 20 bp, Artificial Sequence
  sgRNA
  Alppl2_10
gacgcaacctagttcaagag

SEQ ID NO: 9933 - DNA, 20 bp, Artificial Sequence
  sgRNA
  Alppl2_11
tacgcgcacactgtgaaccg

SEQ ID NO: 9934 - DNA, 20 bp, Artificial Sequence
  sgRNA
  Alppl2_12
tgtctacagtaaccgctacc

SEQ ID NO: 9935 - DNA, 20 bp, Artificial Sequence
  sgRNA
  Alppl2_13
atatccaactgacaccaagc

SEQ ID NO: 9936 - DNA, 20 bp, Artificial Sequence
  sgRNA
  Alppl2_14
aggtacagcctttctctgcg

SEQ ID NO: 9937 - DNA, 20 bp, Artificial Sequence
  sgRNA
  Alppl2_15
agaagcatgctgcaccgacg

SEQ ID NO: 9938 - DNA, 20 bp, Artificial Sequence
  sgRNA
  Alppl2_16
tggtggttacacacagagag

SEQ ID NO: 9939 - DNA, 20 bp, Artificial Sequence
  sgRNA
  Alppl2_17
cgatctgtgacacacctcat

SEQ ID NO: 9940 - DNA, 20 bp, Artificial Sequence
  sgRNA
  Alppl2_18
tgacgctcgggcacacctgt

SEQ ID NO: 9941 - DNA, 20 bp, Artificial Sequence
  sgRNA
  Alppl2_19
ctggaaccgaaaggcagccg

SEQ ID NO: 9942 - DNA, 20 bp, Artificial Sequence
  sgRNA
  Alppl2_20
cttcctcagtgacatcagcc

SEQ ID NO: 9943 - DNA, 20 bp, Artificial Sequence
  sgRNA
  Amhr2_1
agataggtcatgcgccatcg

SEQ ID NO: 9944 - DNA, 20 bp, Artificial Sequence
  sgRNA
  Amhr2_2
actcagtacacgagcgactg

SEQ ID NO: 9945 - DNA, 20 bp, Artificial Sequence
  sgRNA
  Amhr2_3
aggcagcggatacccttggg

SEQ ID NO: 9946 - DNA, 20 bp, Artificial Sequence
  sgRNA
  Amhr2_4
acaacacgagaaacattccc

SEQ ID NO: 9947 - DNA, 20 bp, Artificial Sequence
  sgRNA
  Amhr2_5
gatcgggactcctagagcca

SEQ ID NO: 9948 - DNA, 20 bp, Artificial Sequence
  sgRNA
  Amhr2_6
ggagccccttggtttcccga

SEQ ID NO: 9949 - DNA, 20 bp, Artificial Sequence
  sgRNA
  Amhr2_7
cagaccaccacctttccaat

SEQ ID NO: 9950 - DNA, 20 bp, Artificial Sequence
  sgRNA
  Amhr2_8
gcctccttcgggaaaccaag

SEQ ID NO: 9951 - DNA, 20 bp, Artificial Sequence
  sgRNA
  Amhr2_9
gcgactggggaagttccttg

SEQ ID NO: 9952 - DNA, 20 bp, Artificial Sequence
  sgRNA
  Amhr2_10
gggacgcagacccagaagca

SEQ ID NO: 9953 - DNA, 20 bp, Artificial Sequence
  sgRNA
  Amhr2_11
aggagacaagaactctgctg

SEQ ID NO: 9954 - DNA, 20 bp, Artificial Sequence
  sgRNA
  Amhr2_12
aactctgctgaggccgacag

SEQ ID NO: 9955 - DNA, 20 bp, Artificial Sequence
  sgRNA
  Amhr2_13
tctaggagtcccgatcctgt

SEQ ID NO: 9956 - DNA, 20 bp, Artificial Sequence
  sgRNA
  Amhr2_14
gagcagcagtgccatccaga

SEQ ID NO: 9957 - DNA, 20 bp, Artificial Sequence
  sgRNA
  Amhr2_15
gttctgcctcataagccaat

SEQ ID NO: 9958 - DNA, 20 bp, Artificial Sequence
  sgRNA
  Amhr2_16
tctccacgaggagcgttggc

SEQ ID NO: 9959 - DNA, 20 bp, Artificial Sequence
  sgRNA
  Amhr2_17
tttgaggctcctggagtgcg

SEQ ID NO: 9960 - DNA, 20 bp, Artificial Sequence
  sgRNA
  Amhr2_18
ggtacacagccctctcagct

SEQ ID NO: 9961 - DNA, 20 bp, Artificial Sequence
  sgRNA
  Amhr2_19
catcctgccaacgctcctcg

SEQ ID NO: 9962 - DNA, 20 bp, Artificial Sequence
  sgRNA
  Amhr2_20
gggtacagctctccagagag

SEQ ID NO: 9963 - DNA, 20 bp, Artificial Sequence
  sgRNA
  Amigo1_1
gcttgcagtcgcactccaag

SEQ ID NO: 9964 - DNA, 20 bp, Artificial Sequence
  sgRNA
  Amigo1_2
cgggacaactaaccacagat

SEQ ID NO: 9965 - DNA, 20 bp, Artificial Sequence
  sgRNA
  Amigo1_3
agtacctaaggttgggtacg

SEQ ID NO: 9966 - DNA, 20 bp, Artificial Sequence
  sgRNA
  Amigo1_4
gcaaggcatgaccaaagtgt

SEQ ID NO: 9967 - DNA, 20 bp, Artificial Sequence
  sgRNA
  Amigo1_5
gtatacctgttacgccatgg

SEQ ID NO: 9968 - DNA, 20 bp, Artificial Sequence
  sgRNA
  Amigo1_6
ctacaggcaagggccaacgg

SEQ ID NO: 9969 - DNA, 20 bp, Artificial Sequence
  sgRNA
  Amigo1_7
acaactaaccacagatcggc

SEQ ID NO: 9970 - DNA, 20 bp, Artificial Sequence
  sgRNA
  Amigo1_8
gcagcctgctcaagttgttg

SEQ ID NO: 9971 - DNA, 20 bp, Artificial Sequence
  sgRNA
  Amigo1_9
gttccaggaaggccacccgc

SEQ ID NO: 9972 - DNA, 20 bp, Artificial Sequence
  sgRNA
  Amigo1_10
gtatagcccattcttgaccc

SEQ ID NO: 9973 - DNA, 20 bp, Artificial Sequence
  sgRNA
  Amigo1_11
cctgaacttcatctcctccg

SEQ ID NO: 9974 - DNA, 20 bp, Artificial Sequence
  sgRNA
  Amigo1_12
tctttgtccccaccagccat

SEQ ID NO: 9975 - DNA, 20 bp, Artificial Sequence
  sgRNA
  Amigo1_13
tcgtccccgtacccaacctt

SEQ ID NO: 9976 - DNA, 20 bp, Artificial Sequence
  sgRNA
  Amigo1_14
ggtgggctgtatcctcagtg

SEQ ID NO: 9977 - DNA, 20 bp, Artificial Sequence
  sgRNA
  Amigo1_15
atacctgcataacaacccct

SEQ ID NO: 9978 - DNA, 20 bp, Artificial Sequence
  sgRNA
  Amigo1_16
gttcagcgacctgcaggcgc

SEQ ID NO: 9979 - DNA, 20 bp, Artificial Sequence
  sgRNA
  Amigo1_17
actgccagtgcgaaaagagc

SEQ ID NO: 9980 - DNA, 20 bp, Artificial Sequence
  sgRNA
  Amigo1_18
tgagcaggctgcgggccgag

SEQ ID NO: 9981 - DNA, 20 bp, Artificial Sequence
  sgRNA
  Amigo1_19
gcatgcagtacaggtcctcc

SEQ ID NO: 9982 - DNA, 20 bp, Artificial Sequence
  sgRNA
  Amigo1_20
aggcctcgcaggtcacgctg

SEQ ID NO: 9983 - DNA, 20 bp, Artificial Sequence
  sgRNA
  Amigo2_1
accatataaacttagtgccg

SEQ ID NO: 9984 - DNA, 20 bp, Artificial Sequence
  sgRNA
  Amigo2_2
atgactatacctgtcgcctg

SEQ ID NO: 9985 - DNA, 20 bp, Artificial Sequence
  sgRNA
  Amigo2_3
cgtggataaagccaagtgcg

SEQ ID NO: 9986 - DNA, 20 bp, Artificial Sequence
  sgRNA
  Amigo2_4
ggtgcagctgacaatgtcgg

SEQ ID NO: 9987 - DNA, 20 bp, Artificial Sequence
  sgRNA
  Amigo2_5
agtgagaccgttatagccga

SEQ ID NO: 9988 - DNA, 20 bp, Artificial Sequence
  sgRNA
  Amigo2_6
tatggtgcatcggtatggaa

SEQ ID NO: 9989 - DNA, 20 bp, Artificial Sequence
  sgRNA
  Amigo2_7
gtctggacttatcatccaat

SEQ ID NO: 9990 - DNA, 20 bp, Artificial Sequence
  sgRNA
  Amigo2_8
tgcgatacaagaatataccc

SEQ ID NO: 9991 - DNA, 20 bp, Artificial Sequence
  sgRNA
  Amigo2_9
ggagcccctgaaggacacgg

SEQ ID NO: 9992 - DNA, 20 bp, Artificial Sequence
  sgRNA
  Amigo2_10
gtatactgggaggttcaagc

SEQ ID NO: 9993 - DNA, 20 bp, Artificial Sequence
  sgRNA
  Amigo2_11
aaagccccccgaacgctgcg

SEQ ID NO: 9994 - DNA, 20 bp, Artificial Sequence
  sgRNA
  Amigo2_12
gggcatcttaaagtccacca

SEQ ID NO: 9995 - DNA, 20 bp, Artificial Sequence
  sgRNA
  Amigo2_13
cgcccacgaggcgtttaaca

SEQ ID NO: 9996 - DNA, 20 bp, Artificial Sequence
  sgRNA
  Amigo2_14
gctttgcatttgcatgggca

SEQ ID NO: 9997 - DNA, 20 bp, Artificial Sequence
  sgRNA
  Amigo2_15
cagtgagaccgttatagccg

SEQ ID NO: 9998 - DNA, 20 bp, Artificial Sequence
  sgRNA
  Amigo2_16
gtatcgcaatgaacaggcag

SEQ ID NO: 9999 - DNA, 20 bp, Artificial Sequence
  sgRNA
  Amigo2_17
cggctataacggtctcactg

SEQ ID NO: 10000 - DNA, 20 bp, Artificial Sequence
  sgRNA
  Amigo2_18
tgcctctgctgacgatcgga

SEQ ID NO: 10001 - DNA, 20 bp, Artificial Sequence
  sgRNA
  Amigo2_19
ggagtcagaccacaggcgac

SEQ ID NO: 10002 - DNA, 20 bp, Artificial Sequence
  sgRNA
  Amigo2_20
gcggctgttaaacgagacgg

SEQ ID NO: 10003 - DNA, 20 bp, Artificial Sequence
  sgRNA
  Amigo3_1
gcccgcacagctcaacacat

SEQ ID NO: 10004 - DNA, 20 bp, Artificial Sequence
  sgRNA
  Amigo3_2
tggcattggtgaacgcacca

SEQ ID NO: 10005 - DNA, 20 bp, Artificial Sequence
  sgRNA
  Amigo3_3
agcgatgctaccatcctgag

SEQ ID NO: 10006 - DNA, 20 bp, Artificial Sequence
  sgRNA
  Amigo3_4
ctcgcgttcaaaatcatgca

SEQ ID NO: 10007 - DNA, 20 bp, Artificial Sequence
  sgRNA
  Amigo3_5
ttaaccccagaccgtgcaag

SEQ ID NO: 10008 - DNA, 20 bp, Artificial Sequence
  sgRNA
  Amigo3_6
ggtgcgttcaccaatgccag

SEQ ID NO: 10009 - DNA, 20 bp, Artificial Sequence
  sgRNA
  Amigo3_7
ggagacccaggccacccgag

SEQ ID NO: 10010 - DNA, 20 bp, Artificial Sequence
  sgRNA
  Amigo3_8
ccggcaagtcctgtaaccca

SEQ ID NO: 10011 - DNA, 20 bp, Artificial Sequence
  sgRNA
  Amigo3_9
gccttgagttgcaagcccat

SEQ ID NO: 10012 - DNA, 20 bp, Artificial Sequence
  sgRNA
  Amigo3_10
ttctctttcaaccacttgca

SEQ ID NO: 10013 - DNA, 20 bp, Artificial Sequence
  sgRNA
  Amigo3_11
tggcagcttagccataggca

SEQ ID NO: 10014 - DNA, 20 bp, Artificial Sequence
  sgRNA
  Amigo3_12
gagcatccttaacatattag

SEQ ID NO: 10015 - DNA, 20 bp, Artificial Sequence
  sgRNA
  Amigo3_13
gctgatggcagcttagccat

SEQ ID NO: 10016 - DNA, 20 bp, Artificial Sequence
  sgRNA
  Amigo3_14
agtagagcaacaccagcacc

SEQ ID NO: 10017 - DNA, 20 bp, Artificial Sequence
  sgRNA
  Amigo3_15
gcagtggtaggcagtgctac

SEQ ID NO: 10018 - DNA, 20 bp, Artificial Sequence
  sgRNA
  Amigo3_16
catatatcggggcagttgtg

SEQ ID NO: 10019 - DNA, 20 bp, Artificial Sequence
  sgRNA
  Amigo3_17
ttcgatctgtgcaaccccat

SEQ ID NO: 10020 - DNA, 20 bp, Artificial Sequence
  sgRNA
  Amigo3_18
gcatatatcggggcagttgt

SEQ ID NO: 10021 - DNA, 20 bp, Artificial Sequence
  sgRNA
  Amigo3_19
cttcgatctgtgcaacccca

SEQ ID NO: 10022 - DNA, 20 bp, Artificial Sequence
  sgRNA
  Amigo3_20
tgaacgcgagtacacatgct

SEQ ID NO: 10023 - DNA, 20 bp, Artificial Sequence
  sgRNA
  Amn_1
gcagacgttctcgcgcgacg

SEQ ID NO: 10024 - DNA, 20 bp, Artificial Sequence
  sgRNA
  Amn_2
acagacgcagcccgacgcgt

SEQ ID NO: 10025 - DNA, 20 bp, Artificial Sequence
  sgRNA
  Amn_3
ccagaaccggaccccgtgcg

SEQ ID NO: 10026 - DNA, 20 bp, Artificial Sequence
  sgRNA
  Amn_4
gcgcgatggatctttccgcg

SEQ ID NO: 10027 - DNA, 20 bp, Artificial Sequence
  sgRNA
  Amn_5
acgcggaaagatccatcgcg

SEQ ID NO: 10028 - DNA, 20 bp, Artificial Sequence
  sgRNA
  Amn_6
aggcttgccggactgccgca

SEQ ID NO: 10029 - DNA, 20 bp, Artificial Sequence
  sgRNA
  Amn_7
gtatcgtgtcggcgaccctg

SEQ ID NO: 10030 - DNA, 20 bp, Artificial Sequence
  sgRNA
  Amn_8
cagcgtgctcggtatcgtgt

SEQ ID NO: 10031 - DNA, 20 bp, Artificial Sequence
  sgRNA
  Amn_9
ccttcgatactgcctccaac

SEQ ID NO: 10032 - DNA, 20 bp, Artificial Sequence
  sgRNA
  Amn_10
gcgtccacggagaagagccc

SEQ ID NO: 10033 - DNA, 20 bp, Artificial Sequence
  sgRNA
  Amn_11
aggacgtcgtcgtagctgca

SEQ ID NO: 10034 - DNA, 20 bp, Artificial Sequence
  sgRNA
  Amn_12
ggtgcacgttcgcagcgtct

SEQ ID NO: 10035 - DNA, 20 bp, Artificial Sequence
  sgRNA
  Amn_13
gctttcctggcgtcccgcga

SEQ ID NO: 10036 - DNA, 20 bp, Artificial Sequence
  sgRNA
  Amn_14
gggattgcggaagagcaacg

SEQ ID NO: 10037 - DNA, 20 bp, Artificial Sequence
  sgRNA
  Amn_15
gctgcactcagcgctgcagg

SEQ ID NO: 10038 - DNA, 20 bp, Artificial Sequence
  sgRNA
  Amn_16
gtggagaccgagcacgcgac

SEQ ID NO: 10039 - DNA, 20 bp, Artificial Sequence
  sgRNA
  Amn_17
aagacaatcgcgtcgaaaat

SEQ ID NO: 10040 - DNA, 20 bp, Artificial Sequence
  sgRNA
  Amn_18
cgcggaaagatccatcgcgc

SEQ ID NO: 10041 - DNA, 20 bp, Artificial Sequence
  sgRNA
  Amn_19
tgaagacgctgagcccgtat

SEQ ID NO: 10042 - DNA, 20 bp, Artificial Sequence
  sgRNA
  Amn_20
aaccgcatctcccgcgcacg

SEQ ID NO: 10043 - DNA, 20 bp, Artificial Sequence
  sgRNA
  Ank_1
ctgtggggagcaaaacacga

SEQ ID NO: 10044 - DNA, 20 bp, Artificial Sequence
  sgRNA
  Ank_2
catatggcatatgacccacg

SEQ ID NO: 10045 - DNA, 20 bp, Artificial Sequence
  sgRNA
  Ank_3
tggccacgcagcgaatcagt

SEQ ID NO: 10046 - DNA, 20 bp, Artificial Sequence
  sgRNA
  Ank_4
gacatcatccccgacaggag

SEQ ID NO: 10047 - DNA, 20 bp, Artificial Sequence
  sgRNA
  Ank_5
gctatgttggtgatgccgag

SEQ ID NO: 10048 - DNA, 20 bp, Artificial Sequence
  sgRNA
  Ank_6
tctgacagccacctaccccg

SEQ ID NO: 10049 - DNA, 20 bp, Artificial Sequence
  sgRNA
  Ank_7
gggccgactgattcgctgcg

SEQ ID NO: 10050 - DNA, 20 bp, Artificial Sequence
  sgRNA
  Ank_8
tgtggggagcaaaacacgaa

SEQ ID NO: 10051 - DNA, 20 bp, Artificial Sequence
  sgRNA
  Ank_9
tgggtcatatgccatatggc

SEQ ID NO: 10052 - DNA, 20 bp, Artificial Sequence
  sgRNA
  Ank_10
tgttcgccagtttattgctg

SEQ ID NO: 10053 - DNA, 20 bp, Artificial Sequence
  sgRNA
  Ank_11
tccacgacatcatccccgac

SEQ ID NO: 10054 - DNA, 20 bp, Artificial Sequence
  sgRNA
  Ank_12
gtagaaatgctggccagcta

SEQ ID NO: 10055 - DNA, 20 bp, Artificial Sequence
  sgRNA
  Ank_13
gcatgctgcaagggcaacca

SEQ ID NO: 10056 - DNA, 20 bp, Artificial Sequence
  sgRNA
  Ank_14
tcttgctgttcacgaacacc

SEQ ID NO: 10057 - DNA, 20 bp, Artificial Sequence
  sgRNA
  Ank_15
gtttgtgggagaatctacca

SEQ ID NO: 10058 - DNA, 20 bp, Artificial Sequence
  sgRNA
  Ank_16
ccttgactgcagcgatgccc

SEQ ID NO: 10059 - DNA, 20 bp, Artificial Sequence
  sgRNA
  Ank_17
tgagagctcatctcactgga

SEQ ID NO: 10060 - DNA, 20 bp, Artificial Sequence
  sgRNA
  Ank_18
gggcatcgctgcagtcaagg

SEQ ID NO: 10061 - DNA, 20 bp, Artificial Sequence
  sgRNA
  Ank_19
ccaggtacggcaggaccaca

SEQ ID NO: 10062 - DNA, 20 bp, Artificial Sequence
  sgRNA
  Ank_20
ctgacagccacctaccccgt

SEQ ID NO: 10063 - DNA, 20 bp, Artificial Sequence
  sgRNA
  Ano1_1
ggagcgtcgagtacttctcg

SEQ ID NO: 10064 - DNA, 20 bp, Artificial Sequence
  sgRNA
  Ano1_2
gaagagaacaacgtgcacca

SEQ ID NO: 10065 - DNA, 20 bp, Artificial Sequence
  sgRNA
  Ano1_3
gatgaggctcaactaccgat

SEQ ID NO: 10066 - DNA, 20 bp, Artificial Sequence
  sgRNA
  Ano1_4
tgacaaacgcttcagacggg

SEQ ID NO: 10067 - DNA, 20 bp, Artificial Sequence
  sgRNA
  Ano1_5
tgacacccacgatcgaggca

SEQ ID NO: 10068 - DNA, 20 bp, Artificial Sequence
  sgRNA
  Ano1_6
gatgttggaccgcacagacg

SEQ ID NO: 10069 - DNA, 20 bp, Artificial Sequence
  sgRNA
  Ano1_7
cttccgccgtttacttagaa

SEQ ID NO: 10070 - DNA, 20 bp, Artificial Sequence
  sgRNA
  Ano1_8
ggttgtggatggggagcgcg

SEQ ID NO: 10071 - DNA, 20 bp, Artificial Sequence
  sgRNA
  Ano1_9
tgtagaggtacaccaggcga

SEQ ID NO: 10072 - DNA, 20 bp, Artificial Sequence
  sgRNA
  Ano1_10
aagattaccgggaaccccca

SEQ ID NO: 10073 - DNA, 20 bp, Artificial Sequence
  sgRNA
  Ano1_11
ccagcagaatgatgaccacg

SEQ ID NO: 10074 - DNA, 20 bp, Artificial Sequence
  sgRNA
  Ano1_12
gcagctactggacacatgga

SEQ ID NO: 10075 - DNA, 20 bp, Artificial Sequence
  sgRNA
  Ano1_13
agtttgtcaccgagctacgg

SEQ ID NO: 10076 - DNA, 20 bp, Artificial Sequence
  sgRNA
  Ano1_14
atgtcgccttcttcaaaggc

SEQ ID NO: 10077 - DNA, 20 bp, Artificial Sequence
  sgRNA
  Ano1_15
tcttcacaaacccgacacca

SEQ ID NO: 10078 - DNA, 20 bp, Artificial Sequence
  sgRNA
  Ano1_16
cggtggccgtgactgtaacc

SEQ ID NO: 10079 - DNA, 20 bp, Artificial Sequence
  sgRNA
  Ano1_17
ctgcggaccgagagtgccag

SEQ ID NO: 10080 - DNA, 20 bp, Artificial Sequence
  sgRNA
  Ano1_18
gaagtactcgacgctcccgg

SEQ ID NO: 10081 - DNA, 20 bp, Artificial Sequence
  sgRNA
  Ano1_19
aatgacaaatgccagtcggg

SEQ ID NO: 10082 - DNA, 20 bp, Artificial Sequence
  sgRNA
  Ano1_20
agtatacgccattggccagg

SEQ ID NO: 10083 - DNA, 20 bp, Artificial Sequence
  sgRNA
  Ano2_1
gcataccactaccggaaacg

SEQ ID NO: 10084 - DNA, 20 bp, Artificial Sequence
  sgRNA
  Ano2_2
aggtacacgagattctgaag

SEQ ID NO: 10085 - DNA, 20 bp, Artificial Sequence
  sgRNA
  Ano2_3
ttatggatgtgcaacaatcg

SEQ ID NO: 10086 - DNA, 20 bp, Artificial Sequence
  sgRNA
  Ano2_4
ttgtccggatccacgcccca

SEQ ID NO: 10087 - DNA, 20 bp, Artificial Sequence
  sgRNA
  Ano2_5
cgtgttcgacggttaccgca

SEQ ID NO: 10088 - DNA, 20 bp, Artificial Sequence
  sgRNA
  Ano2_6
aatagcaaacaatatctacg

SEQ ID NO: 10089 - DNA, 20 bp, Artificial Sequence
  sgRNA
  Ano2_7
agtactggtacacaaggcgg

SEQ ID NO: 10090 - DNA, 20 bp, Artificial Sequence
  sgRNA
  Ano2_8
agctatgtctacgtgttcga

SEQ ID NO: 10091 - DNA, 20 bp, Artificial Sequence
  sgRNA
  Ano2_9
ccaagatgaggatgaccacg

SEQ ID NO: 10092 - DNA, 20 bp, Artificial Sequence
  sgRNA
  Ano2_10
ggttgtcgtgaaagtgcatg

SEQ ID NO: 10093 - DNA, 20 bp, Artificial Sequence
  sgRNA
  Ano2_11
tctcgagccaacaacacgat

SEQ ID NO: 10094 - DNA, 20 bp, Artificial Sequence
  sgRNA
  Ano2_12
tcaacaatgtcattgaagtg

SEQ ID NO: 10095 - DNA, 20 bp, Artificial Sequence
  sgRNA
  Ano2_13
tcacgcctatgacagaagat

SEQ ID NO: 10096 - DNA, 20 bp, Artificial Sequence
  sgRNA
  Ano2_14
tgcactttcacgacaaccag

SEQ ID NO: 10097 - DNA, 20 bp, Artificial Sequence
  sgRNA
  Ano2_15
actggcccgtgcagtcccac

SEQ ID NO: 10098 - DNA, 20 bp, Artificial Sequence
  sgRNA
  Ano2_16
ggacactcaggaacatcact

SEQ ID NO: 10099 - DNA, 20 bp, Artificial Sequence
  sgRNA
  Ano2_17
tgttgaggagagcaaacaca

SEQ ID NO: 10100 - DNA, 20 bp, Artificial Sequence
  sgRNA
  Ano2_18
acacgagattctgaagcgga

SEQ ID NO: 10101 - DNA, 20 bp, Artificial Sequence
  sgRNA
  Ano2_19
tcagccgacgtggagatcca

SEQ ID NO: 10102 - DNA, 20 bp, Artificial Sequence
  sgRNA
  Ano2_20
gtacatagtcgactttcctc

SEQ ID NO: 10103 - DNA, 20 bp, Artificial Sequence
  sgRNA
  Ano3_1
aggtaataaaccccatcacg

SEQ ID NO: 10104 - DNA, 20 bp, Artificial Sequence
  sgRNA
  Ano3_2
tctgctgataagcctgaaca

SEQ ID NO: 10105 - DNA, 20 bp, Artificial Sequence
  sgRNA
  Ano3_3
tgaacttacctaagttagtg

SEQ ID NO: 10106 - DNA, 20 bp, Artificial Sequence
  sgRNA
  Ano3_4
cactgtgcaagtatgcagag

SEQ ID NO: 10107 - DNA, 20 bp, Artificial Sequence
  sgRNA
  Ano3_5
ctcgccgtatgcgctcacgg

SEQ ID NO: 10108 - DNA, 20 bp, Artificial Sequence
  sgRNA
  Ano3_6
gatagacctctgcctccaga

SEQ ID NO: 10109 - DNA, 20 bp, Artificial Sequence
  sgRNA
  Ano3_7
aggtctatcagacagccact

SEQ ID NO: 10110 - DNA, 20 bp, Artificial Sequence
  sgRNA
  Ano3_8
tgtattcatagacaaaacgt

SEQ ID NO: 10111 - DNA, 20 bp, Artificial Sequence
  sgRNA
  Ano3_9
acatgatgactcccatctgg

SEQ ID NO: 10112 - DNA, 20 bp, Artificial Sequence
  sgRNA
  Ano3_10
gacctgagtgaacttggtat

SEQ ID NO: 10113 - DNA, 20 bp, Artificial Sequence
  sgRNA
  Ano3_11
ggaatttcgtcaaacagcac

SEQ ID NO: 10114 - DNA, 20 bp, Artificial Sequence
  sgRNA
  Ano3_12
agtactcgtccatcagccca

SEQ ID NO: 10115 - DNA, 20 bp, Artificial Sequence
  sgRNA
  Ano3_13
atggatgtcccaaaacccaa

SEQ ID NO: 10116 - DNA, 20 bp, Artificial Sequence
  sgRNA
  Ano3_14
gagactatagaggcccacct

SEQ ID NO: 10117 - DNA, 20 bp, Artificial Sequence
  sgRNA
  Ano3_15
agtggactcttattcaaaga

SEQ ID NO: 10118 - DNA, 20 bp, Artificial Sequence
  sgRNA
  Ano3_16
agattggcttatacttcgcc

SEQ ID NO: 10119 - DNA, 20 bp, Artificial Sequence
  sgRNA
  Ano3_17
attagtagccaaggatcctg

SEQ ID NO: 10120 - DNA, 20 bp, Artificial Sequence
  sgRNA
  Ano3_18
agccttccgatcaaaaccca

SEQ ID NO: 10121 - DNA, 20 bp, Artificial Sequence
  sgRNA
  Ano3_19
tcacgacacaaaatcaaaag

SEQ ID NO: 10122 - DNA, 20 bp, Artificial Sequence
  sgRNA
  Ano3_20
actgttccatgactaccaga

SEQ ID NO: 10123 - DNA, 20 bp, Artificial Sequence
  sgRNA
  Ano5_1
tttcttcaaatcctccacgt

SEQ ID NO: 10124 - DNA, 20 bp, Artificial Sequence
  sgRNA
  Ano5_2
aaaggttgtacctttcattg

SEQ ID NO: 10125 - DNA, 20 bp, Artificial Sequence
  sgRNA
  Ano5_3
cacacacttcatcgcaaagt

SEQ ID NO: 10126 - DNA, 20 bp, Artificial Sequence
  sgRNA
  Ano5_4
ggaagttcgtgggatatcct

SEQ ID NO: 10127 - DNA, 20 bp, Artificial Sequence
  sgRNA
  Ano5_5
catagaagtaaactaaccgg

SEQ ID NO: 10128 - DNA, 20 bp, Artificial Sequence
  sgRNA
  Ano5_6
ttattgacgtatccactcaa

SEQ ID NO: 10129 - DNA, 20 bp, Artificial Sequence
  sgRNA
  Ano5_7
tgtgaagattcacgccccat

SEQ ID NO: 10130 - DNA, 20 bp, Artificial Sequence
  sgRNA
  Ano5_8
aagtgaccaggacttcccat

SEQ ID NO: 10131 - DNA, 20 bp, Artificial Sequence
  sgRNA
  Ano5_9
ttgtgaagattcacgcccca

SEQ ID NO: 10132 - DNA, 20 bp, Artificial Sequence
  sgRNA
  Ano5_10
gtacaacctttgcaagaact

SEQ ID NO: 10133 - DNA, 20 bp, Artificial Sequence
  sgRNA
  Ano5_11
gctctcatgaacaacatcat

SEQ ID NO: 10134 - DNA, 20 bp, Artificial Sequence
  sgRNA
  Ano5_12
caacatcatgggaatccgag

SEQ ID NO: 10135 - DNA, 20 bp, Artificial Sequence
  sgRNA
  Ano5_13
tgagaaactgtacagtcgtt

SEQ ID NO: 10136 - DNA, 20 bp, Artificial Sequence
  sgRNA
  Ano5_14
gaaatctgtgaccctgacat

SEQ ID NO: 10137 - DNA, 20 bp, Artificial Sequence
  sgRNA
  Ano5_15
tcagcttccaggcatccact

SEQ ID NO: 10138 - DNA, 20 bp, Artificial Sequence
  sgRNA
  Ano5_16
aagtggcaaagactgacagg

SEQ ID NO: 10139 - DNA, 20 bp, Artificial Sequence
  sgRNA
  Ano5_17
tcttcttcagagatggaatc

SEQ ID NO: 10140 - DNA, 20 bp, Artificial Sequence
  sgRNA
  Ano5_18
gaagctcttcacgctctgca

SEQ ID NO: 10141 - DNA, 20 bp, Artificial Sequence
  sgRNA
  Ano5_19
aggagtaggatacttcacag

SEQ ID NO: 10142 - DNA, 20 bp, Artificial Sequence
  sgRNA
  Ano5_20
ggaagctgacaactcagtac

SEQ ID NO: 10143 - DNA, 20 bp, Artificial Sequence
  sgRNA
  Ano6_1
ggtgataaacgagatcactc

SEQ ID NO: 10144 - DNA, 20 bp, Artificial Sequence
  sgRNA
  Ano6_2
cagattcaactatgagtcgg

SEQ ID NO: 10145 - DNA, 20 bp, Artificial Sequence
  sgRNA
  Ano6_3
tgaagaaggaatctctatcg

SEQ ID NO: 10146 - DNA, 20 bp, Artificial Sequence
  sgRNA
  Ano6_4
caaattcgtgggctatcccg

SEQ ID NO: 10147 - DNA, 20 bp, Artificial Sequence
  sgRNA
  Ano6_5
gcttcttgtatatactccga

SEQ ID NO: 10148 - DNA, 20 bp, Artificial Sequence
  sgRNA
  Ano6_6
gtaatcctgttcccatcgtg

SEQ ID NO: 10149 - DNA, 20 bp, Artificial Sequence
  sgRNA
  Ano6_7
tggaaataagagtggacgcg

SEQ ID NO: 10150 - DNA, 20 bp, Artificial Sequence
  sgRNA
  Ano6_8
ggaccacacttattacacca

SEQ ID NO: 10151 - DNA, 20 bp, Artificial Sequence
  sgRNA
  Ano6_9
tgcttcttgtatatactccg

SEQ ID NO: 10152 - DNA, 20 bp, Artificial Sequence
  sgRNA
  Ano6_10
ggacacatctggaattgcgt

SEQ ID NO: 10153 - DNA, 20 bp, Artificial Sequence
  sgRNA
  Ano6_11
aacaatcccagcttgcccat

SEQ ID NO: 10154 - DNA, 20 bp, Artificial Sequence
  sgRNA
  Ano6_12
acatggggatcatcgccgag

SEQ ID NO: 10155 - DNA, 20 bp, Artificial Sequence
  sgRNA
  Ano6_13
gattaccatctgcagcccat

SEQ ID NO: 10156 - DNA, 20 bp, Artificial Sequence
  sgRNA
  Ano6_14
cagctgacgatcatcatggg

SEQ ID NO: 10157 - DNA, 20 bp, Artificial Sequence
  sgRNA
  Ano6_15
ccttctcgtagatcgtgttg

SEQ ID NO: 10158 - DNA, 20 bp, Artificial Sequence
  sgRNA
  Ano6_16
gctgtgtggtcagttcaagg

SEQ ID NO: 10159 - DNA, 20 bp, Artificial Sequence
  sgRNA
  Ano6_17
tgtggaaaatacgatgaaca

SEQ ID NO: 10160 - DNA, 20 bp, Artificial Sequence
  sgRNA
  Ano6_18
ttacctcctgtacagagaat

SEQ ID NO: 10161 - DNA, 20 bp, Artificial Sequence
  sgRNA
  Ano6_19
gacaatgatcccgatcacag

SEQ ID NO: 10162 - DNA, 20 bp, Artificial Sequence
  sgRNA
  Ano6_20
taggtgcacagcacttccca

SEQ ID NO: 10163 - DNA, 20 bp, Artificial Sequence
  sgRNA
  Ano7_1
actggcaggagtaatactcg

SEQ ID NO: 10164 - DNA, 20 bp, Artificial Sequence
  sgRNA
  Ano7_2
ccatgtgcgaaggtacttcg

SEQ ID NO: 10165 - DNA, 20 bp, Artificial Sequence
  sgRNA
  Ano7_3
gaaggcgatatacacgggcg

SEQ ID NO: 10166 - DNA, 20 bp, Artificial Sequence
  sgRNA
  Ano7_4
atagatggcttaccaattgg

SEQ ID NO: 10167 - DNA, 20 bp, Artificial Sequence
  sgRNA
  Ano7_5
gcaagtgcggttgtgtgcgg

SEQ ID NO: 10168 - DNA, 20 bp, Artificial Sequence
  sgRNA
  Ano7_6
gtgcgagtatcggcgcccag

SEQ ID NO: 10169 - DNA, 20 bp, Artificial Sequence
  sgRNA
  Ano7_7
aacgggcctcacacacctcg

SEQ ID NO: 10170 - DNA, 20 bp, Artificial Sequence
  sgRNA
  Ano7_8
gtgtatatcgccttcttcaa

SEQ ID NO: 10171 - DNA, 20 bp, Artificial Sequence
  sgRNA
  Ano7_9
gctggaataagacttggcgt

SEQ ID NO: 10172 - DNA, 20 bp, Artificial Sequence
  sgRNA
  Ano7_10
gccaggagagtccagtaagt

SEQ ID NO: 10173 - DNA, 20 bp, Artificial Sequence
  sgRNA
  Ano7_11
cgaacttgcgcgcatctagg

SEQ ID NO: 10174 - DNA, 20 bp, Artificial Sequence
  sgRNA
  Ano7_12
gcaagttcgtgtgcgagtat

SEQ ID NO: 10175 - DNA, 20 bp, Artificial Sequence
  sgRNA
  Ano7_13
tggcttcctcaatttcacgc

SEQ ID NO: 10176 - DNA, 20 bp, Artificial Sequence
  sgRNA
  Ano7_14
acaccaggaaacatcccacc

SEQ ID NO: 10177 - DNA, 20 bp, Artificial Sequence
  sgRNA
  Ano7_15
gtccagctgtagtagacacg

SEQ ID NO: 10178 - DNA, 20 bp, Artificial Sequence
  sgRNA
  Ano7_16
gggcggctcttcgaccatgg

SEQ ID NO: 10179 - DNA, 20 bp, Artificial Sequence
  sgRNA
  Ano7_17
gagcagccaaaaagaacagt

SEQ ID NO: 10180 - DNA, 20 bp, Artificial Sequence
  sgRNA
  Ano7_18
gatcatcaataacgtgcagg

SEQ ID NO: 10181 - DNA, 20 bp, Artificial Sequence
  sgRNA
  Ano7_19
tagtagcaaagcacagccca

SEQ ID NO: 10182 - DNA, 20 bp, Artificial Sequence
  sgRNA
  Ano7_20
cgattcttctcaggaaagta

SEQ ID NO: 10183 - DNA, 20 bp, Artificial Sequence
  sgRNA
  Ano9_1
tcccggaagtaccatgaaca

SEQ ID NO: 10184 - DNA, 20 bp, Artificial Sequence
  sgRNA
  Ano9_2
agccactcagaaagacgatg

SEQ ID NO: 10185 - DNA, 20 bp, Artificial Sequence
  sgRNA
  Ano9_3
tgaagaatatatgggctcgg

SEQ ID NO: 10186 - DNA, 20 bp, Artificial Sequence
  sgRNA
  Ano9_4
ccaggcgcgtggatttccca

SEQ ID NO: 10187 - DNA, 20 bp, Artificial Sequence
  sgRNA
  Ano9_5
gcatcaaactcattgctgcg

SEQ ID NO: 10188 - DNA, 20 bp, Artificial Sequence
  sgRNA
  Ano9_6
actcatctctttgacaacga

SEQ ID NO: 10189 - DNA, 20 bp, Artificial Sequence
  sgRNA
  Ano9_7
gtaggtgtaccagccaagcc

SEQ ID NO: 10190 - DNA, 20 bp, Artificial Sequence
  sgRNA
  Ano9_8
ggtacttgtagactaccctg

SEQ ID NO: 10191 - DNA, 20 bp, Artificial Sequence
  sgRNA
  Ano9_9
tggtctttcagcttatagtg

SEQ ID NO: 10192 - DNA, 20 bp, Artificial Sequence
  sgRNA
  Ano9_10
catccagacggatttccaca

SEQ ID NO: 10193 - DNA, 20 bp, Artificial Sequence
  sgRNA
  Ano9_11
tcaagatggtcagactacag

SEQ ID NO: 10194 - DNA, 20 bp, Artificial Sequence
  sgRNA
  Ano9_12
ctgtagtctgaccatcttga

SEQ ID NO: 10195 - DNA, 20 bp, Artificial Sequence
  sgRNA
  Ano9_13
tctccatgaactcatcaaac

SEQ ID NO: 10196 - DNA, 20 bp, Artificial Sequence
  sgRNA
  Ano9_14
tgccccagtcaccaccacag

SEQ ID NO: 10197 - DNA, 20 bp, Artificial Sequence
  sgRNA
  Ano9_15
tatggttgacatagttcgtg

SEQ ID NO: 10198 - DNA, 20 bp, Artificial Sequence
  sgRNA
  Ano9_16
ccatcttgatggcatccaga

SEQ ID NO: 10199 - DNA, 20 bp, Artificial Sequence
  sgRNA
  Ano9_17
tgtagaagacagacaagcta

SEQ ID NO: 10200 - DNA, 20 bp, Artificial Sequence
  sgRNA
  Ano9_18
ctagaaaacctcgagagcaa

SEQ ID NO: 10201 - DNA, 20 bp, Artificial Sequence
  sgRNA
  Ano9_19
gatggacctgtttatccaga

SEQ ID NO: 10202 - DNA, 20 bp, Artificial Sequence
  sgRNA
  Ano9_20
agaggataacaaaggtcagt

SEQ ID NO: 10203 - DNA, 20 bp, Artificial Sequence
  sgRNA
  Anpep_1
agagcgtactgagtacctgg

SEQ ID NO: 10204 - DNA, 20 bp, Artificial Sequence
  sgRNA
  Anpep_2
gtccatgatagtgcgcaccg

SEQ ID NO: 10205 - DNA, 20 bp, Artificial Sequence
  sgRNA
  Anpep_3
agcacccagatattccacgt

SEQ ID NO: 10206 - DNA, 20 bp, Artificial Sequence
  sgRNA
  Anpep_4
gaccagggagctctcacggt

SEQ ID NO: 10207 - DNA, 20 bp, Artificial Sequence
  sgRNA
  Anpep_5
tggggccgtagacctccgag

SEQ ID NO: 10208 - DNA, 20 bp, Artificial Sequence
  sgRNA
  Anpep_6
tgtgtaccgtgtgatggccg

SEQ ID NO: 10209 - DNA, 20 bp, Artificial Sequence
  sgRNA
  Anpep_7
gtactgacggccctctacca

SEQ ID NO: 10210 - DNA, 20 bp, Artificial Sequence
  sgRNA
  Anpep_8
gatggacagccagttccagg

SEQ ID NO: 10211 - DNA, 20 bp, Artificial Sequence
  sgRNA
  Anpep_9
atagtgcgcaccgtggccgg

SEQ ID NO: 10212 - DNA, 20 bp, Artificial Sequence
  sgRNA
  Anpep_10
gatagtgcgcaccgtggccg

SEQ ID NO: 10213 - DNA, 20 bp, Artificial Sequence
  sgRNA
  Anpep_11
gtatgtggacatcttagggg

SEQ ID NO: 10214 - DNA, 20 bp, Artificial Sequence
  sgRNA
  Anpep_12
acacatcattcagtaccatg

SEQ ID NO: 10215 - DNA, 20 bp, Artificial Sequence
  sgRNA
  Anpep_13
ctttacctgcaaccagacca

SEQ ID NO: 10216 - DNA, 20 bp, Artificial Sequence
  sgRNA
  Anpep_14
aatgatctgtggctgaacga

SEQ ID NO: 10217 - DNA, 20 bp, Artificial Sequence
  sgRNA
  Anpep_15
gccctgcctgacttcaacgc

SEQ ID NO: 10218 - DNA, 20 bp, Artificial Sequence
  sgRNA
  Anpep_16
gggttcgcaacaccaccctg

SEQ ID NO: 10219 - DNA, 20 bp, Artificial Sequence
  sgRNA
  Anpep_17
actcatgttcgaccgctcgg

SEQ ID NO: 10220 - DNA, 20 bp, Artificial Sequence
  sgRNA
  Anpep_18
tcagccacaggctttggcac

SEQ ID NO: 10221 - DNA, 20 bp, Artificial Sequence
  sgRNA
  Anpep_19
gctttcatctacagcagggg

SEQ ID NO: 10222 - DNA, 20 bp, Artificial Sequence
  sgRNA
  Anpep_20
ggtcatcagccagttccccc

SEQ ID NO: 10223 - DNA, 20 bp, Artificial Sequence
  sgRNA
  Antxr1_1
acatgcacgaaggattcgag

SEQ ID NO: 10224 - DNA, 20 bp, Artificial Sequence
  sgRNA
  Antxr1_2
tgaaccatccaccatctgcg

SEQ ID NO: 10225 - DNA, 20 bp, Artificial Sequence
  sgRNA
  Antxr1_3
tgaaggacatccttagctgt

SEQ ID NO: 10226 - DNA, 20 bp, Artificial Sequence
  sgRNA
  Antxr1_4
ctgctcatcccatagtcaga

SEQ ID NO: 10227 - DNA, 20 bp, Artificial Sequence
  sgRNA
  Antxr1_5
tcattgtcttctctactcga

SEQ ID NO: 10228 - DNA, 20 bp, Artificial Sequence
  sgRNA
  Antxr1_6
cgagtaccacttccgaggcg

SEQ ID NO: 10229 - DNA, 20 bp, Artificial Sequence
  sgRNA
  Antxr1_7
ggaccagcagagcaatcgcc

SEQ ID NO: 10230 - DNA, 20 bp, Artificial Sequence
  sgRNA
  Antxr1_8
accgcgtccaccataataag

SEQ ID NO: 10231 - DNA, 20 bp, Artificial Sequence
  sgRNA
  Antxr1_9
catgcacgaaggattcgaga

SEQ ID NO: 10232 - DNA, 20 bp, Artificial Sequence
  sgRNA
  Antxr1_10
ctgcaggtcagcatgaacga

SEQ ID NO: 10233 - DNA, 20 bp, Artificial Sequence
  sgRNA
  Antxr1_11
gtagcaagcacgttcaccca

SEQ ID NO: 10234 - DNA, 20 bp, Artificial Sequence
  sgRNA
  Antxr1_12
gaaccaccagagcagcgcca

SEQ ID NO: 10235 - DNA, 20 bp, Artificial Sequence
  sgRNA
  Antxr1_13
gacacggtaggattcgccaa

SEQ ID NO: 10236 - DNA, 20 bp, Artificial Sequence
  sgRNA
  Antxr1_14
gtggcctcatcacagacact

SEQ ID NO: 10237 - DNA, 20 bp, Artificial Sequence
  sgRNA
  Antxr1_15
ggagacacttacatgcacga

SEQ ID NO: 10238 - DNA, 20 bp, Artificial Sequence
  sgRNA
  Antxr1_16
ggtgtgtagataggagcggg

SEQ ID NO: 10239 - DNA, 20 bp, Artificial Sequence
  sgRNA
  Antxr1_17
gtagatgcctcttattatgg

SEQ ID NO: 10240 - DNA, 20 bp, Artificial Sequence
  sgRNA
  Antxr1_18
cgtcgttcacaggaaacacg

SEQ ID NO: 10241 - DNA, 20 bp, Artificial Sequence
  sgRNA
  Antxr1_19
gcctcttattatggtggacg

SEQ ID NO: 10242 - DNA, 20 bp, Artificial Sequence
  sgRNA
  Antxr1_20
acctcaacaacaacatgcgc

SEQ ID NO: 10243 - DNA, 20 bp, Artificial Sequence
  sgRNA
  Antxr2_1
gtcacgtcgatcagtcacga

SEQ ID NO: 10244 - DNA, 20 bp, Artificial Sequence
  sgRNA
  Antxr2_2
cagtacgaagtacaaatcga

SEQ ID NO: 10245 - DNA, 20 bp, Artificial Sequence
  sgRNA
  Antxr2_3
ttgacggacggtaagctgga

SEQ ID NO: 10246 - DNA, 20 bp, Artificial Sequence
  sgRNA
  Antxr2_4
caaaattggcaaaggactgg

SEQ ID NO: 10247 - DNA, 20 bp, Artificial Sequence
  sgRNA
  Antxr2_5
gggagataaaggatctacag

SEQ ID NO: 10248 - DNA, 20 bp, Artificial Sequence
  sgRNA
  Antxr2_6
gtgtctgctcctgatacgca

SEQ ID NO: 10249 - DNA, 20 bp, Artificial Sequence
  sgRNA
  Antxr2_7
gtggacgcttcctactacgg

SEQ ID NO: 10250 - DNA, 20 bp, Artificial Sequence
  sgRNA
  Antxr2_8
ccgatgcataaacttctccc

SEQ ID NO: 10251 - DNA, 20 bp, Artificial Sequence
  sgRNA
  Antxr2_9
ttaaaggccgttaagccagt

SEQ ID NO: 10252 - DNA, 20 bp, Artificial Sequence
  sgRNA
  Antxr2_10
cgctagtgtttactgcgttg

SEQ ID NO: 10253 - DNA, 20 bp, Artificial Sequence
  sgRNA
  Antxr2_11
ggggtctcatcaaggacacc

SEQ ID NO: 10254 - DNA, 20 bp, Artificial Sequence
  sgRNA
  Antxr2_12
ctgatacgcatggctccact

SEQ ID NO: 10255 - DNA, 20 bp, Artificial Sequence
  sgRNA
  Antxr2_13
cgtgcctcatgagagccaag

SEQ ID NO: 10256 - DNA, 20 bp, Artificial Sequence
  sgRNA
  Antxr2_14
tttgcaagagggctgctcct

SEQ ID NO: 10257 - DNA, 20 bp, Artificial Sequence
  sgRNA
  Antxr2_15
tgttggctgtgggcggtccg

SEQ ID NO: 10258 - DNA, 20 bp, Artificial Sequence
  sgRNA
  Antxr2_16
tgatcatgaagcagtatgac

SEQ ID NO: 10259 - DNA, 20 bp, Artificial Sequence
  sgRNA
  Antxr2_17
cccgggagaagtttatgcat

SEQ ID NO: 10260 - DNA, 20 bp, Artificial Sequence
  sgRNA
  Antxr2_18
atcataattgctttgacgga

SEQ ID NO: 10261 - DNA, 20 bp, Artificial Sequence
  sgRNA
  Antxr2_19
accatcttatgcagagaacg

SEQ ID NO: 10262 - DNA, 20 bp, Artificial Sequence
  sgRNA
  Antxr2_20
tggatgtatgtttctccaac

SEQ ID NO: 10263 - DNA, 20 bp, Artificial Sequence
  sgRNA
  Antxrl_1
gggagcaatcgtttacaccg

SEQ ID NO: 10264 - DNA, 20 bp, Artificial Sequence
  sgRNA
  Antxrl_2
acaaacgtaggtaggctgca

SEQ ID NO: 10265 - DNA, 20 bp, Artificial Sequence
  sgRNA
  Antxrl_3
cttaagaacatagtgcctca

SEQ ID NO: 10266 - DNA, 20 bp, Artificial Sequence
  sgRNA
  Antxrl_4
actcccaaccaggcatcaca

SEQ ID NO: 10267 - DNA, 20 bp, Artificial Sequence
  sgRNA
  Antxrl_5
ggtataccaagtctcccgcc

SEQ ID NO: 10268 - DNA, 20 bp, Artificial Sequence
  sgRNA
  Antxrl_6
ggagcaatcgtttacaccgt

SEQ ID NO: 10269 - DNA, 20 bp, Artificial Sequence
  sgRNA
  Antxrl_7
gggttgaaagacaatccttg

SEQ ID NO: 10270 - DNA, 20 bp, Artificial Sequence
  sgRNA
  Antxrl_8
ttattccaccgcctgagcaa

SEQ ID NO: 10271 - DNA, 20 bp, Artificial Sequence
  sgRNA
  Antxrl_9
gctatacataaaaacaccca

SEQ ID NO: 10272 - DNA, 20 bp, Artificial Sequence
  sgRNA
  Antxrl_10
ttataaccagtaccaactgc

SEQ ID NO: 10273 - DNA, 20 bp, Artificial Sequence
  sgRNA
  Antxrl_11
gaagggttctctgctctgga

SEQ ID NO: 10274 - DNA, 20 bp, Artificial Sequence
  sgRNA
  Antxrl_12
tgatggagatccgcaggtta

SEQ ID NO: 10275 - DNA, 20 bp, Artificial Sequence
  sgRNA
  Antxrl_13
tgacaccaaaccaatggcat

SEQ ID NO: 10276 - DNA, 20 bp, Artificial Sequence
  sgRNA
  Antxrl_14
cttcaagtcagtctgaacaa

SEQ ID NO: 10277 - DNA, 20 bp, Artificial Sequence
  sgRNA
  Antxrl_15
ggtgggagcctccgatacca

SEQ ID NO: 10278 - DNA, 20 bp, Artificial Sequence
  sgRNA
  Antxrl_16
accaaaccaatggcatcggg

SEQ ID NO: 10279 - DNA, 20 bp, Artificial Sequence
  sgRNA
  Antxrl_17
tcatctcccgattgaccctg

SEQ ID NO: 10280 - DNA, 20 bp, Artificial Sequence
  sgRNA
  Antxrl_18
gagcagaggcagcatcctgg

SEQ ID NO: 10281 - DNA, 20 bp, Artificial Sequence
  sgRNA
  Antxrl_19
aagggattctaaagattgcc

SEQ ID NO: 10282 - DNA, 20 bp, Artificial Sequence
  sgRNA
  Antxrl_20
tcatttgctgtgtctggcgt

SEQ ID NO: 10283 - DNA, 20 bp, Artificial Sequence
  sgRNA
  Aoc3_1
acaatgactacagccccccg

SEQ ID NO: 10284 - DNA, 20 bp, Artificial Sequence
  sgRNA
  Aoc3_2
atcaatgtcgacctgctacg

SEQ ID NO: 10285 - DNA, 20 bp, Artificial Sequence
  sgRNA
  Aoc3_3
tcccaaacaatggtacaggt

SEQ ID NO: 10286 - DNA, 20 bp, Artificial Sequence
  sgRNA
  Aoc3_4
tgcatcacgtagtgtcttgg

SEQ ID NO: 10287 - DNA, 20 bp, Artificial Sequence
  sgRNA
  Aoc3_5
tcttcaaccagaacgacccg

SEQ ID NO: 10288 - DNA, 20 bp, Artificial Sequence
  sgRNA
  Aoc3_6
gctcaattacgactacatat

SEQ ID NO: 10289 - DNA, 20 bp, Artificial Sequence
  sgRNA
  Aoc3_7
ggtcccctgattgcaaacca

SEQ ID NO: 10290 - DNA, 20 bp, Artificial Sequence
  sgRNA
  Aoc3_8
tcccctgattgcaaaccacg

SEQ ID NO: 10291 - DNA, 20 bp, Artificial Sequence
  sgRNA
  Aoc3_9
ggtaaggacagtctacccct

SEQ ID NO: 10292 - DNA, 20 bp, Artificial Sequence
  sgRNA
  Aoc3_10
ctctacccccctgatccgag

SEQ ID NO: 10293 - DNA, 20 bp, Artificial Sequence
  sgRNA
  Aoc3_11
tgccctgtggaccatccaga

SEQ ID NO: 10294 - DNA, 20 bp, Artificial Sequence
  sgRNA
  Aoc3_12
cgtcaaagaagttatacggc

SEQ ID NO: 10295 - DNA, 20 bp, Artificial Sequence
  sgRNA
  Aoc3_13
tctttgatatccgctttcaa

SEQ ID NO: 10296 - DNA, 20 bp, Artificial Sequence
  sgRNA
  Aoc3_14
atgtcgacctgctacgtgga

SEQ ID NO: 10297 - DNA, 20 bp, Artificial Sequence
  sgRNA
  Aoc3_15
gtctacccctcggatcaggg

SEQ ID NO: 10298 - DNA, 20 bp, Artificial Sequence
  sgRNA
  Aoc3_16
gcaacaagtggggtcatagg

SEQ ID NO: 10299 - DNA, 20 bp, Artificial Sequence
  sgRNA
  Aoc3_17
cctctgcagttccatcccca

SEQ ID NO: 10300 - DNA, 20 bp, Artificial Sequence
  sgRNA
  Aoc3_18
ggccaggtacaggtagcgtg

SEQ ID NO: 10301 - DNA, 20 bp, Artificial Sequence
  sgRNA
  Aoc3_19
gtaatacaagccaaaccagg

SEQ ID NO: 10302 - DNA, 20 bp, Artificial Sequence
  sgRNA
  Aoc3_20
gccgtataacttctttgacg

SEQ ID NO: 10303 - DNA, 20 bp, Artificial Sequence
  sgRNA
  Apcdd1_1
aggacgtagcctatgacctg

SEQ ID NO: 10304 - DNA, 20 bp, Artificial Sequence
  sgRNA
  Apcdd1_2
cgggtccggagttcatgaca

SEQ ID NO: 10305 - DNA, 20 bp, Artificial Sequence
  sgRNA
  Apcdd1_3
ccttagagaaaagcgcctgg

SEQ ID NO: 10306 - DNA, 20 bp, Artificial Sequence
  sgRNA
  Apcdd1_4
gctggctcacccattccccg

SEQ ID NO: 10307 - DNA, 20 bp, Artificial Sequence
  sgRNA
  Apcdd1_5
gctgccatagtaaaactggt

SEQ ID NO: 10308 - DNA, 20 bp, Artificial Sequence
  sgRNA
  Apcdd1_6
acctacaccctcatcatccg

SEQ ID NO: 10309 - DNA, 20 bp, Artificial Sequence
  sgRNA
  Apcdd1_7
ggcaagttcggttcaccagt

SEQ ID NO: 10310 - DNA, 20 bp, Artificial Sequence
  sgRNA
  Apcdd1_8
agcatctccacaacggtgcg

SEQ ID NO: 10311 - DNA, 20 bp, Artificial Sequence
  sgRNA
  Apcdd1_9
ggcgtcctggatcatccgtg

SEQ ID NO: 10312 - DNA, 20 bp, Artificial Sequence
  sgRNA
  Apcdd1_10
acattcaccatctacgctcg

SEQ ID NO: 10313 - DNA, 20 bp, Artificial Sequence
  sgRNA
  Apcdd1_11
tggtatgtgtcacatcctgt

SEQ ID NO: 10314 - DNA, 20 bp, Artificial Sequence
  sgRNA
  Apcdd1_12
atgctgaagcatctccacaa

SEQ ID NO: 10315 - DNA, 20 bp, Artificial Sequence
  sgRNA
  Apcdd1_13
ggccattgaacagcaggtag

SEQ ID NO: 10316 - DNA, 20 bp, Artificial Sequence
  sgRNA
  Apcdd1_14
gtagcggcctcgagcgtaga

SEQ ID NO: 10317 - DNA, 20 bp, Artificial Sequence
  sgRNA
  Apcdd1_15
acaacaacaacacctgggaa

SEQ ID NO: 10318 - DNA, 20 bp, Artificial Sequence
  sgRNA
  Apcdd1_16
gagtaaccacgagtgcacca

SEQ ID NO: 10319 - DNA, 20 bp, Artificial Sequence
  sgRNA
  Apcdd1_17
gatcttgcctcggatgatga

SEQ ID NO: 10320 - DNA, 20 bp, Artificial Sequence
  sgRNA
  Apcdd1_18
atgggtgagccagcgctgcg

SEQ ID NO: 10321 - DNA, 20 bp, Artificial Sequence
  sgRNA
  Apcdd1_19
tcaaggtcatctgtatggca

SEQ ID NO: 10322 - DNA, 20 bp, Artificial Sequence
  sgRNA
  Apcdd1_20
tctgctgtctggatgaagga

SEQ ID NO: 10323 - DNA, 20 bp, Artificial Sequence
  sgRNA
  Aplnr_1
ctacatggactactctatgg

SEQ ID NO: 10324 - DNA, 20 bp, Artificial Sequence
  sgRNA
  Aplnr_2
catcgctggccatttccgaa

SEQ ID NO: 10325 - DNA, 20 bp, Artificial Sequence
  sgRNA
  Aplnr_3
gcaggaatgagcgctccaga

SEQ ID NO: 10326 - DNA, 20 bp, Artificial Sequence
  sgRNA
  Aplnr_4
ccaggtatcggtcaaagctg

SEQ ID NO: 10327 - DNA, 20 bp, Artificial Sequence
  sgRNA
  Aplnr_5
aggccagtcaaactcccggt

SEQ ID NO: 10328 - DNA, 20 bp, Artificial Sequence
  sgRNA
  Aplnr_6
tgtagagagtcttcaccagg

SEQ ID NO: 10329 - DNA, 20 bp, Artificial Sequence
  sgRNA
  Aplnr_7
gcatgtagagagtcttcacc

SEQ ID NO: 10330 - DNA, 20 bp, Artificial Sequence
  sgRNA
  Aplnr_8
gctgtgcccggaagaataac

SEQ ID NO: 10331 - DNA, 20 bp, Artificial Sequence
  sgRNA
  Aplnr_9
gtatcggtcaaagctgaggc

SEQ ID NO: 10332 - DNA, 20 bp, Artificial Sequence
  sgRNA
  Aplnr_10
ctgcgtagtcgcattcagac

SEQ ID NO: 10333 - DNA, 20 bp, Artificial Sequence
  sgRNA
  Aplnr_11
gctaaggctgcgagtcagcg

SEQ ID NO: 10334 - DNA, 20 bp, Artificial Sequence
  sgRNA
  Aplnr_12
gctctgatcacagcagagca

SEQ ID NO: 10335 - DNA, 20 bp, Artificial Sequence
  sgRNA
  Aplnr_13
aggaagatgtcaaagtcaca

SEQ ID NO: 10336 - DNA, 20 bp, Artificial Sequence
  sgRNA
  Aplnr_14
ttcgcggctggttcgaaaca

SEQ ID NO: 10337 - DNA, 20 bp, Artificial Sequence
  sgRNA
  Aplnr_15
gttccgttccacagacgcct

SEQ ID NO: 10338 - DNA, 20 bp, Artificial Sequence
  sgRNA
  Aplnr_16
gaagggcaccacaaagccca

SEQ ID NO: 10339 - DNA, 20 bp, Artificial Sequence
  sgRNA
  Aplnr_17
atacctggccattgtcaggc

SEQ ID NO: 10340 - DNA, 20 bp, Artificial Sequence
  sgRNA
  Aplnr_18
tgcaggcttggcgaaatcgg

SEQ ID NO: 10341 - DNA, 20 bp, Artificial Sequence
  sgRNA
  Aplnr_19
agtacggaaagacattcatg

SEQ ID NO: 10342 - DNA, 20 bp, Artificial Sequence
  sgRNA
  Aplnr_20
gcctgacaatggccaggtat

SEQ ID NO: 10343 - DNA, 20 bp, Artificial Sequence
  sgRNA
  Aplp1_1
agtaatcgtctactggctga

SEQ ID NO: 10344 - DNA, 20 bp, Artificial Sequence
  sgRNA
  Aplp1_2
accagtgtgagagttcaacc

SEQ ID NO: 10345 - DNA, 20 bp, Artificial Sequence
  sgRNA
  Aplp1_3
taggatgcgccagattaatg

SEQ ID NO: 10346 - DNA, 20 bp, Artificial Sequence
  sgRNA
  Aplp1_4
cgagctgcacatagcacgcg

SEQ ID NO: 10347 - DNA, 20 bp, Artificial Sequence
  sgRNA
  Aplp1_5
ccactcgtcagatatccagc

SEQ ID NO: 10348 - DNA, 20 bp, Artificial Sequence
  sgRNA
  Aplp1_6
tgtggctctgatcggttccg

SEQ ID NO: 10349 - DNA, 20 bp, Artificial Sequence
  sgRNA
  Aplp1_7
tctgaggcactaccagcacg

SEQ ID NO: 10350 - DNA, 20 bp, Artificial Sequence
  sgRNA
  Aplp1_8
ggctgcacaggccatcccga

SEQ ID NO: 10351 - DNA, 20 bp, Artificial Sequence
  sgRNA
  Aplp1_9
ggggaaatcggcgagcatga

SEQ ID NO: 10352 - DNA, 20 bp, Artificial Sequence
  sgRNA
  Aplp1_10
gaagccctgctagtgcccga

SEQ ID NO: 10353 - DNA, 20 bp, Artificial Sequence
  sgRNA
  Aplp1_11
tcatgctcgccgatttcccc

SEQ ID NO: 10354 - DNA, 20 bp, Artificial Sequence
  sgRNA
  Aplp1_12
ttacttcgtagagccccctc

SEQ ID NO: 10355 - DNA, 20 bp, Artificial Sequence
  sgRNA
  Aplp1_13
cccgctggatatctgacgag

SEQ ID NO: 10356 - DNA, 20 bp, Artificial Sequence
  sgRNA
  Aplp1_14
ccatggctgatagtcccata

SEQ ID NO: 10357 - DNA, 20 bp, Artificial Sequence
  sgRNA
  Aplp1_15
ggtgaatgcatccgccccga

SEQ ID NO: 10358 - DNA, 20 bp, Artificial Sequence
  sgRNA
  Aplp1_16
cccaacagccaggttcccga

SEQ ID NO: 10359 - DNA, 20 bp, Artificial Sequence
  sgRNA
  Aplp1_17
aggtgaatgcatccgccccg

SEQ ID NO: 10360 - DNA, 20 bp, Artificial Sequence
  sgRNA
  Aplp1_18
gctctttctgctcggcgcgc

SEQ ID NO: 10361 - DNA, 20 bp, Artificial Sequence
  sgRNA
  Aplp1_19
gctcgaccagaaccctcacc

SEQ ID NO: 10362 - DNA, 20 bp, Artificial Sequence
  sgRNA
  Aplp1_20
ggaggatgactcttgatctg

SEQ ID NO: 10363 - DNA, 20 bp, Artificial Sequence
  sgRNA
  Aplp2_1
ctggcacacgttagtcaagg

SEQ ID NO: 10364 - DNA, 20 bp, Artificial Sequence
  sgRNA
  Aplp2_2
gagaggtcgaagtaccaacg

SEQ ID NO: 10365 - DNA, 20 bp, Artificial Sequence
  sgRNA
  Aplp2_3
gcgtcggcggtcattcagca

SEQ ID NO: 10366 - DNA, 20 bp, Artificial Sequence
  sgRNA
  Aplp2_4
tcaacatcattggttggcag

SEQ ID NO: 10367 - DNA, 20 bp, Artificial Sequence
  sgRNA
  Aplp2_5
tattgatagttggtgccgaa

SEQ ID NO: 10368 - DNA, 20 bp, Artificial Sequence
  sgRNA
  Aplp2_6
aattcgacatcgaaaccgaa

SEQ ID NO: 10369 - DNA, 20 bp, Artificial Sequence
  sgRNA
  Aplp2_7
agctcacccggacatccaca

SEQ ID NO: 10370 - DNA, 20 bp, Artificial Sequence
  sgRNA
  Aplp2_8
gataacgatgaccgtagcaa

SEQ ID NO: 10371 - DNA, 20 bp, Artificial Sequence
  sgRNA
  Aplp2_9
acatcgaaaccgaatggaca

SEQ ID NO: 10372 - DNA, 20 bp, Artificial Sequence
  sgRNA
  Aplp2_10
tcgtcattaccaacacgtgt

SEQ ID NO: 10373 - DNA, 20 bp, Artificial Sequence
  sgRNA
  Aplp2_11
tgagcacgcccgcttccaga

SEQ ID NO: 10374 - DNA, 20 bp, Artificial Sequence
  sgRNA
  Aplp2_12
gctccttcaggaacagcgag

SEQ ID NO: 10375 - DNA, 20 bp, Artificial Sequence
  sgRNA
  Aplp2_13
ggtcaacagccaacacgtgt

SEQ ID NO: 10376 - DNA, 20 bp, Artificial Sequence
  sgRNA
  Aplp2_14
tatccgctcgctgttcctga

SEQ ID NO: 10377 - DNA, 20 bp, Artificial Sequence
  sgRNA
  Aplp2_15
ggaatggcagaacaagacgg

SEQ ID NO: 10378 - DNA, 20 bp, Artificial Sequence
  sgRNA
  Aplp2_16
tgcgtacgctttatatatgg

SEQ ID NO: 10379 - DNA, 20 bp, Artificial Sequence
  sgRNA
  Aplp2_17
tggtacttcgacctctccaa

SEQ ID NO: 10380 - DNA, 20 bp, Artificial Sequence
  sgRNA
  Aplp2_18
tggaactggtctaccccgca

SEQ ID NO: 10381 - DNA, 20 bp, Artificial Sequence
  sgRNA
  Aplp2_19
tggcttgctggttatcgcag

SEQ ID NO: 10382 - DNA, 20 bp, Artificial Sequence
  sgRNA
  Aplp2_20
gtacgcactttcccttggag

SEQ ID NO: 10383 - DNA, 20 bp, Artificial Sequence
  sgRNA
  App_1
cacggaagagtactgcatgg

SEQ ID NO: 10384 - DNA, 20 bp, Artificial Sequence
  sgRNA
  App_2
gcagcttgtagagacacaca

SEQ ID NO: 10385 - DNA, 20 bp, Artificial Sequence
  sgRNA
  App_3
aacggtaaggaatcacgatg

SEQ ID NO: 10386 - DNA, 20 bp, Artificial Sequence
  sgRNA
  App_4
caaaacctgcattggcacca

SEQ ID NO: 10387 - DNA, 20 bp, Artificial Sequence
  sgRNA
  App_5
cggaacttgtcgatgccgca

SEQ ID NO: 10388 - DNA, 20 bp, Artificial Sequence
  sgRNA
  App_6
gctgaagaagtacgtccgtg

SEQ ID NO: 10389 - DNA, 20 bp, Artificial Sequence
  sgRNA
  App_7
gtacttgtcgacggcgtcgg

SEQ ID NO: 10390 - DNA, 20 bp, Artificial Sequence
  sgRNA
  App_8
tgcgctcgtagatcacacgg

SEQ ID NO: 10391 - DNA, 20 bp, Artificial Sequence
  sgRNA
  App_9
cggcatcgacaagttccgag

SEQ ID NO: 10392 - DNA, 20 bp, Artificial Sequence
  sgRNA
  App_10
tgaactgcagatcacaaacg

SEQ ID NO: 10393 - DNA, 20 bp, Artificial Sequence
  sgRNA
  App_11
cagagcccgaaccgtccagg

SEQ ID NO: 10394 - DNA, 20 bp, Artificial Sequence
  sgRNA
  App_12
agtgacatcaaagtaccagc

SEQ ID NO: 10395 - DNA, 20 bp, Artificial Sequence
  sgRNA
  App_13
gcggcatcgacaagttccga

SEQ ID NO: 10396 - DNA, 20 bp, Artificial Sequence
  sgRNA
  App_14
tgggctgacaaacatcaaga

SEQ ID NO: 10397 - DNA, 20 bp, Artificial Sequence
  sgRNA
  App_15
tgacacggaagagtactgca

SEQ ID NO: 10398 - DNA, 20 bp, Artificial Sequence
  sgRNA
  App_16
agagtttgtatgctgcccgt

SEQ ID NO: 10399 - DNA, 20 bp, Artificial Sequence
  sgRNA
  App_17
ggtacttgtcgacggcgtcg

SEQ ID NO: 10400 - DNA, 20 bp, Artificial Sequence
  sgRNA
  App_18
accagcgggagatcattgcg

SEQ ID NO: 10401 - DNA, 20 bp, Artificial Sequence
  sgRNA
  App_19
gcatgctcgttctcgtcccc

SEQ ID NO: 10402 - DNA, 20 bp, Artificial Sequence
  sgRNA
  App_20
ggtactttgatgtcactgaa

SEQ ID NO: 10403 - DNA, 20 bp, Artificial Sequence
  sgRNA
  Aqp1_1
aagtgaattgtcgactaggg

SEQ ID NO: 10404 - DNA, 20 bp, Artificial Sequence
  sgRNA
  Aqp1_2
cctaggcttcaattacccac

SEQ ID NO: 10405 - DNA, 20 bp, Artificial Sequence
  sgRNA
  Aqp1_3
ggagccccagtgtgaccgca

SEQ ID NO: 10406 - DNA, 20 bp, Artificial Sequence
  sgRNA
  Aqp1_4
tgatgtacatgacagcccgg

SEQ ID NO: 10407 - DNA, 20 bp, Artificial Sequence
  sgRNA
  Aqp1_5
gctgcggtatcaaccctgcc

SEQ ID NO: 10408 - DNA, 20 bp, Artificial Sequence
  sgRNA
  Aqp1_6
tgctgacgacatcaactcca

SEQ ID NO: 10409 - DNA, 20 bp, Artificial Sequence
  sgRNA
  Aqp1_7
tccctagtcgacaattcact

SEQ ID NO: 10410 - DNA, 20 bp, Artificial Sequence
  sgRNA
  Aqp1_8
gctactctggcccaaagtgt

SEQ ID NO: 10411 - DNA, 20 bp, Artificial Sequence
  sgRNA
  Aqp1_9
gccagggcacccccaatgaa

SEQ ID NO: 10412 - DNA, 20 bp, Artificial Sequence
  sgRNA
  Aqp1_10
gcgtctggtttctctccagt

SEQ ID NO: 10413 - DNA, 20 bp, Artificial Sequence
  sgRNA
  Aqp1_11
gcacagcagagccaaatgac

SEQ ID NO: 10414 - DNA, 20 bp, Artificial Sequence
  sgRNA
  Aqp1_12
cggtgctcacctcaaccctg

SEQ ID NO: 10415 - DNA, 20 bp, Artificial Sequence
  sgRNA
  Aqp1_13
tgaattgtcgactagggagg

SEQ ID NO: 10416 - DNA, 20 bp, Artificial Sequence
  sgRNA
  Aqp1_14
ttctggccaccactgaccgg

SEQ ID NO: 10417 - DNA, 20 bp, Artificial Sequence
  sgRNA
  Aqp1_15
tgacgacatcaactccaggg

SEQ ID NO: 10418 - DNA, 20 bp, Artificial Sequence
  sgRNA
  Aqp1_16
gatgcccgagagaatggccg

SEQ ID NO: 10419 - DNA, 20 bp, Artificial Sequence
  sgRNA
  Aqp1_17
gtcatagatgagcactgcca

SEQ ID NO: 10420 - DNA, 20 bp, Artificial Sequence
  sgRNA
  Aqp1_18
tgtgggagccatcgtcgcca

SEQ ID NO: 10421 - DNA, 20 bp, Artificial Sequence
  sgRNA
  Aqp1_19
actggagagaaaccagacgc

SEQ ID NO: 10422 - DNA, 20 bp, Artificial Sequence
  sgRNA
  Aqp1_20
ggacaacgtgaaggtgtcgc

SEQ ID NO: 10423 - DNA, 20 bp, Artificial Sequence
  sgRNA
  Aqp2_1
gagcgccgcagtgacaacct

SEQ ID NO: 10424 - DNA, 20 bp, Artificial Sequence
  sgRNA
  Aqp2_2
tacccctgtagaaatccgcg

SEQ ID NO: 10425 - DNA, 20 bp, Artificial Sequence
  sgRNA
  Aqp2_3
atggcccagagcctgaacca

SEQ ID NO: 10426 - DNA, 20 bp, Artificial Sequence
  sgRNA
  Aqp2_4
ccttcgagctgccttctacg

SEQ ID NO: 10427 - DNA, 20 bp, Artificial Sequence
  sgRNA
  Aqp2_5
ggtccccgcggatttctaca

SEQ ID NO: 10428 - DNA, 20 bp, Artificial Sequence
  sgRNA
  Aqp2_6
ttacccctgtagaaatccgc

SEQ ID NO: 10429 - DNA, 20 bp, Artificial Sequence
  sgRNA
  Aqp2_7
gtccatagcgttctcccgag

SEQ ID NO: 10430 - DNA, 20 bp, Artificial Sequence
  sgRNA
  Aqp2_8
cattgacagccaggtccccg

SEQ ID NO: 10431 - DNA, 20 bp, Artificial Sequence
  sgRNA
  Aqp2_9
ggaactcggccagcaccgct

SEQ ID NO: 10432 - DNA, 20 bp, Artificial Sequence
  sgRNA
  Aqp2_10
gtccccgcggatttctacag

SEQ ID NO: 10433 - DNA, 20 bp, Artificial Sequence
  sgRNA
  Aqp2_11
attacccctgtagaaatccg

SEQ ID NO: 10434 - DNA, 20 bp, Artificial Sequence
  sgRNA
  Aqp2_12
ccacgtagaaggcagctcga

SEQ ID NO: 10435 - DNA, 20 bp, Artificial Sequence
  sgRNA
  Aqp2_13
agagctccacagtcaccgcc

SEQ ID NO: 10436 - DNA, 20 bp, Artificial Sequence
  sgRNA
  Aqp2_14
ggcacgccacagtcacagca

SEQ ID NO: 10437 - DNA, 20 bp, Artificial Sequence
  sgRNA
  Aqp2_15
gctcttcctgaccatgcagc

SEQ ID NO: 10438 - DNA, 20 bp, Artificial Sequence
  sgRNA
  Aqp2_16
caatgcaacagccggccagg

SEQ ID NO: 10439 - DNA, 20 bp, Artificial Sequence
  sgRNA
  Aqp2_17
ctacaggggtaatctcatgg

SEQ ID NO: 10440 - DNA, 20 bp, Artificial Sequence
  sgRNA
  Aqp2_18
cctgcaggctcttggtcgag

SEQ ID NO: 10441 - DNA, 20 bp, Artificial Sequence
  sgRNA
  Aqp2_19
gggaggaacgcgaagtgcgg

SEQ ID NO: 10442 - DNA, 20 bp, Artificial Sequence
  sgRNA
  Aqp2_20
actgcggcgctcatcagtgg

SEQ ID NO: 10443 - DNA, 20 bp, Artificial Sequence
  sgRNA
  Aqp4_1
ggatccaccataaactgggg

SEQ ID NO: 10444 - DNA, 20 bp, Artificial Sequence
  sgRNA
  Aqp4_2
accatggctacagtcacagc

SEQ ID NO: 10445 - DNA, 20 bp, Artificial Sequence
  sgRNA
  Aqp4_3
aagtgattattaactccacc

SEQ ID NO: 10446 - DNA, 20 bp, Artificial Sequence
  sgRNA
  Aqp4_4
aatcctccaaccacactggg

SEQ ID NO: 10447 - DNA, 20 bp, Artificial Sequence
  sgRNA
  Aqp4_5
catgtgattgacattgaccg

SEQ ID NO: 10448 - DNA, 20 bp, Artificial Sequence
  sgRNA
  Aqp4_6
gatctttcgtgtgcacacca

SEQ ID NO: 10449 - DNA, 20 bp, Artificial Sequence
  sgRNA
  Aqp4_7
tttggacccgcagttatcat

SEQ ID NO: 10450 - DNA, 20 bp, Artificial Sequence
  sgRNA
  Aqp4_8
cttccgtctccacttggctc

SEQ ID NO: 10451 - DNA, 20 bp, Artificial Sequence
  sgRNA
  Aqp4_9
catcattgcacagtgcctgg

SEQ ID NO: 10452 - DNA, 20 bp, Artificial Sequence
  sgRNA
  Aqp4_10
ggaccatgtccacaggtaag

SEQ ID NO: 10453 - DNA, 20 bp, Artificial Sequence
  sgRNA
  Aqp4_11
gtgggatccaccataaactg

SEQ ID NO: 10454 - DNA, 20 bp, Artificial Sequence
  sgRNA
  Aqp4_12
cagtagagagagcatcatgg

SEQ ID NO: 10455 - DNA, 20 bp, Artificial Sequence
  sgRNA
  Aqp4_13
tgtgggatccaccataaact

SEQ ID NO: 10456 - DNA, 20 bp, Artificial Sequence
  sgRNA
  Aqp4_14
gagcaaaacaaagataagcg

SEQ ID NO: 10457 - DNA, 20 bp, Artificial Sequence
  sgRNA
  Aqp4_15
ggttcaatagctttagcaat

SEQ ID NO: 10458 - DNA, 20 bp, Artificial Sequence
  sgRNA
  Aqp4_16
gaagacttgatcctgaagcc

SEQ ID NO: 10459 - DNA, 20 bp, Artificial Sequence
  sgRNA
  Aqp4_17
gcgggtccaaaagatcgagc

SEQ ID NO: 10460 - DNA, 20 bp, Artificial Sequence
  sgRNA
  Aqp4_18
ggagctcaaacgtcgcctta

SEQ ID NO: 10461 - DNA, 20 bp, Artificial Sequence
  sgRNA
  Aqp4_19
gtggccaaagcactgcacca

SEQ ID NO: 10462 - DNA, 20 bp, Artificial Sequence
  sgRNA
  Aqp4_20
cttgatcctgaagcccggag

SEQ ID NO: 10463 - DNA, 20 bp, Artificial Sequence
  sgRNA
  Aqp5_1
gagtaatggccggattgatg

SEQ ID NO: 10464 - DNA, 20 bp, Artificial Sequence
  sgRNA
  Aqp5_2
ttggcgccaggcaatgcccg

SEQ ID NO: 10465 - DNA, 20 bp, Artificial Sequence
  sgRNA
  Aqp5_3
gctccgagccatcttctacg

SEQ ID NO: 10466 - DNA, 20 bp, Artificial Sequence
  sgRNA
  Aqp5_4
acaagccaatggataaggct

SEQ ID NO: 10467 - DNA, 20 bp, Artificial Sequence
  sgRNA
  Aqp5_5
accgattcatgaccaccgca

SEQ ID NO: 10468 - DNA, 20 bp, Artificial Sequence
  sgRNA
  Aqp5_6
gctgagcctccacgaccgtg

SEQ ID NO: 10469 - DNA, 20 bp, Artificial Sequence
  sgRNA
  Aqp5_7
gataaggctggggagcccac

SEQ ID NO: 10470 - DNA, 20 bp, Artificial Sequence
  sgRNA
  Aqp5_8
agcccgatctttcggccctg

SEQ ID NO: 10471 - DNA, 20 bp, Artificial Sequence
  sgRNA
  Aqp5_9
ggttggcgccaggcaatgcc

SEQ ID NO: 10472 - DNA, 20 bp, Artificial Sequence
  sgRNA
  Aqp5_10
ataaggctggggagcccacc

SEQ ID NO: 10473 - DNA, 20 bp, Artificial Sequence
  sgRNA
  Aqp5_11
cagtgtgaccgacaagccaa

SEQ ID NO: 10474 - DNA, 20 bp, Artificial Sequence
  sgRNA
  Aqp5_12
gttaatcttgactttccagc

SEQ ID NO: 10475 - DNA, 20 bp, Artificial Sequence
  sgRNA
  Aqp5_13
acggtcgtggaggctcagcg

SEQ ID NO: 10476 - DNA, 20 bp, Artificial Sequence
  sgRNA
  Aqp5_14
gttggcgccaggcaatgccc

SEQ ID NO: 10477 - DNA, 20 bp, Artificial Sequence
  sgRNA
  Aqp5_15
aagagggccagagtaatggc

SEQ ID NO: 10478 - DNA, 20 bp, Artificial Sequence
  sgRNA
  Aqp5_16
gccaccactcacaggtccca

SEQ ID NO: 10479 - DNA, 20 bp, Artificial Sequence
  sgRNA
  Aqp5_17
tctgggtaggaccgatcgtg

SEQ ID NO: 10480 - DNA, 20 bp, Artificial Sequence
  sgRNA
  Aqp5_18
cacaacaccaggcaaggccg

SEQ ID NO: 10481 - DNA, 20 bp, Artificial Sequence
  sgRNA
  Aqp5_19
gggaagatcatagagaggag

SEQ ID NO: 10482 - DNA, 20 bp, Artificial Sequence
  sgRNA
  Aqp5_20
agaagtagaggattgcagcc

SEQ ID NO: 10483 - DNA, 20 bp, Artificial Sequence
  sgRNA
  Aqp8_1
ttgagaatagtccgaatact

SEQ ID NO: 10484 - DNA, 20 bp, Artificial Sequence
  sgRNA
  Aqp8_2
gggaccactcactttagcca

SEQ ID NO: 10485 - DNA, 20 bp, Artificial Sequence
  sgRNA
  Aqp8_3
gaattagcagcatggtcttg

SEQ ID NO: 10486 - DNA, 20 bp, Artificial Sequence
  sgRNA
  Aqp8_4
accatgtatagtggaacttg

SEQ ID NO: 10487 - DNA, 20 bp, Artificial Sequence
  sgRNA
  Aqp8_5
ggatctcccagctatttgga

SEQ ID NO: 10488 - DNA, 20 bp, Artificial Sequence
  sgRNA
  Aqp8_6
ggtaggtccatactacacat

SEQ ID NO: 10489 - DNA, 20 bp, Artificial Sequence
  sgRNA
  Aqp8_7
tgactgccagcgacacagca

SEQ ID NO: 10490 - DNA, 20 bp, Artificial Sequence
  sgRNA
  Aqp8_8
attgctcataccagaacaca

SEQ ID NO: 10491 - DNA, 20 bp, Artificial Sequence
  sgRNA
  Aqp8_9
tccgctctcttcatcttcat

SEQ ID NO: 10492 - DNA, 20 bp, Artificial Sequence
  sgRNA
  Aqp8_10
tccgatgaagatgaagagag

SEQ ID NO: 10493 - DNA, 20 bp, Artificial Sequence
  sgRNA
  Aqp8_11
ggtagcaatgatgagcccca

SEQ ID NO: 10494 - DNA, 20 bp, Artificial Sequence
  sgRNA
  Aqp8_12
ctggcagtcacagtgatcgg

SEQ ID NO: 10495 - DNA, 20 bp, Artificial Sequence
  sgRNA
  Aqp8_13
gtgtagtatggacctacctg

SEQ ID NO: 10496 - DNA, 20 bp, Artificial Sequence
  sgRNA
  Aqp8_14
gatcattctgacaatgctgt

SEQ ID NO: 10497 - DNA, 20 bp, Artificial Sequence
  sgRNA
  Aqp8_15
ggctcatcattgctaccttg

SEQ ID NO: 10498 - DNA, 20 bp, Artificial Sequence
  sgRNA
  Aqp8_16
aatcagccctccaaatagct

SEQ ID NO: 10499 - DNA, 20 bp, Artificial Sequence
  sgRNA
  Aqp8_17
taatgagcagtcctacaaag

SEQ ID NO: 10500 - DNA, 20 bp, Artificial Sequence
  sgRNA
  Aqp8_18
ccatgctgctaattccctat

SEQ ID NO: 10501 - DNA, 20 bp, Artificial Sequence
  sgRNA
  Aqp8_19
ggcccagccagtagatccaa

SEQ ID NO: 10502 - DNA, 20 bp, Artificial Sequence
  sgRNA
  Aqp8_20
aaatagctgggagatccaat

SEQ ID NO: 10503 - DNA, 20 bp, Artificial Sequence
  sgRNA
  Aqp9_1
acattgcaaaagacaccgct

SEQ ID NO: 10504 - DNA, 20 bp, Artificial Sequence
  sgRNA
  Aqp9_2
gtcttctatagacggactca

SEQ ID NO: 10505 - DNA, 20 bp, Artificial Sequence
  sgRNA
  Aqp9_3
tcagtcgagaaaaggctggt

SEQ ID NO: 10506 - DNA, 20 bp, Artificial Sequence
  sgRNA
  Aqp9_4
gctgagctcccacataaaag

SEQ ID NO: 10507 - DNA, 20 bp, Artificial Sequence
  sgRNA
  Aqp9_5
tgttctctcggactcaactc

SEQ ID NO: 10508 - DNA, 20 bp, Artificial Sequence
  sgRNA
  Aqp9_6
ccaagaagaacctcgtgcag

SEQ ID NO: 10509 - DNA, 20 bp, Artificial Sequence
  sgRNA
  Aqp9_7
ccaatcatagggcccacgac

SEQ ID NO: 10510 - DNA, 20 bp, Artificial Sequence
  sgRNA
  Aqp9_8
tatcaatattggatttgcaa

SEQ ID NO: 10511 - DNA, 20 bp, Artificial Sequence
  sgRNA
  Aqp9_9
tctttgactccagaaacctg

SEQ ID NO: 10512 - DNA, 20 bp, Artificial Sequence
  sgRNA
  Aqp9_10
ctttgactccagaaacctgg

SEQ ID NO: 10513 - DNA, 20 bp, Artificial Sequence
  sgRNA
  Aqp9_11
tttatgtgtgtgatgcgcct

SEQ ID NO: 10514 - DNA, 20 bp, Artificial Sequence
  sgRNA
  Aqp9_12
gcacctggcacggatacaaa

SEQ ID NO: 10515 - DNA, 20 bp, Artificial Sequence
  sgRNA
  Aqp9_13
gaaccactccatccttccaa

SEQ ID NO: 10516 - DNA, 20 bp, Artificial Sequence
  sgRNA
  Aqp9_14
gagacactctctgagttcct

SEQ ID NO: 10517 - DNA, 20 bp, Artificial Sequence
  sgRNA
  Aqp9_15
ggcgcatcacacacataaaa

SEQ ID NO: 10518 - DNA, 20 bp, Artificial Sequence
  sgRNA
  Aqp9_16
ccaggacagctccaatcata

SEQ ID NO: 10519 - DNA, 20 bp, Artificial Sequence
  sgRNA
  Aqp9_17
agctgagctcccacataaaa

SEQ ID NO: 10520 - DNA, 20 bp, Artificial Sequence
  sgRNA
  Aqp9_18
ttgcaatgtgcacctttgga

SEQ ID NO: 10521 - DNA, 20 bp, Artificial Sequence
  sgRNA
  Aqp9_19
gcacgaggttcttcttggct

SEQ ID NO: 10522 - DNA, 20 bp, Artificial Sequence
  sgRNA
  Aqp9_20
agaaacctgggggtccccag

SEQ ID NO: 10523 - DNA, 20 bp, Artificial Sequence
  sgRNA
  Areg_1
aggggactacgactactcag

SEQ ID NO: 10524 - DNA, 20 bp, Artificial Sequence
  sgRNA
  Areg_2
agaaggcatttcgcttatgg

SEQ ID NO: 10525 - DNA, 20 bp, Artificial Sequence
  sgRNA
  Areg_3
cagatacatcgagaacctgg

SEQ ID NO: 10526 - DNA, 20 bp, Artificial Sequence
  sgRNA
  Areg_4
gaaaggcgaatcgctttctg

SEQ ID NO: 10527 - DNA, 20 bp, Artificial Sequence
  sgRNA
  Areg_5
tgccgatgccaatagctgcg

SEQ ID NO: 10528 - DNA, 20 bp, Artificial Sequence
  sgRNA
  Areg_6
atccatgaagactcacagcg

SEQ ID NO: 10529 - DNA, 20 bp, Artificial Sequence
  sgRNA
  Areg_7
tgagtagtcgtagtcccctg

SEQ ID NO: 10530 - DNA, 20 bp, Artificial Sequence
  sgRNA
  Areg_8
gctcaagtccaccggcactg

SEQ ID NO: 10531 - DNA, 20 bp, Artificial Sequence
  sgRNA
  Areg_9
tctggcagtgaactctccac

SEQ ID NO: 10532 - DNA, 20 bp, Artificial Sequence
  sgRNA
  Areg_10
ctggcagtgaactctccaca

SEQ ID NO: 10533 - DNA, 20 bp, Artificial Sequence
  sgRNA
  Areg_11
ggaggcttcgacaagaaaac

SEQ ID NO: 10534 - DNA, 20 bp, Artificial Sequence
  sgRNA
  Areg_12
aacagcactgagcgcgccag

SEQ ID NO: 10535 - DNA, 20 bp, Artificial Sequence
  sgRNA
  Areg_13
ctactactgcaatcttggat

SEQ ID NO: 10536 - DNA, 20 bp, Artificial Sequence
  sgRNA
  Areg_14
accataagcgaaatgccttc

SEQ ID NO: 10537 - DNA, 20 bp, Artificial Sequence
  sgRNA
  Areg_15
agtctacagaaaaacccaaa

SEQ ID NO: 10538 - DNA, 20 bp, Artificial Sequence
  sgRNA
  Areg_16
atcctcgcagctattggcat

SEQ ID NO: 10539 - DNA, 20 bp, Artificial Sequence
  sgRNA
  Areg_17
cacagaaagctcaagtccac

SEQ ID NO: 10540 - DNA, 20 bp, Artificial Sequence
  sgRNA
  Areg_18
atacatcgagaacctggagg

SEQ ID NO: 10541 - DNA, 20 bp, Artificial Sequence
  sgRNA
  Areg_19
ggtggacttgagctttctgt

SEQ ID NO: 10542 - DNA, 20 bp, Artificial Sequence
  sgRNA
  Areg_20
gtggagagttcactgccaga

SEQ ID NO: 10543 - DNA, 20 bp, Artificial Sequence
  sgRNA
  Art1_1
tgccgcccaacaatttggcg

SEQ ID NO: 10544 - DNA, 20 bp, Artificial Sequence
  sgRNA
  Art1_2
tcaggccaacaaagtatacg

SEQ ID NO: 10545 - DNA, 20 bp, Artificial Sequence
  sgRNA
  Art1_3
aaagccccccagcctaacgg

SEQ ID NO: 10546 - DNA, 20 bp, Artificial Sequence
  sgRNA
  Art1_4
gctggcacccgcgagatcgg

SEQ ID NO: 10547 - DNA, 20 bp, Artificial Sequence
  sgRNA
  Art1_5
gcgttgaactccttgtgcag

SEQ ID NO: 10548 - DNA, 20 bp, Artificial Sequence
  sgRNA
  Art1_6
cctggaaagtttcgaaagga

SEQ ID NO: 10549 - DNA, 20 bp, Artificial Sequence
  sgRNA
  Art1_7
agtaggagagacatcatagc

SEQ ID NO: 10550 - DNA, 20 bp, Artificial Sequence
  sgRNA
  Art1_8
tgctcatcccggaagcccgg

SEQ ID NO: 10551 - DNA, 20 bp, Artificial Sequence
  sgRNA
  Art1_9
gtggctccggagcagttgca

SEQ ID NO: 10552 - DNA, 20 bp, Artificial Sequence
  sgRNA
  Art1_10
ttgggcggcaacgttcttga

SEQ ID NO: 10553 - DNA, 20 bp, Artificial Sequence
  sgRNA
  Art1_11
tactgcgtttgcccagagcg

SEQ ID NO: 10554 - DNA, 20 bp, Artificial Sequence
  sgRNA
  Art1_12
tgcgtttgcccagagcgcgg

SEQ ID NO: 10555 - DNA, 20 bp, Artificial Sequence
  sgRNA
  Art1_13
gcgctcctgccactgattgt

SEQ ID NO: 10556 - DNA, 20 bp, Artificial Sequence
  sgRNA
  Art1_14
agcaaagccccccagcctaa

SEQ ID NO: 10557 - DNA, 20 bp, Artificial Sequence
  sgRNA
  Art1_15
tccttgcccccatcaccgcc

SEQ ID NO: 10558 - DNA, 20 bp, Artificial Sequence
  sgRNA
  Art1_16
gtcctcgccaaattgttggg

SEQ ID NO: 10559 - DNA, 20 bp, Artificial Sequence
  sgRNA
  Art1_17
tctctcctactggtgtctgt

SEQ ID NO: 10560 - DNA, 20 bp, Artificial Sequence
  sgRNA
  Art1_18
tgagacccacagacaccagt

SEQ ID NO: 10561 - DNA, 20 bp, Artificial Sequence
  sgRNA
  Art1_19
gccaacaaagtatacgcgga

SEQ ID NO: 10562 - DNA, 20 bp, Artificial Sequence
  sgRNA
  Art1_20
tttggcgaggacaccttctt

SEQ ID NO: 10563 - DNA, 20 bp, Artificial Sequence
  sgRNA
  Art3_1
caggctgggtaacttcacgt

SEQ ID NO: 10564 - DNA, 20 bp, Artificial Sequence
  sgRNA
  Art3_2
ctcttgagcctcattcacgt

SEQ ID NO: 10565 - DNA, 20 bp, Artificial Sequence
  sgRNA
  Art3_3
ggacaatgcggagatccagt

SEQ ID NO: 10566 - DNA, 20 bp, Artificial Sequence
  sgRNA
  Art3_4
cgagaaaagttacaaaactg

SEQ ID NO: 10567 - DNA, 20 bp, Artificial Sequence
  sgRNA
  Art3_5
ctacgagtgcgcattcctcg

SEQ ID NO: 10568 - DNA, 20 bp, Artificial Sequence
  sgRNA
  Art3_6
gaaaattgtatcgcgaacgc

SEQ ID NO: 10569 - DNA, 20 bp, Artificial Sequence
  sgRNA
  Art3_7
tctggatggttagcacccgt

SEQ ID NO: 10570 - DNA, 20 bp, Artificial Sequence
  sgRNA
  Art3_8
gtattgccagaggatgcaga

SEQ ID NO: 10571 - DNA, 20 bp, Artificial Sequence
  sgRNA
  Art3_9
tggatgccatgactgatgga

SEQ ID NO: 10572 - DNA, 20 bp, Artificial Sequence
  sgRNA
  Art3_10
gggcaaacgatgcgctcctg

SEQ ID NO: 10573 - DNA, 20 bp, Artificial Sequence
  sgRNA
  Art3_11
gtaccgtcttcgggacaggc

SEQ ID NO: 10574 - DNA, 20 bp, Artificial Sequence
  sgRNA
  Art3_12
cggagacagccgacaaccaa

SEQ ID NO: 10575 - DNA, 20 bp, Artificial Sequence
  sgRNA
  Art3_13
gtagaagtgtgtactcacct

SEQ ID NO: 10576 - DNA, 20 bp, Artificial Sequence
  sgRNA
  Art3_14
gacctgctttggagtcgccg

SEQ ID NO: 10577 - DNA, 20 bp, Artificial Sequence
  sgRNA
  Art3_15
aggtcgtctcagcagctgca

SEQ ID NO: 10578 - DNA, 20 bp, Artificial Sequence
  sgRNA
  Art3_16
agtatattccgcagatgaag

SEQ ID NO: 10579 - DNA, 20 bp, Artificial Sequence
  sgRNA
  Art3_17
cctgaagtgcaaaagcagaa

SEQ ID NO: 10580 - DNA, 20 bp, Artificial Sequence
  sgRNA
  Art3_18
agaagcaacgagtaaaatgg

SEQ ID NO: 10581 - DNA, 20 bp, Artificial Sequence
  sgRNA
  Art3_19
cattgtcccacaccatccgc

SEQ ID NO: 10582 - DNA, 20 bp, Artificial Sequence
  sgRNA
  Art3_20
gcggatggtgtgggacaatg

SEQ ID NO: 10583 - DNA, 20 bp, Artificial Sequence
  sgRNA
  Art4_1
gtgagcattggagccaacgt

SEQ ID NO: 10584 - DNA, 20 bp, Artificial Sequence
  sgRNA
  Art4_2
gggtccagcagacacccgcg

SEQ ID NO: 10585 - DNA, 20 bp, Artificial Sequence
  sgRNA
  Art4_3
atggtggaggagctaaatca

SEQ ID NO: 10586 - DNA, 20 bp, Artificial Sequence
  sgRNA
  Art4_4
ataagtattactccagagca

SEQ ID NO: 10587 - DNA, 20 bp, Artificial Sequence
  sgRNA
  Art4_5
tttgaagtcgtaagtaagag

SEQ ID NO: 10588 - DNA, 20 bp, Artificial Sequence
  sgRNA
  Art4_6
cctcccggagagcatgaccc

SEQ ID NO: 10589 - DNA, 20 bp, Artificial Sequence
  sgRNA
  Art4_7
gtaggttccaccattcgatt

SEQ ID NO: 10590 - DNA, 20 bp, Artificial Sequence
  sgRNA
  Art4_8
gagagagaagtcttgcacag

SEQ ID NO: 10591 - DNA, 20 bp, Artificial Sequence
  sgRNA
  Art4_9
ggctcctcttaaggtcgacg

SEQ ID NO: 10592 - DNA, 20 bp, Artificial Sequence
  sgRNA
  Art4_10
cttcaaataactcatagggg

SEQ ID NO: 10593 - DNA, 20 bp, Artificial Sequence
  sgRNA
  Art4_11
ccgtgtctcttcctttagca

SEQ ID NO: 10594 - DNA, 20 bp, Artificial Sequence
  sgRNA
  Art4_12
gccttggtattgatcatcaa

SEQ ID NO: 10595 - DNA, 20 bp, Artificial Sequence
  sgRNA
  Art4_13
gaactggccgaatcgaatgg

SEQ ID NO: 10596 - DNA, 20 bp, Artificial Sequence
  sgRNA
  Art4_14
aatggccacagcatgcaccg

SEQ ID NO: 10597 - DNA, 20 bp, Artificial Sequence
  sgRNA
  Art4_15
tcgaatggtggaacctacgt

SEQ ID NO: 10598 - DNA, 20 bp, Artificial Sequence
  sgRNA
  Art4_16
tgtgagctctgacttggcca

SEQ ID NO: 10599 - DNA, 20 bp, Artificial Sequence
  sgRNA
  Art4_17
ctgtgttacaaggtgtacca

SEQ ID NO: 10600 - DNA, 20 bp, Artificial Sequence
  sgRNA
  Art4_18
gggatgaaggatgtgagcat

SEQ ID NO: 10601 - DNA, 20 bp, Artificial Sequence
  sgRNA
  Art4_19
acttcaaataactcataggg

SEQ ID NO: 10602 - DNA, 20 bp, Artificial Sequence
  sgRNA
  Art4_20
tgctcacatccttcatcccg

SEQ ID NO: 10603 - DNA, 20 bp, Artificial Sequence
  sgRNA
  Asgr1_1
tgtgtgatcacatcccaaag

SEQ ID NO: 10604 - DNA, 20 bp, Artificial Sequence
  sgRNA
  Asgr1_2
gaccatcatcaactccggag

SEQ ID NO: 10605 - DNA, 20 bp, Artificial Sequence
  sgRNA
  Asgr1_3
catactccacccagttgatg

SEQ ID NO: 10606 - DNA, 20 bp, Artificial Sequence
  sgRNA
  Asgr1_4
cagcagaaggatctgactga

SEQ ID NO: 10607 - DNA, 20 bp, Artificial Sequence
  sgRNA
  Asgr1_5
ggactgtgcccacttcacga

SEQ ID NO: 10608 - DNA, 20 bp, Artificial Sequence
  sgRNA
  Asgr1_6
tgtctcacagacccagcggt

SEQ ID NO: 10609 - DNA, 20 bp, Artificial Sequence
  sgRNA
  Asgr1_7
ataatgaccatcatcaactc

SEQ ID NO: 10610 - DNA, 20 bp, Artificial Sequence
  sgRNA
  Asgr1_8
gcgaagcttgagctgccaga

SEQ ID NO: 10611 - DNA, 20 bp, Artificial Sequence
  sgRNA
  Asgr1_9
gctggaaaatgcccatctgg

SEQ ID NO: 10612 - DNA, 20 bp, Artificial Sequence
  sgRNA
  Asgr1_10
tggaggtcaccaccaccaga

SEQ ID NO: 10613 - DNA, 20 bp, Artificial Sequence
  sgRNA
  Asgr1_11
tctggtggtggtgacctcca

SEQ ID NO: 10614 - DNA, 20 bp, Artificial Sequence
  sgRNA
  Asgr1_12
ttagagccagcagatcttcc

SEQ ID NO: 10615 - DNA, 20 bp, Artificial Sequence
  sgRNA
  Asgr1_13
actttgtctcacagacccag

SEQ ID NO: 10616 - DNA, 20 bp, Artificial Sequence
  sgRNA
  Asgr1_14
acatgggccccttaaacact

SEQ ID NO: 10617 - DNA, 20 bp, Artificial Sequence
  sgRNA
  Asgr1_15
ggaatgacgacgtctgcagg

SEQ ID NO: 10618 - DNA, 20 bp, Artificial Sequence
  sgRNA
  Asgr1_16
tcatactccacccagttgat

SEQ ID NO: 10619 - DNA, 20 bp, Artificial Sequence
  sgRNA
  Asgr1_17
aacttcctccagcgccacat

SEQ ID NO: 10620 - DNA, 20 bp, Artificial Sequence
  sgRNA
  Asgr1_18
agctgacaagtactgccagc

SEQ ID NO: 10621 - DNA, 20 bp, Artificial Sequence
  sgRNA
  Asgr1_19
tgcagacgtcgtcattccag

SEQ ID NO: 10622 - DNA, 20 bp, Artificial Sequence
  sgRNA
  Asgr1_20
gagcagccagataactggta

SEQ ID NO: 10623 - DNA, 20 bp, Artificial Sequence
  sgRNA
  Asgr2_1
ctaggatagaaaatccacac

SEQ ID NO: 10624 - DNA, 20 bp, Artificial Sequence
  sgRNA
  Asgr2_2
ttcctggttagcccaactgg

SEQ ID NO: 10625 - DNA, 20 bp, Artificial Sequence
  sgRNA
  Asgr2_3
cagagccccgaactccatca

SEQ ID NO: 10626 - DNA, 20 bp, Artificial Sequence
  sgRNA
  Asgr2_4
gagcagactgaggcggaacg

SEQ ID NO: 10627 - DNA, 20 bp, Artificial Sequence
  sgRNA
  Asgr2_5
cgaactccacccagttaaca

SEQ ID NO: 10628 - DNA, 20 bp, Artificial Sequence
  sgRNA
  Asgr2_6
tcagggttcgcagatccatt

SEQ ID NO: 10629 - DNA, 20 bp, Artificial Sequence
  sgRNA
  Asgr2_7
gcgaaccctgacctgtcagc

SEQ ID NO: 10630 - DNA, 20 bp, Artificial Sequence
  sgRNA
  Asgr2_8
ggagttgatgaccagcaggt

SEQ ID NO: 10631 - DNA, 20 bp, Artificial Sequence
  sgRNA
  Asgr2_9
gtactggtcagcctcagccc

SEQ ID NO: 10632 - DNA, 20 bp, Artificial Sequence
  sgRNA
  Asgr2_10
ctgccagcaggtgaaccgct

SEQ ID NO: 10633 - DNA, 20 bp, Artificial Sequence
  sgRNA
  Asgr2_11
ccagttatctggctgagtga

SEQ ID NO: 10634 - DNA, 20 bp, Artificial Sequence
  sgRNA
  Asgr2_12
gttaactgggtggagttcgg

SEQ ID NO: 10635 - DNA, 20 bp, Artificial Sequence
  sgRNA
  Asgr2_13
tttggataggtcttaccgac

SEQ ID NO: 10636 - DNA, 20 bp, Artificial Sequence
  sgRNA
  Asgr2_14
gctggtcatcaactccaggg

SEQ ID NO: 10637 - DNA, 20 bp, Artificial Sequence
  sgRNA
  Asgr2_15
atacccagcggttcacctgc

SEQ ID NO: 10638 - DNA, 20 bp, Artificial Sequence
  sgRNA
  Asgr2_16
gtacgccagctgacaggtca

SEQ ID NO: 10639 - DNA, 20 bp, Artificial Sequence
  sgRNA
  Asgr2_17
cacagatgaccaccaacagg

SEQ ID NO: 10640 - DNA, 20 bp, Artificial Sequence
  sgRNA
  Asgr2_18
tcacctgaagcacttcccaa

SEQ ID NO: 10641 - DNA, 20 bp, Artificial Sequence
  sgRNA
  Asgr2_19
gctgggtatgcgaaaagaga

SEQ ID NO: 10642 - DNA, 20 bp, Artificial Sequence
  sgRNA
  Asgr2_20
aggactttgttgtaaagcac

SEQ ID NO: 10643 - DNA, 20 bp, Artificial Sequence
  sgRNA
  Asic1_1
ccacgtcaccaagctcgacg

SEQ ID NO: 10644 - DNA, 20 bp, Artificial Sequence
  sgRNA
  Asic1_2
gtgggcaagaccgtgcagcg

SEQ ID NO: 10645 - DNA, 20 bp, Artificial Sequence
  sgRNA
  Asic1_3
ggaaaactgcaactgccgta

SEQ ID NO: 10646 - DNA, 20 bp, Artificial Sequence
  sgRNA
  Asic1_4
tctctcgtgccacttccgag

SEQ ID NO: 10647 - DNA, 20 bp, Artificial Sequence
  sgRNA
  Asic1_5
ggtttcacaatcaatccggc

SEQ ID NO: 10648 - DNA, 20 bp, Artificial Sequence
  sgRNA
  Asic1_6
tctgtaacaccaatgccgtg

SEQ ID NO: 10649 - DNA, 20 bp, Artificial Sequence
  sgRNA
  Asic1_7
gcagcaggacagctcagaat

SEQ ID NO: 10650 - DNA, 20 bp, Artificial Sequence
  sgRNA
  Asic1_8
gctgagctgggacaaccgca

SEQ ID NO: 10651 - DNA, 20 bp, Artificial Sequence
  sgRNA
  Asic1_9
aatccctgcgagagcctccg

SEQ ID NO: 10652 - DNA, 20 bp, Artificial Sequence
  sgRNA
  Asic1_10
gcagcgtacgtcatcccggc

SEQ ID NO: 10653 - DNA, 20 bp, Artificial Sequence
  sgRNA
  Asic1_11
agaaggcctatgagatcgca

SEQ ID NO: 10654 - DNA, 20 bp, Artificial Sequence
  sgRNA
  Asic1_12
tcatctagcaaagtcacgtg

SEQ ID NO: 10655 - DNA, 20 bp, Artificial Sequence
  sgRNA
  Asic1_13
cttcgactcctacagcatca

SEQ ID NO: 10656 - DNA, 20 bp, Artificial Sequence
  sgRNA
  Asic1_14
gcaaaggccaccaagtccct

SEQ ID NO: 10657 - DNA, 20 bp, Artificial Sequence
  sgRNA
  Asic1_15
tggtccccacaacttctcag

SEQ ID NO: 10658 - DNA, 20 bp, Artificial Sequence
  sgRNA
  Asic1_16
agcaccggctgtgtagacgt

SEQ ID NO: 10659 - DNA, 20 bp, Artificial Sequence
  sgRNA
  Asic1_17
tagaactcacgcatgttgaa

SEQ ID NO: 10660 - DNA, 20 bp, Artificial Sequence
  sgRNA
  Asic1_18
cctacagcatcacggcctgc

SEQ ID NO: 10661 - DNA, 20 bp, Artificial Sequence
  sgRNA
  Asic1_19
agagcagcatgtcctccagg

SEQ ID NO: 10662 - DNA, 20 bp, Artificial Sequence
  sgRNA
  Asic1_20
gggccaggtagagcaagtca

SEQ ID NO: 10663 - DNA, 20 bp, Artificial Sequence
  sgRNA
  Asic4_1
agccggaaaacccgccactg

SEQ ID NO: 10664 - DNA, 20 bp, Artificial Sequence
  sgRNA
  Asic4_2
tggactgcgcagaaccctgt

SEQ ID NO: 10665 - DNA, 20 bp, Artificial Sequence
  sgRNA
  Asic4_3
ttgtctccctccatatgggt

SEQ ID NO: 10666 - DNA, 20 bp, Artificial Sequence
  sgRNA
  Asic4_4
tccaggtctatactcgctat

SEQ ID NO: 10667 - DNA, 20 bp, Artificial Sequence
  sgRNA
  Asic4_5
tcagcgctgccactgccgga

SEQ ID NO: 10668 - DNA, 20 bp, Artificial Sequence
  sgRNA
  Asic4_6
ggatgaacagagcctcctgg

SEQ ID NO: 10669 - DNA, 20 bp, Artificial Sequence
  sgRNA
  Asic4_7
tgtcaggctctggatagcga

SEQ ID NO: 10670 - DNA, 20 bp, Artificial Sequence
  sgRNA
  Asic4_8
ccctgagctcgctttccgcc

SEQ ID NO: 10671 - DNA, 20 bp, Artificial Sequence
  sgRNA
  Asic4_9
tcagagttcactgcccagta

SEQ ID NO: 10672 - DNA, 20 bp, Artificial Sequence
  sgRNA
  Asic4_10
gatcatgctagacatccagc

SEQ ID NO: 10673 - DNA, 20 bp, Artificial Sequence
  sgRNA
  Asic4_11
ctcctgggatcggctcaaga

SEQ ID NO: 10674 - DNA, 20 bp, Artificial Sequence
  sgRNA
  Asic4_12
acttatctgccccagccttg

SEQ ID NO: 10675 - DNA, 20 bp, Artificial Sequence
  sgRNA
  Asic4_13
acgagacgtcattcgaggca

SEQ ID NO: 10676 - DNA, 20 bp, Artificial Sequence
  sgRNA
  Asic4_14
cccactgcggacatccaccg

SEQ ID NO: 10677 - DNA, 20 bp, Artificial Sequence
  sgRNA
  Asic4_15
ttgtgtcctgccaggaacag

SEQ ID NO: 10678 - DNA, 20 bp, Artificial Sequence
  sgRNA
  Asic4_16
cgatgctgatatcttccacc

SEQ ID NO: 10679 - DNA, 20 bp, Artificial Sequence
  sgRNA
  Asic4_17
gatccttgactacatctatg

SEQ ID NO: 10680 - DNA, 20 bp, Artificial Sequence
  sgRNA
  Asic4_18
tcaagagctgcaacttcagt

SEQ ID NO: 10681 - DNA, 20 bp, Artificial Sequence
  sgRNA
  Asic4_19
cctccttctcacagcgcagt

SEQ ID NO: 10682 - DNA, 20 bp, Artificial Sequence
  sgRNA
  Asic4_20
gcagtggcagcgctgaagca

SEQ ID NO: 10683 - DNA, 20 bp, Artificial Sequence
  sgRNA
  Asic5_1
gtccaccaggagtacccatg

SEQ ID NO: 10684 - DNA, 20 bp, Artificial Sequence
  sgRNA
  Asic5_2
aaacctaagccatcaaactg

SEQ ID NO: 10685 - DNA, 20 bp, Artificial Sequence
  sgRNA
  Asic5_3
aatattatgtatcccatgaa

SEQ ID NO: 10686 - DNA, 20 bp, Artificial Sequence
  sgRNA
  Asic5_4
gtggcaaatctacagtcgtt

SEQ ID NO: 10687 - DNA, 20 bp, Artificial Sequence
  sgRNA
  Asic5_5
ggtccaccaggagtacccat

SEQ ID NO: 10688 - DNA, 20 bp, Artificial Sequence
  sgRNA
  Asic5_6
tgagaaatcacaagtgcacg

SEQ ID NO: 10689 - DNA, 20 bp, Artificial Sequence
  sgRNA
  Asic5_7
aaatacttgaaacgatacag

SEQ ID NO: 10690 - DNA, 20 bp, Artificial Sequence
  sgRNA
  Asic5_8
acacagcctttgtatatgcc

SEQ ID NO: 10691 - DNA, 20 bp, Artificial Sequence
  sgRNA
  Asic5_9
tgttggcactgatttcctga

SEQ ID NO: 10692 - DNA, 20 bp, Artificial Sequence
  sgRNA
  Asic5_10
tcgaacttcttccggtcagt

SEQ ID NO: 10693 - DNA, 20 bp, Artificial Sequence
  sgRNA
  Asic5_11
ttatctcaataacgacactt

SEQ ID NO: 10694 - DNA, 20 bp, Artificial Sequence
  sgRNA
  Asic5_12
tggcactgatttcctgaagg

SEQ ID NO: 10695 - DNA, 20 bp, Artificial Sequence
  sgRNA
  Asic5_13
ttaggtttgtcttctcctgt

SEQ ID NO: 10696 - DNA, 20 bp, Artificial Sequence
  sgRNA
  Asic5_14
acttctatagatgttgtcgt

SEQ ID NO: 10697 - DNA, 20 bp, Artificial Sequence
  sgRNA
  Asic5_15
gctgctcctcgacgtccatc

SEQ ID NO: 10698 - DNA, 20 bp, Artificial Sequence
  sgRNA
  Asic5_16
gaaccagaacaaagttcgaa

SEQ ID NO: 10699 - DNA, 20 bp, Artificial Sequence
  sgRNA
  Asic5_17
ttgggattgcattctcccca

SEQ ID NO: 10700 - DNA, 20 bp, Artificial Sequence
  sgRNA
  Asic5_18
ctgtttcctcacatgacaca

SEQ ID NO: 10701 - DNA, 20 bp, Artificial Sequence
  sgRNA
  Asic5_19
tgggattgcattctccccat

SEQ ID NO: 10702 - DNA, 20 bp, Artificial Sequence
  sgRNA
  Asic5_20
gcaaagcccggcatatacaa

SEQ ID NO: 10703 - DNA, 20 bp, Artificial Sequence
  sgRNA
  Astn1_1
ccttacacgatatttcagcg

SEQ ID NO: 10704 - DNA, 20 bp, Artificial Sequence
  sgRNA
  Astn1_2
tgctcagatggtttcaacgg

SEQ ID NO: 10705 - DNA, 20 bp, Artificial Sequence
  sgRNA
  Astn1_3
tgacatgagaagagcacacg

SEQ ID NO: 10706 - DNA, 20 bp, Artificial Sequence
  sgRNA
  Astn1_4
tgatgatcctgtacactcgc

SEQ ID NO: 10707 - DNA, 20 bp, Artificial Sequence
  sgRNA
  Astn1_5
gtaaccacatgccttccccg

SEQ ID NO: 10708 - DNA, 20 bp, Artificial Sequence
  sgRNA
  Astn1_6
ctatgatcgccatatcggag

SEQ ID NO: 10709 - DNA, 20 bp, Artificial Sequence
  sgRNA
  Astn1_7
tatcatagccacaagccccg

SEQ ID NO: 10710 - DNA, 20 bp, Artificial Sequence
  sgRNA
  Astn1_8
tgtcccctacaatgactacg

SEQ ID NO: 10711 - DNA, 20 bp, Artificial Sequence
  sgRNA
  Astn1_9
gaatacagaagacatccccc

SEQ ID NO: 10712 - DNA, 20 bp, Artificial Sequence
  sgRNA
  Astn1_10
cgtggttcactcaagtacct

SEQ ID NO: 10713 - DNA, 20 bp, Artificial Sequence
  sgRNA
  Astn1_11
gctggtggttagaatccacg

SEQ ID NO: 10714 - DNA, 20 bp, Artificial Sequence
  sgRNA
  Astn1_12
aatgtgaccccgaaactggt

SEQ ID NO: 10715 - DNA, 20 bp, Artificial Sequence
  sgRNA
  Astn1_13
taactcatcttcacaccgcc

SEQ ID NO: 10716 - DNA, 20 bp, Artificial Sequence
  sgRNA
  Astn1_14
gattgcagcaaagataacgg

SEQ ID NO: 10717 - DNA, 20 bp, Artificial Sequence
  sgRNA
  Astn1_15
ttagaccagcaactgccgga

SEQ ID NO: 10718 - DNA, 20 bp, Artificial Sequence
  sgRNA
  Astn1_16
cgcactttggactccctaca

SEQ ID NO: 10719 - DNA, 20 bp, Artificial Sequence
  sgRNA
  Astn1_17
actgcgcctccggctccgag

SEQ ID NO: 10720 - DNA, 20 bp, Artificial Sequence
  sgRNA
  Astn1_18
gctcccgcctaccagtttcg

SEQ ID NO: 10721 - DNA, 20 bp, Artificial Sequence
  sgRNA
  Astn1_19
aggtcgttctcgcgcaggaa

SEQ ID NO: 10722 - DNA, 20 bp, Artificial Sequence
  sgRNA
  Astn1_20
actacagcaggcctaccccc

SEQ ID NO: 10723 - DNA, 20 bp, Artificial Sequence
  sgRNA
  Astn2_1
ggagccctcggagatcgttg

SEQ ID NO: 10724 - DNA, 20 bp, Artificial Sequence
  sgRNA
  Astn2_2
gatgtcgctttcccgcagag

SEQ ID NO: 10725 - DNA, 20 bp, Artificial Sequence
  sgRNA
  Astn2_3
gaggtggtatcatagggcaa

SEQ ID NO: 10726 - DNA, 20 bp, Artificial Sequence
  sgRNA
  Astn2_4
tcaggtatgatgaggccatg

SEQ ID NO: 10727 - DNA, 20 bp, Artificial Sequence
  sgRNA
  Astn2_5
aggctcatctgattctgcgg

SEQ ID NO: 10728 - DNA, 20 bp, Artificial Sequence
  sgRNA
  Astn2_6
tgtatgctgtggatactcga

SEQ ID NO: 10729 - DNA, 20 bp, Artificial Sequence
  sgRNA
  Astn2_7
agtggaagagcaatgccggg

SEQ ID NO: 10730 - DNA, 20 bp, Artificial Sequence
  sgRNA
  Astn2_8
tgttcctcaacgatctccga

SEQ ID NO: 10731 - DNA, 20 bp, Artificial Sequence
  sgRNA
  Astn2_9
gctttgttgtcatctaccag

SEQ ID NO: 10732 - DNA, 20 bp, Artificial Sequence
  sgRNA
  Astn2_10
acagacacggacctatacac

SEQ ID NO: 10733 - DNA, 20 bp, Artificial Sequence
  sgRNA
  Astn2_11
ctgaacatctacccactcca

SEQ ID NO: 10734 - DNA, 20 bp, Artificial Sequence
  sgRNA
  Astn2_12
tggctcccactacattgccg

SEQ ID NO: 10735 - DNA, 20 bp, Artificial Sequence
  sgRNA
  Astn2_13
ctgttcctcaacgatctccg

SEQ ID NO: 10736 - DNA, 20 bp, Artificial Sequence
  sgRNA
  Astn2_14
tcagtgcctttgatgccagt

SEQ ID NO: 10737 - DNA, 20 bp, Artificial Sequence
  sgRNA
  Astn2_15
agatcaatgccacctcgcca

SEQ ID NO: 10738 - DNA, 20 bp, Artificial Sequence
  sgRNA
  Astn2_16
tatggcccgaaacacgtacg

SEQ ID NO: 10739 - DNA, 20 bp, Artificial Sequence
  sgRNA
  Astn2_17
actcatcctcacgggagacg

SEQ ID NO: 10740 - DNA, 20 bp, Artificial Sequence
  sgRNA
  Astn2_18
ggatgactatgactatgaag

SEQ ID NO: 10741 - DNA, 20 bp, Artificial Sequence
  sgRNA
  Astn2_19
ctacctgtcacctttgccgc

SEQ ID NO: 10742 - DNA, 20 bp, Artificial Sequence
  sgRNA
  Astn2_20
gagaaggagacgagactccg

SEQ ID NO: 10743 - DNA, 20 bp, Artificial Sequence
  sgRNA
  Atg9a_1
agataaacttgataagccgg

SEQ ID NO: 10744 - DNA, 20 bp, Artificial Sequence
  sgRNA
  Atg9a_2
ctcggcttgctggtacactg

SEQ ID NO: 10745 - DNA, 20 bp, Artificial Sequence
  sgRNA
  Atg9a_3
cttcatcccagaccagcaca

SEQ ID NO: 10746 - DNA, 20 bp, Artificial Sequence
  sgRNA
  Atg9a_4
aggccgagtacaaacgtgga

SEQ ID NO: 10747 - DNA, 20 bp, Artificial Sequence
  sgRNA
  Atg9a_5
ctatagcgattcgccccccg

SEQ ID NO: 10748 - DNA, 20 bp, Artificial Sequence
  sgRNA
  Atg9a_6
cgacctcgaccgtaaagttg

SEQ ID NO: 10749 - DNA, 20 bp, Artificial Sequence
  sgRNA
  Atg9a_7
tgaagaagacaacctctccg

SEQ ID NO: 10750 - DNA, 20 bp, Artificial Sequence
  sgRNA
  Atg9a_8
gggcttccagaggcgctacg

SEQ ID NO: 10751 - DNA, 20 bp, Artificial Sequence
  sgRNA
  Atg9a_9
ttgccatcaccaatcccggc

SEQ ID NO: 10752 - DNA, 20 bp, Artificial Sequence
  sgRNA
  Atg9a_10
tgttggtgcatgtggccgag

SEQ ID NO: 10753 - DNA, 20 bp, Artificial Sequence
  sgRNA
  Atg9a_11
actcgtcccgggtctgcgag

SEQ ID NO: 10754 - DNA, 20 bp, Artificial Sequence
  sgRNA
  Atg9a_12
gcgaacgtccatctgagcaa

SEQ ID NO: 10755 - DNA, 20 bp, Artificial Sequence
  sgRNA
  Atg9a_13
gaggttgtcttcttcacccg

SEQ ID NO: 10756 - DNA, 20 bp, Artificial Sequence
  sgRNA
  Atg9a_14
ggatgtgtgcaagaatcact

SEQ ID NO: 10757 - DNA, 20 bp, Artificial Sequence
  sgRNA
  Atg9a_15
ccatgtagttctggaaacgt

SEQ ID NO: 10758 - DNA, 20 bp, Artificial Sequence
  sgRNA
  Atg9a_16
ctcaaggccgagtacaaacg

SEQ ID NO: 10759 - DNA, 20 bp, Artificial Sequence
  sgRNA
  Atg9a_17
gactcccaggagggtgaccg

SEQ ID NO: 10760 - DNA, 20 bp, Artificial Sequence
  sgRNA
  Atg9a_18
gtagcaggctcatcctgccg

SEQ ID NO: 10761 - DNA, 20 bp, Artificial Sequence
  sgRNA
  Atg9a_19
gcggtgccacacatgccgct

SEQ ID NO: 10762 - DNA, 20 bp, Artificial Sequence
  sgRNA
  Atg9a_20
gaagaagtctatgatctcca

SEQ ID NO: 10763 - DNA, 20 bp, Artificial Sequence
  sgRNA
  Atp13a1_1
agtcacacctgtatcatatg

SEQ ID NO: 10764 - DNA, 20 bp, Artificial Sequence
  sgRNA
  Atp13a1_2
gtggtgccaacccccaacaa

SEQ ID NO: 10765 - DNA, 20 bp, Artificial Sequence
  sgRNA
  Atp13a1_3
cattcccatagaaacacacc

SEQ ID NO: 10766 - DNA, 20 bp, Artificial Sequence
  sgRNA
  Atp13a1_4
acatccattgtcgaccgctg

SEQ ID NO: 10767 - DNA, 20 bp, Artificial Sequence
  sgRNA
  Atp13a1_5
gcgtcgtcaccaatgtgcac

SEQ ID NO: 10768 - DNA, 20 bp, Artificial Sequence
  sgRNA
  Atp13a1_6
cgtagcagcagtacatcaca

SEQ ID NO: 10769 - DNA, 20 bp, Artificial Sequence
  sgRNA
  Atp13a1_7
gggccagcactcatagcgaa

SEQ ID NO: 10770 - DNA, 20 bp, Artificial Sequence
  sgRNA
  Atp13a1_8
acttcaaccttgccagcgaa

SEQ ID NO: 10771 - DNA, 20 bp, Artificial Sequence
  sgRNA
  Atp13a1_9
tcaagactctttcccgagag

SEQ ID NO: 10772 - DNA, 20 bp, Artificial Sequence
  sgRNA
  Atp13a1_10
ggacagtgagtgcgtgcgcg

SEQ ID NO: 10773 - DNA, 20 bp, Artificial Sequence
  sgRNA
  Atp13a1_11
gctggatgacggcaccctag

SEQ ID NO: 10774 - DNA, 20 bp, Artificial Sequence
  sgRNA
  Atp13a1_12
gatgacatgcagccgagcat

SEQ ID NO: 10775 - DNA, 20 bp, Artificial Sequence
  sgRNA
  Atp13a1_13
ggtgccatctccacacataa

SEQ ID NO: 10776 - DNA, 20 bp, Artificial Sequence
  sgRNA
  Atp13a1_14
cttcaaccttgccagcgaag

SEQ ID NO: 10777 - DNA, 20 bp, Artificial Sequence
  sgRNA
  Atp13a1_15
gagcttgtaacggttccggc

SEQ ID NO: 10778 - DNA, 20 bp, Artificial Sequence
  sgRNA
  Atp13a1_16
tggcctcgtctacaatgcag

SEQ ID NO: 10779 - DNA, 20 bp, Artificial Sequence
  sgRNA
  Atp13a1_17
gatccagaatgcatcccaca

SEQ ID NO: 10780 - DNA, 20 bp, Artificial Sequence
  sgRNA
  Atp13a1_18
ggttggcaccaccttcacaa

SEQ ID NO: 10781 - DNA, 20 bp, Artificial Sequence
  sgRNA
  Atp13a1_19
gcatcccccagcttcacgat

SEQ ID NO: 10782 - DNA, 20 bp, Artificial Sequence
  sgRNA
  Atp13a1_20
gcacagaccaatgccccgac

SEQ ID NO: 10783 - DNA, 20 bp, Artificial Sequence
  sgRNA
  Atp13a2_1
cgtcatcacaggtacgaccg

SEQ ID NO: 10784 - DNA, 20 bp, Artificial Sequence
  sgRNA
  Atp13a2_2
ccagctacatgacaccccgg

SEQ ID NO: 10785 - DNA, 20 bp, Artificial Sequence
  sgRNA
  Atp13a2_3
gggaccccgtgtgctagcag

SEQ ID NO: 10786 - DNA, 20 bp, Artificial Sequence
  sgRNA
  Atp13a2_4
tgtggtagtgacatggccag

SEQ ID NO: 10787 - DNA, 20 bp, Artificial Sequence
  sgRNA
  Atp13a2_5
ggtccacgtttgcagtcctt

SEQ ID NO: 10788 - DNA, 20 bp, Artificial Sequence
  sgRNA
  Atp13a2_6
gcccaactacgagaatacgg

SEQ ID NO: 10789 - DNA, 20 bp, Artificial Sequence
  sgRNA
  Atp13a2_7
gctcatgagcaccgcaaccg

SEQ ID NO: 10790 - DNA, 20 bp, Artificial Sequence
  sgRNA
  Atp13a2_8
ctataacgagtgtttcggcg

SEQ ID NO: 10791 - DNA, 20 bp, Artificial Sequence
  sgRNA
  Atp13a2_9
gccgtgggagtgacaccaga

SEQ ID NO: 10792 - DNA, 20 bp, Artificial Sequence
  sgRNA
  Atp13a2_10
ttagctgctgagcggccgca

SEQ ID NO: 10793 - DNA, 20 bp, Artificial Sequence
  sgRNA
  Atp13a2_11
agcacctgagaaaagtcgct

SEQ ID NO: 10794 - DNA, 20 bp, Artificial Sequence
  sgRNA
  Atp13a2_12
gaacctactgaagccacaga

SEQ ID NO: 10795 - DNA, 20 bp, Artificial Sequence
  sgRNA
  Atp13a2_13
ggccatcggctatcacgccg

SEQ ID NO: 10796 - DNA, 20 bp, Artificial Sequence
  sgRNA
  Atp13a2_14
aggtcaacgctacgtctgga

SEQ ID NO: 10797 - DNA, 20 bp, Artificial Sequence
  sgRNA
  Atp13a2_15
cagctacatgacaccccggt

SEQ ID NO: 10798 - DNA, 20 bp, Artificial Sequence
  sgRNA
  Atp13a2_16
gcagggccgtcttcagcaca

SEQ ID NO: 10799 - DNA, 20 bp, Artificial Sequence
  sgRNA
  Atp13a2_17
gtgcaggtgtgccgacccgg

SEQ ID NO: 10800 - DNA, 20 bp, Artificial Sequence
  sgRNA
  Atp13a2_18
gaagagggtgtgccgccggt

SEQ ID NO: 10801 - DNA, 20 bp, Artificial Sequence
  sgRNA
  Atp13a2_19
gcctccaggaccaagctacg

SEQ ID NO: 10802 - DNA, 20 bp, Artificial Sequence
  sgRNA
  Atp13a2_20
atgtggtagtgacatggcca

SEQ ID NO: 10803 - DNA, 20 bp, Artificial Sequence
  sgRNA
  Atp13a3_1
atagtgcaggactgacacag

SEQ ID NO: 10804 - DNA, 20 bp, Artificial Sequence
  sgRNA
  Atp13a3_2
ttcagcgagtggaaaatacc

SEQ ID NO: 10805 - DNA, 20 bp, Artificial Sequence
  sgRNA
  Atp13a3_3
ttaataagtactgcatcaca

SEQ ID NO: 10806 - DNA, 20 bp, Artificial Sequence
  sgRNA
  Atp13a3_4
taaccggatcatgcctactg

SEQ ID NO: 10807 - DNA, 20 bp, Artificial Sequence
  sgRNA
  Atp13a3_5
gcctaaacctcagacaacga

SEQ ID NO: 10808 - DNA, 20 bp, Artificial Sequence
  sgRNA
  Atp13a3_6
tgtgtgcaagagcaattaca

SEQ ID NO: 10809 - DNA, 20 bp, Artificial Sequence
  sgRNA
  Atp13a3_7
gcggccactcaggatcaaag

SEQ ID NO: 10810 - DNA, 20 bp, Artificial Sequence
  sgRNA
  Atp13a3_8
gagactggcgacaacctcag

SEQ ID NO: 10811 - DNA, 20 bp, Artificial Sequence
  sgRNA
  Atp13a3_9
tgtgtttgctcgaatggcac

SEQ ID NO: 10812 - DNA, 20 bp, Artificial Sequence
  sgRNA
  Atp13a3_10
gcaataataactttatcctg

SEQ ID NO: 10813 - DNA, 20 bp, Artificial Sequence
  sgRNA
  Atp13a3_11
tgattcactacactgtgaca

SEQ ID NO: 10814 - DNA, 20 bp, Artificial Sequence
  sgRNA
  Atp13a3_12
gatggatgcctacatgaagg

SEQ ID NO: 10815 - DNA, 20 bp, Artificial Sequence
  sgRNA
  Atp13a3_13
caaatcttcaagtactgcag

SEQ ID NO: 10816 - DNA, 20 bp, Artificial Sequence
  sgRNA
  Atp13a3_14
gattgaatacaactttccaa

SEQ ID NO: 10817 - DNA, 20 bp, Artificial Sequence
  sgRNA
  Atp13a3_15
ggatcagaagacacaattgg

SEQ ID NO: 10818 - DNA, 20 bp, Artificial Sequence
  sgRNA
  Atp13a3_16
atgccgctggaagcttgcca

SEQ ID NO: 10819 - DNA, 20 bp, Artificial Sequence
  sgRNA
  Atp13a3_17
acccagcgactgaaatccaa

SEQ ID NO: 10820 - DNA, 20 bp, Artificial Sequence
  sgRNA
  Atp13a3_18
tgtgatgcagtacttattaa

SEQ ID NO: 10821 - DNA, 20 bp, Artificial Sequence
  sgRNA
  Atp13a3_19
aatcactcctacaaaaacca

SEQ ID NO: 10822 - DNA, 20 bp, Artificial Sequence
  sgRNA
  Atp13a3_20
gaagcattacctccaaagga

SEQ ID NO: 10823 - DNA, 20 bp, Artificial Sequence
  sgRNA
  Atp13a5_1
gtgtgggcccaactcgatcg

SEQ ID NO: 10824 - DNA, 20 bp, Artificial Sequence
  sgRNA
  Atp13a5_2
gcttataggaaacttcagtg

SEQ ID NO: 10825 - DNA, 20 bp, Artificial Sequence
  sgRNA
  Atp13a5_3
cttgatcgatgggagttgtg

SEQ ID NO: 10826 - DNA, 20 bp, Artificial Sequence
  sgRNA
  Atp13a5_4
tgtcagtacccgtttcagag

SEQ ID NO: 10827 - DNA, 20 bp, Artificial Sequence
  sgRNA
  Atp13a5_5
gtttcggtccaaactcacgt

SEQ ID NO: 10828 - DNA, 20 bp, Artificial Sequence
  sgRNA
  Atp13a5_6
gcttctgtgctaagtttcga

SEQ ID NO: 10829 - DNA, 20 bp, Artificial Sequence
  sgRNA
  Atp13a5_7
acagcagccttggtactgcg

SEQ ID NO: 10830 - DNA, 20 bp, Artificial Sequence
  sgRNA
  Atp13a5_8
gacccaatccaaacgtatgg

SEQ ID NO: 10831 - DNA, 20 bp, Artificial Sequence
  sgRNA
  Atp13a5_9
gcaacgtgtacgcccagaag

SEQ ID NO: 10832 - DNA, 20 bp, Artificial Sequence
  sgRNA
  Atp13a5_10
gctgtttccgatgtcaatgt

SEQ ID NO: 10833 - DNA, 20 bp, Artificial Sequence
  sgRNA
  Atp13a5_11
gctaccatacccagaattta

SEQ ID NO: 10834 - DNA, 20 bp, Artificial Sequence
  sgRNA
  Atp13a5_12
tccaaactgtgcgatttcca

SEQ ID NO: 10835 - DNA, 20 bp, Artificial Sequence
  sgRNA
  Atp13a5_13
gcgtagatgggtttccgaaa

SEQ ID NO: 10836 - DNA, 20 bp, Artificial Sequence
  sgRNA
  Atp13a5_14
gagatattctcattcttcca

SEQ ID NO: 10837 - DNA, 20 bp, Artificial Sequence
  sgRNA
  Atp13a5_15
aggtcaagccatctgctcag

SEQ ID NO: 10838 - DNA, 20 bp, Artificial Sequence
  sgRNA
  Atp13a5_16
gcagaaaataaggtacgtgt

SEQ ID NO: 10839 - DNA, 20 bp, Artificial Sequence
  sgRNA
  Atp13a5_17
ttaacaagcagcttccatat

SEQ ID NO: 10840 - DNA, 20 bp, Artificial Sequence
  sgRNA
  Atp13a5_18
taatctgtcctgttcacggg

SEQ ID NO: 10841 - DNA, 20 bp, Artificial Sequence
  sgRNA
  Atp13a5_19
gtagggagccaacttcgggt

SEQ ID NO: 10842 - DNA, 20 bp, Artificial Sequence
  sgRNA
  Atp13a5_20
gctgctctggtctcatcctt

SEQ ID NO: 10843 - DNA, 20 bp, Artificial Sequence
  sgRNA
  Atp1a1_1
gtacacgacgatgccacgtg

SEQ ID NO: 10844 - DNA, 20 bp, Artificial Sequence
  sgRNA
  Atp1a1_2
cttaccactctgattctccg

SEQ ID NO: 10845 - DNA, 20 bp, Artificial Sequence
  sgRNA
  Atp1a1_3
aatctgttccgtatttacga

SEQ ID NO: 10846 - DNA, 20 bp, Artificial Sequence
  sgRNA
  Atp1a1_4
gaaaatgagcatcaatgcgg

SEQ ID NO: 10847 - DNA, 20 bp, Artificial Sequence
  sgRNA
  Atp1a1_5
cgaagcagaggttatccacg

SEQ ID NO: 10848 - DNA, 20 bp, Artificial Sequence
  sgRNA
  Atp1a1_6
tgacgatgtcaatttccccg

SEQ ID NO: 10849 - DNA, 20 bp, Artificial Sequence
  sgRNA
  Atp1a1_7
ggtcttgcagatgaccaagt

SEQ ID NO: 10850 - DNA, 20 bp, Artificial Sequence
  sgRNA
  Atp1a1_8
gtcaccatgctccgatacag

SEQ ID NO: 10851 - DNA, 20 bp, Artificial Sequence
  sgRNA
  Atp1a1_9
tgcggaagctcattatcagg

SEQ ID NO: 10852 - DNA, 20 bp, Artificial Sequence
  sgRNA
  Atp1a1_10
cacgaagcagaggttatcca

SEQ ID NO: 10853 - DNA, 20 bp, Artificial Sequence
  sgRNA
  Atp1a1_11
gatccatgaagctgacacca

SEQ ID NO: 10854 - DNA, 20 bp, Artificial Sequence
  sgRNA
  Atp1a1_12
ggatgaagaaagacaccccc

SEQ ID NO: 10855 - DNA, 20 bp, Artificial Sequence
  sgRNA
  Atp1a1_13
gcaaacattccactgcccct

SEQ ID NO: 10856 - DNA, 20 bp, Artificial Sequence
  sgRNA
  Atp1a1_14
cagcagagagcaccaccccg

SEQ ID NO: 10857 - DNA, 20 bp, Artificial Sequence
  sgRNA
  Atp1a1_15
gtaagtgaagaagcctccca

SEQ ID NO: 10858 - DNA, 20 bp, Artificial Sequence
  sgRNA
  Atp1a1_16
cctgacgaacagtttcccga

SEQ ID NO: 10859 - DNA, 20 bp, Artificial Sequence
  sgRNA
  Atp1a1_17
tcactgccaagcgcatggcg

SEQ ID NO: 10860 - DNA, 20 bp, Artificial Sequence
  sgRNA
  Atp1a1_18
gcgccatcgtggccgtcaca

SEQ ID NO: 10861 - DNA, 20 bp, Artificial Sequence
  sgRNA
  Atp1a1_19
ctctccatttcgaatcacaa

SEQ ID NO: 10862 - DNA, 20 bp, Artificial Sequence
  sgRNA
  Atp1a1_20
gcagcccagaaaccccaaaa

SEQ ID NO: 10863 - DNA, 20 bp, Artificial Sequence
  sgRNA
  Atp1a2_1
gctgggccgaaaataccaag

SEQ ID NO: 10864 - DNA, 20 bp, Artificial Sequence
  sgRNA
  Atp1a2_2
ggatggttcgtcctccatag

SEQ ID NO: 10865 - DNA, 20 bp, Artificial Sequence
  sgRNA
  Atp1a2_3
ggataactcatccctaacag

SEQ ID NO: 10866 - DNA, 20 bp, Artificial Sequence
  sgRNA
  Atp1a2_4
ctggccccctaccttagaca

SEQ ID NO: 10867 - DNA, 20 bp, Artificial Sequence
  sgRNA
  Atp1a2_5
tttcttctctaccaactgcg

SEQ ID NO: 10868 - DNA, 20 bp, Artificial Sequence
  sgRNA
  Atp1a2_6
tcgtagccaatgtgcccgaa

SEQ ID NO: 10869 - DNA, 20 bp, Artificial Sequence
  sgRNA
  Atp1a2_7
ttcggaagctcatcctacgg

SEQ ID NO: 10870 - DNA, 20 bp, Artificial Sequence
  sgRNA
  Atp1a2_8
gtatcaaatttgaagccccg

SEQ ID NO: 10871 - DNA, 20 bp, Artificial Sequence
  sgRNA
  Atp1a2_9
agatattgcgcgtctccaag

SEQ ID NO: 10872 - DNA, 20 bp, Artificial Sequence
  sgRNA
  Atp1a2_10
ccttctggaaagtttcctcg

SEQ ID NO: 10873 - DNA, 20 bp, Artificial Sequence
  sgRNA
  Atp1a2_11
gatgaaatgctcgatctcca

SEQ ID NO: 10874 - DNA, 20 bp, Artificial Sequence
  sgRNA
  Atp1a2_12
atagctgtcctccaggtcgt

SEQ ID NO: 10875 - DNA, 20 bp, Artificial Sequence
  sgRNA
  Atp1a2_13
gagaccagcgatccgagaca

SEQ ID NO: 10876 - DNA, 20 bp, Artificial Sequence
  sgRNA
  Atp1a2_14
gcggctgtagttatcgtcac

SEQ ID NO: 10877 - DNA, 20 bp, Artificial Sequence
  sgRNA
  Atp1a2_15
gcagctggatgagatcctca

SEQ ID NO: 10878 - DNA, 20 bp, Artificial Sequence
  sgRNA
  Atp1a2_16
tttcatccagctgatcacag

SEQ ID NO: 10879 - DNA, 20 bp, Artificial Sequence
  sgRNA
  Atp1a2_17
tgtcagccttcttcagcgcg

SEQ ID NO: 10880 - DNA, 20 bp, Artificial Sequence
  sgRNA
  Atp1a2_18
gcaagctctggtcatccgag

SEQ ID NO: 10881 - DNA, 20 bp, Artificial Sequence
  sgRNA
  Atp1a2_19
gtttgacaaccagatccatg

SEQ ID NO: 10882 - DNA, 20 bp, Artificial Sequence
  sgRNA
  Atp1a2_20
agatgatccggaggtcagca

SEQ ID NO: 10883 - DNA, 20 bp, Artificial Sequence
  sgRNA
  Atp1a3_1
gtttgacaaccagatccacg

SEQ ID NO: 10884 - DNA, 20 bp, Artificial Sequence
  sgRNA
  Atp1a3_2
catcctgcgcaggaaccccg

SEQ ID NO: 10885 - DNA, 20 bp, Artificial Sequence
  sgRNA
  Atp1a3_3
ggctaccaccacaccccgag

SEQ ID NO: 10886 - DNA, 20 bp, Artificial Sequence
  sgRNA
  Atp1a3_4
gccgcagtcgtgatcatcac

SEQ ID NO: 10887 - DNA, 20 bp, Artificial Sequence
  sgRNA
  Atp1a3_5
atcctgcgcaggaaccccgg

SEQ ID NO: 10888 - DNA, 20 bp, Artificial Sequence
  sgRNA
  Atp1a3_6
catcagctttacggaacccg

SEQ ID NO: 10889 - DNA, 20 bp, Artificial Sequence
  sgRNA
  Atp1a3_7
gcgagaacggaacaagaaag

SEQ ID NO: 10890 - DNA, 20 bp, Artificial Sequence
  sgRNA
  Atp1a3_8
gcagaacttgacccattctg

SEQ ID NO: 10891 - DNA, 20 bp, Artificial Sequence
  sgRNA
  Atp1a3_9
gtaggagaagaaaccaccga

SEQ ID NO: 10892 - DNA, 20 bp, Artificial Sequence
  sgRNA
  Atp1a3_10
tctgacacacagtaaagccc

SEQ ID NO: 10893 - DNA, 20 bp, Artificial Sequence
  sgRNA
  Atp1a3_11
gagtatcgtggtggtccagt

SEQ ID NO: 10894 - DNA, 20 bp, Artificial Sequence
  sgRNA
  Atp1a3_12
gatgaaatgctcaatctcaa

SEQ ID NO: 10895 - DNA, 20 bp, Artificial Sequence
  sgRNA
  Atp1a3_13
cagctcaatgcacttaagca

SEQ ID NO: 10896 - DNA, 20 bp, Artificial Sequence
  sgRNA
  Atp1a3_14
agtaggagaagaaaccaccg

SEQ ID NO: 10897 - DNA, 20 bp, Artificial Sequence
  sgRNA
  Atp1a3_15
ttcaccttcccggatcacaa

SEQ ID NO: 10898 - DNA, 20 bp, Artificial Sequence
  sgRNA
  Atp1a3_16
catccagctcattacgggcg

SEQ ID NO: 10899 - DNA, 20 bp, Artificial Sequence
  sgRNA
  Atp1a3_17
acatgagacccacaaagcaa

SEQ ID NO: 10900 - DNA, 20 bp, Artificial Sequence
  sgRNA
  Atp1a3_18
gccggtgatgatcacgactg

SEQ ID NO: 10901 - DNA, 20 bp, Artificial Sequence
  sgRNA
  Atp1a3_19
gctccgaggtgaagtccttg

SEQ ID NO: 10902 - DNA, 20 bp, Artificial Sequence
  sgRNA
  Atp1a3_20
tgtgccaccatcctcctgca

SEQ ID NO: 10903 - DNA, 20 bp, Artificial Sequence
  sgRNA
  Atp1a4_1
ttcagaaggtaacgacacgg

SEQ ID NO: 10904 - DNA, 20 bp, Artificial Sequence
  sgRNA
  Atp1a4_2
ggggattgtactatctgccg

SEQ ID NO: 10905 - DNA, 20 bp, Artificial Sequence
  sgRNA
  Atp1a4_3
agataaccctgatatcagca

SEQ ID NO: 10906 - DNA, 20 bp, Artificial Sequence
  sgRNA
  Atp1a4_4
ggatgatcacaagctaacgt

SEQ ID NO: 10907 - DNA, 20 bp, Artificial Sequence
  sgRNA
  Atp1a4_5
gcttccacggaaccccaaaa

SEQ ID NO: 10908 - DNA, 20 bp, Artificial Sequence
  sgRNA
  Atp1a4_6
tctgcctcatttcgctcacg

SEQ ID NO: 10909 - DNA, 20 bp, Artificial Sequence
  sgRNA
  Atp1a4_7
tgtgagcaaatgtcgaagcg

SEQ ID NO: 10910 - DNA, 20 bp, Artificial Sequence
  sgRNA
  Atp1a4_8
cataggccatgccaataaga

SEQ ID NO: 10911 - DNA, 20 bp, Artificial Sequence
  sgRNA
  Atp1a4_9
tgagcaaatgtcgaagcgcg

SEQ ID NO: 10912 - DNA, 20 bp, Artificial Sequence
  sgRNA
  Atp1a4_10
catgattgatcctcctcgga

SEQ ID NO: 10913 - DNA, 20 bp, Artificial Sequence
  sgRNA
  Atp1a4_11
ttcaggtgattcataagcca

SEQ ID NO: 10914 - DNA, 20 bp, Artificial Sequence
  sgRNA
  Atp1a4_12
acaaatgcgccactgtcatg

SEQ ID NO: 10915 - DNA, 20 bp, Artificial Sequence
  sgRNA
  Atp1a4_13
cttgagtgggtacatccgca

SEQ ID NO: 10916 - DNA, 20 bp, Artificial Sequence
  sgRNA
  Atp1a4_14
gatgaagtgttcgatttcgg

SEQ ID NO: 10917 - DNA, 20 bp, Artificial Sequence
  sgRNA
  Atp1a4_15
gtttctgattcagctcacca

SEQ ID NO: 10918 - DNA, 20 bp, Artificial Sequence
  sgRNA
  Atp1a4_16
tctccatgattgatcctcct

SEQ ID NO: 10919 - DNA, 20 bp, Artificial Sequence
  sgRNA
  Atp1a4_17
cggcagatagtacaatcccc

SEQ ID NO: 10920 - DNA, 20 bp, Artificial Sequence
  sgRNA
  Atp1a4_18
tgatattccgtgtctccaga

SEQ ID NO: 10921 - DNA, 20 bp, Artificial Sequence
  sgRNA
  Atp1a4_19
ctgcttctcatattaccagg

SEQ ID NO: 10922 - DNA, 20 bp, Artificial Sequence
  sgRNA
  Atp1a4_20
ttacatgtatgccataggcc

SEQ ID NO: 10923 - DNA, 20 bp, Artificial Sequence
  sgRNA
  Atp1b1_1
gtacttacaccaactaccac

SEQ ID NO: 10924 - DNA, 20 bp, Artificial Sequence
  sgRNA
  Atp1b1_2
ttgagcttgataatgatgca

SEQ ID NO: 10925 - DNA, 20 bp, Artificial Sequence
  sgRNA
  Atp1b1_3
ggcgacatcaatcacgaacg

SEQ ID NO: 10926 - DNA, 20 bp, Artificial Sequence
  sgRNA
  Atp1b1_4
agctcttggggtcattagga

SEQ ID NO: 10927 - DNA, 20 bp, Artificial Sequence
  sgRNA
  Atp1b1_5
catacgccttacactcgacg

SEQ ID NO: 10928 - DNA, 20 bp, Artificial Sequence
  sgRNA
  Atp1b1_6
tcaatcacgaacgaggagag

SEQ ID NO: 10929 - DNA, 20 bp, Artificial Sequence
  sgRNA
  Atp1b1_7
gcagttcaccaacctcaccg

SEQ ID NO: 10930 - DNA, 20 bp, Artificial Sequence
  sgRNA
  Atp1b1_8
ggttcaagcttgactggctg

SEQ ID NO: 10931 - DNA, 20 bp, Artificial Sequence
  sgRNA
  Atp1b1_9
gtacaaggattcagcccaga

SEQ ID NO: 10932 - DNA, 20 bp, Artificial Sequence
  sgRNA
  Atp1b1_10
tcggtttgaagcccaacact

SEQ ID NO: 10933 - DNA, 20 bp, Artificial Sequence
  sgRNA
  Atp1b1_11
cttggggtcattaggacgga

SEQ ID NO: 10934 - DNA, 20 bp, Artificial Sequence
  sgRNA
  Atp1b1_12
taatgaccccaagagctacg

SEQ ID NO: 10935 - DNA, 20 bp, Artificial Sequence
  sgRNA
  Atp1b1_13
gacgcggatttcagtgtcca

SEQ ID NO: 10936 - DNA, 20 bp, Artificial Sequence
  sgRNA
  Atp1b1_14
gcccacataccaggaccgag

SEQ ID NO: 10937 - DNA, 20 bp, Artificial Sequence
  sgRNA
  Atp1b1_15
gtgaactgcacggccagcag

SEQ ID NO: 10938 - DNA, 20 bp, Artificial Sequence
  sgRNA
  Atp1b1_16
agtagggataatactgcaga

SEQ ID NO: 10939 - DNA, 20 bp, Artificial Sequence
  sgRNA
  Atp1b1_17
gtaagagtcatcattgagac

SEQ ID NO: 10940 - DNA, 20 bp, Artificial Sequence
  sgRNA
  Atp1b1_18
catcaaagcgtccctgaaaa

SEQ ID NO: 10941 - DNA, 20 bp, Artificial Sequence
  sgRNA
  Atp1b1_19
cctgatgatgtttagcacgt

SEQ ID NO: 10942 - DNA, 20 bp, Artificial Sequence
  sgRNA
  Atp1b1_20
gattatacttcatcatcagt

SEQ ID NO: 10943 - DNA, 20 bp, Artificial Sequence
  sgRNA
  Atp1b2_1
ggttgctcataatatcgccc

SEQ ID NO: 10944 - DNA, 20 bp, Artificial Sequence
  sgRNA
  Atp1b2_2
aggagttcgtgtggaacccg

SEQ ID NO: 10945 - DNA, 20 bp, Artificial Sequence
  sgRNA
  Atp1b2_3
attagtgacactgaaagctg

SEQ ID NO: 10946 - DNA, 20 bp, Artificial Sequence
  sgRNA
  Atp1b2_4
cagtcgatcctggtacttgg

SEQ ID NO: 10947 - DNA, 20 bp, Artificial Sequence
  sgRNA
  Atp1b2_5
atattgccacagacgatgag

SEQ ID NO: 10948 - DNA, 20 bp, Artificial Sequence
  sgRNA
  Atp1b2_6
ggtcatcaacttctatgcag

SEQ ID NO: 10949 - DNA, 20 bp, Artificial Sequence
  sgRNA
  Atp1b2_7
cctgaatgtgacccccaacg

SEQ ID NO: 10950 - DNA, 20 bp, Artificial Sequence
  sgRNA
  Atp1b2_8
gatcaatgctgccattagca

SEQ ID NO: 10951 - DNA, 20 bp, Artificial Sequence
  sgRNA
  Atp1b2_9
gcagcattacccacatggtg

SEQ ID NO: 10952 - DNA, 20 bp, Artificial Sequence
  sgRNA
  Atp1b2_10
ccacatggtgaggctgaaca

SEQ ID NO: 10953 - DNA, 20 bp, Artificial Sequence
  sgRNA
  Atp1b2_11
tccggagtttgaaggccaca

SEQ ID NO: 10954 - DNA, 20 bp, Artificial Sequence
  sgRNA
  Atp1b2_12
cccggtgctgtaaccatagt

SEQ ID NO: 10955 - DNA, 20 bp, Artificial Sequence
  sgRNA
  Atp1b2_13
ccatgaactggtgcgtccgc

SEQ ID NO: 10956 - DNA, 20 bp, Artificial Sequence
  sgRNA
  Atp1b2_14
ttatgagcaacctgataatg

SEQ ID NO: 10957 - DNA, 20 bp, Artificial Sequence
  sgRNA
  Atp1b2_15
caccagttcatggggcgcac

SEQ ID NO: 10958 - DNA, 20 bp, Artificial Sequence
  sgRNA
  Atp1b2_16
gctcataatatcgccctgga

SEQ ID NO: 10959 - DNA, 20 bp, Artificial Sequence
  sgRNA
  Atp1b2_17
tgaggctgaacatggccgtg

SEQ ID NO: 10960 - DNA, 20 bp, Artificial Sequence
  sgRNA
  Atp1b2_18
ggtctgcagcattacccaca

SEQ ID NO: 10961 - DNA, 20 bp, Artificial Sequence
  sgRNA
  Atp1b2_19
ccacagcactatagggacaa

SEQ ID NO: 10962 - DNA, 20 bp, Artificial Sequence
  sgRNA
  Atp1b2_20
ccgcggacgcaccagttcat

SEQ ID NO: 10963 - DNA, 20 bp, Artificial Sequence
  sgRNA
  Atp1b3_1
ctccatcaggacaacttgtg

SEQ ID NO: 10964 - DNA, 20 bp, Artificial Sequence
  sgRNA
  Atp1b3_2
tcaacacaattacctggact

SEQ ID NO: 10965 - DNA, 20 bp, Artificial Sequence
  sgRNA
  Atp1b3_3
gccacagacttacaaaaagt

SEQ ID NO: 10966 - DNA, 20 bp, Artificial Sequence
  sgRNA
  Atp1b3_4
cgagcagcggagagtttctg

SEQ ID NO: 10967 - DNA, 20 bp, Artificial Sequence
  sgRNA
  Atp1b3_5
gattcctagtccaggactta

SEQ ID NO: 10968 - DNA, 20 bp, Artificial Sequence
  sgRNA
  Atp1b3_6
gatcagaccccagctcttgg

SEQ ID NO: 10969 - DNA, 20 bp, Artificial Sequence
  sgRNA
  Atp1b3_7
ttccatattatgggaaaaaa

SEQ ID NO: 10970 - DNA, 20 bp, Artificial Sequence
  sgRNA
  Atp1b3_8
atagcaacttatcctgaatt

SEQ ID NO: 10971 - DNA, 20 bp, Artificial Sequence
  sgRNA
  Atp1b3_9
tttcctaaagccatattctg

SEQ ID NO: 10972 - DNA, 20 bp, Artificial Sequence
  sgRNA
  Atp1b3_10
tcaggaccatgctgaataaa

SEQ ID NO: 10973 - DNA, 20 bp, Artificial Sequence
  sgRNA
  Atp1b3_11
ccaagaacccataaaaaact

SEQ ID NO: 10974 - DNA, 20 bp, Artificial Sequence
  sgRNA
  Atp1b3_12
ttctgttcttccacagaata

SEQ ID NO: 10975 - DNA, 20 bp, Artificial Sequence
  sgRNA
  Atp1b3_13
ggaatctggtctcgatattt

SEQ ID NO: 10976 - DNA, 20 bp, Artificial Sequence
  sgRNA
  Atp1b3_14
aaggatgcaaggctgtcctt

SEQ ID NO: 10977 - DNA, 20 bp, Artificial Sequence
  sgRNA
  Atp1b3_15
ttcagcatggtcctgactat

SEQ ID NO: 10978 - DNA, 20 bp, Artificial Sequence
  sgRNA
  Atp1b3_16
aacctcacaagttgtcctga

SEQ ID NO: 10979 - DNA, 20 bp, Artificial Sequence
  sgRNA
  Atp1b3_17
taagtcctggactaggaatc

SEQ ID NO: 10980 - DNA, 20 bp, Artificial Sequence
  sgRNA
  Atp1b3_18
tcccaaaccgcagactgcct

SEQ ID NO: 10981 - DNA, 20 bp, Artificial Sequence
  sgRNA
  Atp1b3_19
tcagcatggtcctgactata

SEQ ID NO: 10982 - DNA, 20 bp, Artificial Sequence
  sgRNA
  Atp1b3_20
ttccaaggcagtctgcggtt

SEQ ID NO: 10983 - DNA, 20 bp, Artificial Sequence
  sgRNA
  Atp1b4_1
tggatgaagtaccgacccgg

SEQ ID NO: 10984 - DNA, 20 bp, Artificial Sequence
  sgRNA
  Atp1b4_2
tggcccgaacaggtcagagt

SEQ ID NO: 10985 - DNA, 20 bp, Artificial Sequence
  sgRNA
  Atp1b4_3
aagttaaggctatgagcgaa

SEQ ID NO: 10986 - DNA, 20 bp, Artificial Sequence
  sgRNA
  Atp1b4_4
gatgatggtgcctggtctag

SEQ ID NO: 10987 - DNA, 20 bp, Artificial Sequence
  sgRNA
  Atp1b4_5
gatcgtgaatgaatacctgt

SEQ ID NO: 10988 - DNA, 20 bp, Artificial Sequence
  sgRNA
  Atp1b4_6
agtctgtagcgataaccgta

SEQ ID NO: 10989 - DNA, 20 bp, Artificial Sequence
  sgRNA
  Atp1b4_7
atatagattgtcctccgggt

SEQ ID NO: 10990 - DNA, 20 bp, Artificial Sequence
  sgRNA
  Atp1b4_8
gagtcagtttgccatagtaa

SEQ ID NO: 10991 - DNA, 20 bp, Artificial Sequence
  sgRNA
  Atp1b4_9
gcgataaccgtaaggaaagg

SEQ ID NO: 10992 - DNA, 20 bp, Artificial Sequence
  sgRNA
  Atp1b4_10
tcgatccatcaattactacc

SEQ ID NO: 10993 - DNA, 20 bp, Artificial Sequence
  sgRNA
  Atp1b4_11
ggtcggtacttcatccaaga

SEQ ID NO: 10994 - DNA, 20 bp, Artificial Sequence
  sgRNA
  Atp1b4_12
gcatcctcctcaagatgaac

SEQ ID NO: 10995 - DNA, 20 bp, Artificial Sequence
  sgRNA
  Atp1b4_13
aaaatgcattgccaccagcg

SEQ ID NO: 10996 - DNA, 20 bp, Artificial Sequence
  sgRNA
  Atp1b4_14
agcctaaatggctttctcca

SEQ ID NO: 10997 - DNA, 20 bp, Artificial Sequence
  sgRNA
  Atp1b4_15
cctgtacagtgccagctgaa

SEQ ID NO: 10998 - DNA, 20 bp, Artificial Sequence
  sgRNA
  Atp1b4_16
gtaaaatgcattgccaccag

SEQ ID NO: 10999 - DNA, 20 bp, Artificial Sequence
  sgRNA
  Atp1b4_17
gtagcgataaccgtaaggaa

SEQ ID NO: 11000 - DNA, 20 bp, Artificial Sequence
  sgRNA
  Atp1b4_18
gatctgcaatttccgccacc

SEQ ID NO: 11001 - DNA, 20 bp, Artificial Sequence
  sgRNA
  Atp1b4_19
ctataatgacagtcttcaag

SEQ ID NO: 11002 - DNA, 20 bp, Artificial Sequence
  sgRNA
  Atp1b4_20
gtagcggaggtcaaaagaag

SEQ ID NO: 11003 - DNA, 20 bp, Artificial Sequence
  sgRNA
  Atp2b2_1
gcccacggataagcacacgc

SEQ ID NO: 11004 - DNA, 20 bp, Artificial Sequence
  sgRNA
  Atp2b2_2
tgaactcacgtgcatctgcg

SEQ ID NO: 11005 - DNA, 20 bp, Artificial Sequence
  sgRNA
  Atp2b2_3
cctggtactctacttcaccg

SEQ ID NO: 11006 - DNA, 20 bp, Artificial Sequence
  sgRNA
  Atp2b2_4
gcttacctgacagcaacatg

SEQ ID NO: 11007 - DNA, 20 bp, Artificial Sequence
  sgRNA
  Atp2b2_5
gctcgagttctgcttgagcg

SEQ ID NO: 11008 - DNA, 20 bp, Artificial Sequence
  sgRNA
  Atp2b2_6
aagatgttccagatcgacag

SEQ ID NO: 11009 - DNA, 20 bp, Artificial Sequence
  sgRNA
  Atp2b2_7
gacggaggactgtctccgca

SEQ ID NO: 11010 - DNA, 20 bp, Artificial Sequence
  sgRNA
  Atp2b2_8
gttgaccacgaaggtgtcca

SEQ ID NO: 11011 - DNA, 20 bp, Artificial Sequence
  sgRNA
  Atp2b2_9
cgaccacgatctcggccaca

SEQ ID NO: 11012 - DNA, 20 bp, Artificial Sequence
  sgRNA
  Atp2b2_10
gcagagcgggagcttcgccg

SEQ ID NO: 11013 - DNA, 20 bp, Artificial Sequence
  sgRNA
  Atp2b2_11
gtacatgcggaagctctcgt

SEQ ID NO: 11014 - DNA, 20 bp, Artificial Sequence
  sgRNA
  Atp2b2_12
agcggcttgttgcgaccgta

SEQ ID NO: 11015 - DNA, 20 bp, Artificial Sequence
  sgRNA
  Atp2b2_13
caaagacgttgcgctcgccg

SEQ ID NO: 11016 - DNA, 20 bp, Artificial Sequence
  sgRNA
  Atp2b2_14
ggaggattcgcaacgagaag

SEQ ID NO: 11017 - DNA, 20 bp, Artificial Sequence
  sgRNA
  Atp2b2_15
tccgtagctctctctatgaa

SEQ ID NO: 11018 - DNA, 20 bp, Artificial Sequence
  sgRNA
  Atp2b2_16
cgggctccgtaccatctgcg

SEQ ID NO: 11019 - DNA, 20 bp, Artificial Sequence
  sgRNA
  Atp2b2_17
acaatagcgccatcgacagc

SEQ ID NO: 11020 - DNA, 20 bp, Artificial Sequence
  sgRNA
  Atp2b2_18
tcgccaccatccctaccagc

SEQ ID NO: 11021 - DNA, 20 bp, Artificial Sequence
  sgRNA
  Atp2b2_19
ggtgccccgcagctccatga

SEQ ID NO: 11022 - DNA, 20 bp, Artificial Sequence
  sgRNA
  Atp2b2_20
ccttcattgctctctcccgg

SEQ ID NO: 11023 - DNA, 20 bp, Artificial Sequence
  sgRNA
  Atp2b3_1
ctgaagacctcacctactga

SEQ ID NO: 11024 - DNA, 20 bp, Artificial Sequence
  sgRNA
  Atp2b3_2
tgtgattgagacctttgtcg

SEQ ID NO: 11025 - DNA, 20 bp, Artificial Sequence
  sgRNA
  Atp2b3_3
accatatcatcccggtcccg

SEQ ID NO: 11026 - DNA, 20 bp, Artificial Sequence
  sgRNA
  Atp2b3_4
caatacggctttgaagacct

SEQ ID NO: 11027 - DNA, 20 bp, Artificial Sequence
  sgRNA
  Atp2b3_5
tgctgaacgagagctccgca

SEQ ID NO: 11028 - DNA, 20 bp, Artificial Sequence
  sgRNA
  Atp2b3_6
gtttcagttgacagtcaacg

SEQ ID NO: 11029 - DNA, 20 bp, Artificial Sequence
  sgRNA
  Atp2b3_7
gccttggatgagcacaccat

SEQ ID NO: 11030 - DNA, 20 bp, Artificial Sequence
  sgRNA
  Atp2b3_8
cgaagcctcatggagctccg

SEQ ID NO: 11031 - DNA, 20 bp, Artificial Sequence
  sgRNA
  Atp2b3_9
ttgtcattgtccaatttgga

SEQ ID NO: 11032 - DNA, 20 bp, Artificial Sequence
  sgRNA
  Atp2b3_10
ccaatgacttggagaaacgc

SEQ ID NO: 11033 - DNA, 20 bp, Artificial Sequence
  sgRNA
  Atp2b3_11
ggcaatgtcccctaccacca

SEQ ID NO: 11034 - DNA, 20 bp, Artificial Sequence
  sgRNA
  Atp2b3_12
ggttgaggccccgaaaccag

SEQ ID NO: 11035 - DNA, 20 bp, Artificial Sequence
  sgRNA
  Atp2b3_13
gatgagagtcacgtcctgca

SEQ ID NO: 11036 - DNA, 20 bp, Artificial Sequence
  sgRNA
  Atp2b3_14
ggccttcataaagcgagcta

SEQ ID NO: 11037 - DNA, 20 bp, Artificial Sequence
  sgRNA
  Atp2b3_15
cagcccgctgacatccccat

SEQ ID NO: 11038 - DNA, 20 bp, Artificial Sequence
  sgRNA
  Atp2b3_16
gctgaacgagagctccgcag

SEQ ID NO: 11039 - DNA, 20 bp, Artificial Sequence
  sgRNA
  Atp2b3_17
aattgctctccggatttcgg

SEQ ID NO: 11040 - DNA, 20 bp, Artificial Sequence
  sgRNA
  Atp2b3_18
gctggtagacagcatgtcca

SEQ ID NO: 11041 - DNA, 20 bp, Artificial Sequence
  sgRNA
  Atp2b3_19
ggtcccgaggacgaaatcct

SEQ ID NO: 11042 - DNA, 20 bp, Artificial Sequence
  sgRNA
  Atp2b3_20
acacttagctgcaatagccc

SEQ ID NO: 11043 - DNA, 20 bp, Artificial Sequence
  sgRNA
  Atp2b4_1
tcaccctcaatgtcccacga

SEQ ID NO: 11044 - DNA, 20 bp, Artificial Sequence
  sgRNA
  Atp2b4_2
ctaccaagcagttcgcaatg

SEQ ID NO: 11045 - DNA, 20 bp, Artificial Sequence
  sgRNA
  Atp2b4_3
gtggtgcaagcttacatcgg

SEQ ID NO: 11046 - DNA, 20 bp, Artificial Sequence
  sgRNA
  Atp2b4_4
gagtaccacaatgatcaccg

SEQ ID NO: 11047 - DNA, 20 bp, Artificial Sequence
  sgRNA
  Atp2b4_5
gccgagatggagcttcgccg

SEQ ID NO: 11048 - DNA, 20 bp, Artificial Sequence
  sgRNA
  Atp2b4_6
tcttcaacgaaatcaacgct

SEQ ID NO: 11049 - DNA, 20 bp, Artificial Sequence
  sgRNA
  Atp2b4_7
gcagatggaattctaatcca

SEQ ID NO: 11050 - DNA, 20 bp, Artificial Sequence
  sgRNA
  Atp2b4_8
acactgttcgacattgacag

SEQ ID NO: 11051 - DNA, 20 bp, Artificial Sequence
  sgRNA
  Atp2b4_9
gcaaagagaagcagttccgg

SEQ ID NO: 11052 - DNA, 20 bp, Artificial Sequence
  sgRNA
  Atp2b4_10
cgtaattaacaaattccaga

SEQ ID NO: 11053 - DNA, 20 bp, Artificial Sequence
  sgRNA
  Atp2b4_11
gtgacaattcatcatctgcg

SEQ ID NO: 11054 - DNA, 20 bp, Artificial Sequence
  sgRNA
  Atp2b4_12
cattatctccacccggaggt

SEQ ID NO: 11055 - DNA, 20 bp, Artificial Sequence
  sgRNA
  Atp2b4_13
tgttcgacattgacagtggg

SEQ ID NO: 11056 - DNA, 20 bp, Artificial Sequence
  sgRNA
  Atp2b4_14
agatcagtgcccactacgga

SEQ ID NO: 11057 - DNA, 20 bp, Artificial Sequence
  sgRNA
  Atp2b4_15
gcagttacatctcctcctgt

SEQ ID NO: 11058 - DNA, 20 bp, Artificial Sequence
  sgRNA
  Atp2b4_16
tggctgggtggcgaattgag

SEQ ID NO: 11059 - DNA, 20 bp, Artificial Sequence
  sgRNA
  Atp2b4_17
gtcttgttgcctacttgtcg

SEQ ID NO: 11060 - DNA, 20 bp, Artificial Sequence
  sgRNA
  Atp2b4_18
tgaggatcctgtgcgcccgg

SEQ ID NO: 11061 - DNA, 20 bp, Artificial Sequence
  sgRNA
  Atp2b4_19
tccttcctggatatccaaga

SEQ ID NO: 11062 - DNA, 20 bp, Artificial Sequence
  sgRNA
  Atp2b4_20
ggttcaggccacggacccag

SEQ ID NO: 11063 - DNA, 20 bp, Artificial Sequence
  sgRNA
  Atp4b_1
tggatcagcctgtactacgc

SEQ ID NO: 11064 - DNA, 20 bp, Artificial Sequence
  sgRNA
  Atp4b_2
cttgagaccggacgtgtatg

SEQ ID NO: 11065 - DNA, 20 bp, Artificial Sequence
  sgRNA
  Atp4b_3
ccgggttccaacagtagtgc

SEQ ID NO: 11066 - DNA, 20 bp, Artificial Sequence
  sgRNA
  Atp4b_4
acaaaactgctcaggcctgg

SEQ ID NO: 11067 - DNA, 20 bp, Artificial Sequence
  sgRNA
  Atp4b_5
acccccatgacccctacgaa

SEQ ID NO: 11068 - DNA, 20 bp, Artificial Sequence
  sgRNA
  Atp4b_6
gtgctttcttgccatagtag

SEQ ID NO: 11069 - DNA, 20 bp, Artificial Sequence
  sgRNA
  Atp4b_7
ggagcttggctgccaccaga

SEQ ID NO: 11070 - DNA, 20 bp, Artificial Sequence
  sgRNA
  Atp4b_8
gccccactacagcaaccctc

SEQ ID NO: 11071 - DNA, 20 bp, Artificial Sequence
  sgRNA
  Atp4b_9
aggatgatccccaaaagccc

SEQ ID NO: 11072 - DNA, 20 bp, Artificial Sequence
  sgRNA
  Atp4b_10
gatgcacaaggcaaagagcc

SEQ ID NO: 11073 - DNA, 20 bp, Artificial Sequence
  sgRNA
  Atp4b_11
agactgaaggtgccattggg

SEQ ID NO: 11074 - DNA, 20 bp, Artificial Sequence
  sgRNA
  Atp4b_12
gcatgacttcttctcctgca

SEQ ID NO: 11075 - DNA, 20 bp, Artificial Sequence
  sgRNA
  Atp4b_13
gggatagtactcgacctgca

SEQ ID NO: 11076 - DNA, 20 bp, Artificial Sequence
  sgRNA
  Atp4b_14
ccatgacccctacgaaggga

SEQ ID NO: 11077 - DNA, 20 bp, Artificial Sequence
  sgRNA
  Atp4b_15
gaagtcatgcagccagcgca

SEQ ID NO: 11078 - DNA, 20 bp, Artificial Sequence
  sgRNA
  Atp4b_16
actgttggaacccggacact

SEQ ID NO: 11079 - DNA, 20 bp, Artificial Sequence
  sgRNA
  Atp4b_17
ctataccccagcatcccagc

SEQ ID NO: 11080 - DNA, 20 bp, Artificial Sequence
  sgRNA
  Atp4b_18
ccactacagcaaccctctgg

SEQ ID NO: 11081 - DNA, 20 bp, Artificial Sequence
  sgRNA
  Atp4b_19
gtcgagtactatccccccaa

SEQ ID NO: 11082 - DNA, 20 bp, Artificial Sequence
  sgRNA
  Atp4b_20
aactccaccttcccttcgta

SEQ ID NO: 11083 - DNA, 20 bp, Artificial Sequence
  sgRNA
  Atp6v0a2_1
agacacacgggctctaccca

SEQ ID NO: 11084 - DNA, 20 bp, Artificial Sequence
  sgRNA
  Atp6v0a2_2
catctacccgtatccaaaca

SEQ ID NO: 11085 - DNA, 20 bp, Artificial Sequence
  sgRNA
  Atp6v0a2_3
ggcaaccaggacatagaaga

SEQ ID NO: 11086 - DNA, 20 bp, Artificial Sequence
  sgRNA
  Atp6v0a2_4
ttaggatgttctttgacggc

SEQ ID NO: 11087 - DNA, 20 bp, Artificial Sequence
  sgRNA
  Atp6v0a2_5
gttggtgcggatcagagtgg

SEQ ID NO: 11088 - DNA, 20 bp, Artificial Sequence
  sgRNA
  Atp6v0a2_6
ggattgtgttcatgaacgag

SEQ ID NO: 11089 - DNA, 20 bp, Artificial Sequence
  sgRNA
  Atp6v0a2_7
gctttcctaagaagagcacg

SEQ ID NO: 11090 - DNA, 20 bp, Artificial Sequence
  sgRNA
  Atp6v0a2_8
gggattgtgttcatgaacga

SEQ ID NO: 11091 - DNA, 20 bp, Artificial Sequence
  sgRNA
  Atp6v0a2_9
tcggatccaagacctttaca

SEQ ID NO: 11092 - DNA, 20 bp, Artificial Sequence
  sgRNA
  Atp6v0a2_10
tcttcctcacctggaccaca

SEQ ID NO: 11093 - DNA, 20 bp, Artificial Sequence
  sgRNA
  Atp6v0a2_11
tttctgctgtggctgcacaa

SEQ ID NO: 11094 - DNA, 20 bp, Artificial Sequence
  sgRNA
  Atp6v0a2_12
ggatcaatgccaaaagggta

SEQ ID NO: 11095 - DNA, 20 bp, Artificial Sequence
  sgRNA
  Atp6v0a2_13
cctgtgactggcttagtctg

SEQ ID NO: 11096 - DNA, 20 bp, Artificial Sequence
  sgRNA
  Atp6v0a2_14
agaagagggcaacagccgca

SEQ ID NO: 11097 - DNA, 20 bp, Artificial Sequence
  sgRNA
  Atp6v0a2_15
tgtactccaccagctccaac

SEQ ID NO: 11098 - DNA, 20 bp, Artificial Sequence
  sgRNA
  Atp6v0a2_16
aattcgtcggtgaggtaaag

SEQ ID NO: 11099 - DNA, 20 bp, Artificial Sequence
  sgRNA
  Atp6v0a2_17
gcgggaaactcttcatacgt

SEQ ID NO: 11100 - DNA, 20 bp, Artificial Sequence
  sgRNA
  Atp6v0a2_18
cagccgctacagaaaaagta

SEQ ID NO: 11101 - DNA, 20 bp, Artificial Sequence
  sgRNA
  Atp6v0a2_19
agctgaggtctggtgccccg

SEQ ID NO: 11102 - DNA, 20 bp, Artificial Sequence
  sgRNA
  Atp6v0a2_20
tcacgaagaccttcctcaag

SEQ ID NO: 11103 - DNA, 20 bp, Artificial Sequence
  sgRNA
  Atraid_1
aggacaagcagatttgccaa

SEQ ID NO: 11104 - DNA, 20 bp, Artificial Sequence
  sgRNA
  Atraid_2
ttggccaaatcatccttgag

SEQ ID NO: 11105 - DNA, 20 bp, Artificial Sequence
  sgRNA
  Atraid_3
ggatacatcgaagctaatgc

SEQ ID NO: 11106 - DNA, 20 bp, Artificial Sequence
  sgRNA
  Atraid_4
tatgcacaatttgtccagag

SEQ ID NO: 11107 - DNA, 20 bp, Artificial Sequence
  sgRNA
  Atraid_5
tctgcagctgagtaaaccca

SEQ ID NO: 11108 - DNA, 20 bp, Artificial Sequence
  sgRNA
  Atraid_6
atttggccaacaccttccgt

SEQ ID NO: 11109 - DNA, 20 bp, Artificial Sequence
  sgRNA
  Atraid_7
cgatgctgcctgaatcagaa

SEQ ID NO: 11110 - DNA, 20 bp, Artificial Sequence
  sgRNA
  Atraid_8
atatgcaccctgtgtccggg

SEQ ID NO: 11111 - DNA, 20 bp, Artificial Sequence
  sgRNA
  Atraid_9
gcattactacctccaggaca

SEQ ID NO: 11112 - DNA, 20 bp, Artificial Sequence
  sgRNA
  Atraid_10
ccttgagaggatttgcctga

SEQ ID NO: 11113 - DNA, 20 bp, Artificial Sequence
  sgRNA
  Atraid_11
agtaaacccacggaaggtgt

SEQ ID NO: 11114 - DNA, 20 bp, Artificial Sequence
  sgRNA
  Atraid_12
gtgcatacctcccggacaca

SEQ ID NO: 11115 - DNA, 20 bp, Artificial Sequence
  sgRNA
  Atraid_13
gatttggccaacaccttccg

SEQ ID NO: 11116 - DNA, 20 bp, Artificial Sequence
  sgRNA
  Atraid_14
gtttgtgctgatggtttcca

SEQ ID NO: 11117 - DNA, 20 bp, Artificial Sequence
  sgRNA
  Atraid_15
gcagatttgccaagggcaaa

SEQ ID NO: 11118 - DNA, 20 bp, Artificial Sequence
  sgRNA
  Atraid_16
gacaaattgtgcatacctcc

SEQ ID NO: 11119 - DNA, 20 bp, Artificial Sequence
  sgRNA
  Atraid_17
ggcttccagtgctattgcaa

SEQ ID NO: 11120 - DNA, 20 bp, Artificial Sequence
  sgRNA
  Atraid_18
tcccaggcattactacctcc

SEQ ID NO: 11121 - DNA, 20 bp, Artificial Sequence
  sgRNA
  Atraid_19
tcttcagaactgttccctga

SEQ ID NO: 11122 - DNA, 20 bp, Artificial Sequence
  sgRNA
  Atraid_20
gcccagaaccaggagcaggg

SEQ ID NO: 11123 - DNA, 20 bp, Artificial Sequence
  sgRNA
  Atrn_1
cctcactgtacagacaactg

SEQ ID NO: 11124 - DNA, 20 bp, Artificial Sequence
  sgRNA
  Atrn_2
acgatgtggatactcagatg

SEQ ID NO: 11125 - DNA, 20 bp, Artificial Sequence
  sgRNA
  Atrn_3
gaggaaaaattgattcaaca

SEQ ID NO: 11126 - DNA, 20 bp, Artificial Sequence
  sgRNA
  Atrn_4
ggccgccgttgacacacggc

SEQ ID NO: 11127 - DNA, 20 bp, Artificial Sequence
  sgRNA
  Atrn_5
gtgtgcatcgcactgctccg

SEQ ID NO: 11128 - DNA, 20 bp, Artificial Sequence
  sgRNA
  Atrn_6
gtactgatcctagcaatact

SEQ ID NO: 11129 - DNA, 20 bp, Artificial Sequence
  sgRNA
  Atrn_7
gaccggccgtgtgtcaacgg

SEQ ID NO: 11130 - DNA, 20 bp, Artificial Sequence
  sgRNA
  Atrn_8
aagaagttgctctctccgcc

SEQ ID NO: 11131 - DNA, 20 bp, Artificial Sequence
  sgRNA
  Atrn_9
caagtatgagagttgcccca

SEQ ID NO: 11132 - DNA, 20 bp, Artificial Sequence
  sgRNA
  Atrn_10
ggtggtacagaagcacttgc

SEQ ID NO: 11133 - DNA, 20 bp, Artificial Sequence
  sgRNA
  Atrn_11
ccgaataattgctcaggccg

SEQ ID NO: 11134 - DNA, 20 bp, Artificial Sequence
  sgRNA
  Atrn_12
tgtaatgcaagcgataccag

SEQ ID NO: 11135 - DNA, 20 bp, Artificial Sequence
  sgRNA
  Atrn_13
cctagaccagaactgccagt

SEQ ID NO: 11136 - DNA, 20 bp, Artificial Sequence
  sgRNA
  Atrn_14
agatgaccaacatgaccaca

SEQ ID NO: 11137 - DNA, 20 bp, Artificial Sequence
  sgRNA
  Atrn_15
catacagctgtgatagtgag

SEQ ID NO: 11138 - DNA, 20 bp, Artificial Sequence
  sgRNA
  Atrn_16
aatgacacttccatgagcca

SEQ ID NO: 11139 - DNA, 20 bp, Artificial Sequence
  sgRNA
  Atrn_17
gaggtagaaaatcgatacca

SEQ ID NO: 11140 - DNA, 20 bp, Artificial Sequence
  sgRNA
  Atrn_18
gcgatgcactcttgattccg

SEQ ID NO: 11141 - DNA, 20 bp, Artificial Sequence
  sgRNA
  Atrn_19
acctgcatcaaccctctcaa

SEQ ID NO: 11142 - DNA, 20 bp, Artificial Sequence
  sgRNA
  Atrn_20
ctttcagcgccaacaaatac

SEQ ID NO: 11143 - DNA, 20 bp, Artificial Sequence
  sgRNA
  Atrnl1_1
gaaaacatctttatgtacgg

SEQ ID NO: 11144 - DNA, 20 bp, Artificial Sequence
  sgRNA
  Atrnl1_2
taagcccaaatcagaacgcg

SEQ ID NO: 11145 - DNA, 20 bp, Artificial Sequence
  sgRNA
  Atrnl1_3
agaaggctggaatcatgttg

SEQ ID NO: 11146 - DNA, 20 bp, Artificial Sequence
  sgRNA
  Atrnl1_4
atgcgacaaatactggaaag

SEQ ID NO: 11147 - DNA, 20 bp, Artificial Sequence
  sgRNA
  Atrnl1_5
gcagctctgttcccagcgca

SEQ ID NO: 11148 - DNA, 20 bp, Artificial Sequence
  sgRNA
  Atrnl1_6
gggcccaatgaaactcgcgg

SEQ ID NO: 11149 - DNA, 20 bp, Artificial Sequence
  sgRNA
  Atrnl1_7
agacttctggagtccgcaat

SEQ ID NO: 11150 - DNA, 20 bp, Artificial Sequence
  sgRNA
  Atrnl1_8
atggagacccaaccaacggt

SEQ ID NO: 11151 - DNA, 20 bp, Artificial Sequence
  sgRNA
  Atrnl1_9
actttaatctcaacattacg

SEQ ID NO: 11152 - DNA, 20 bp, Artificial Sequence
  sgRNA
  Atrnl1_10
cgacctacggaagggctgaa

SEQ ID NO: 11153 - DNA, 20 bp, Artificial Sequence
  sgRNA
  Atrnl1_11
atcttgcgtaggcctaccca

SEQ ID NO: 11154 - DNA, 20 bp, Artificial Sequence
  sgRNA
  Atrnl1_12
gttgggtctccatagtaccc

SEQ ID NO: 11155 - DNA, 20 bp, Artificial Sequence
  sgRNA
  Atrnl1_13
actcaacttgaattgccagt

SEQ ID NO: 11156 - DNA, 20 bp, Artificial Sequence
  sgRNA
  Atrnl1_14
gtagcctccgtgaacataga

SEQ ID NO: 11157 - DNA, 20 bp, Artificial Sequence
  sgRNA
  Atrnl1_15
gtgtttctctgtctaccgag

SEQ ID NO: 11158 - DNA, 20 bp, Artificial Sequence
  sgRNA
  Atrnl1_16
ggtggagttgacacagcgac

SEQ ID NO: 11159 - DNA, 20 bp, Artificial Sequence
  sgRNA
  Atrnl1_17
ataagtacgaagtcaacacc

SEQ ID NO: 11160 - DNA, 20 bp, Artificial Sequence
  sgRNA
  Atrnl1_18
gaacagacagactttctgcg

SEQ ID NO: 11161 - DNA, 20 bp, Artificial Sequence
  sgRNA
  Atrnl1_19
tttatgtgaggcccgaccta

SEQ ID NO: 11162 - DNA, 20 bp, Artificial Sequence
  sgRNA
  Atrnl1_20
atatctgtaacatctgtcat

SEQ ID NO: 11163 - DNA, 20 bp, Artificial Sequence
  sgRNA
  Avpr1a_1
tcgttgcgtacgtcccccgg

SEQ ID NO: 11164 - DNA, 20 bp, Artificial Sequence
  sgRNA
  Avpr1a_2
gtccggcccgcggaagcggt

SEQ ID NO: 11165 - DNA, 20 bp, Artificial Sequence
  sgRNA
  Avpr1a_3
gctggtcatccaggtcacgt

SEQ ID NO: 11166 - DNA, 20 bp, Artificial Sequence
  sgRNA
  Avpr1a_4
tcggatgaagagatgcatgc

SEQ ID NO: 11167 - DNA, 20 bp, Artificial Sequence
  sgRNA
  Avpr1a_5
gccgggggacgtacgcaacg

SEQ ID NO: 11168 - DNA, 20 bp, Artificial Sequence
  sgRNA
  Avpr1a_6
aggctcccacgatctgcccg

SEQ ID NO: 11169 - DNA, 20 bp, Artificial Sequence
  sgRNA
  Avpr1a_7
cgtgacctggatgaccagcg

SEQ ID NO: 11170 - DNA, 20 bp, Artificial Sequence
  sgRNA
  Avpr1a_8
cttggaagaaggcgaccgcc

SEQ ID NO: 11171 - DNA, 20 bp, Artificial Sequence
  sgRNA
  Avpr1a_9
gtaggcgcttacaatcacaa

SEQ ID NO: 11172 - DNA, 20 bp, Artificial Sequence
  sgRNA
  Avpr1a_10
ctaaaaaacatgtagatcca

SEQ ID NO: 11173 - DNA, 20 bp, Artificial Sequence
  sgRNA
  Avpr1a_11
tggtggcctctgaccaccga

SEQ ID NO: 11174 - DNA, 20 bp, Artificial Sequence
  sgRNA
  Avpr1a_12
cagtaacgccgtgatcgtgg

SEQ ID NO: 11175 - DNA, 20 bp, Artificial Sequence
  sgRNA
  Avpr1a_13
tcatgatcgccgcctcttgg

SEQ ID NO: 11176 - DNA, 20 bp, Artificial Sequence
  sgRNA
  Avpr1a_14
acgtaggcacgggtacccca

SEQ ID NO: 11177 - DNA, 20 bp, Artificial Sequence
  sgRNA
  Avpr1a_15
gttgcccgcgggcagatcgt

SEQ ID NO: 11178 - DNA, 20 bp, Artificial Sequence
  sgRNA
  Avpr1a_16
acatctggcgcaatgtccga

SEQ ID NO: 11179 - DNA, 20 bp, Artificial Sequence
  sgRNA
  Avpr1a_17
cttcatccgacacctcagcc

SEQ ID NO: 11180 - DNA, 20 bp, Artificial Sequence
  sgRNA
  Avpr1a_18
catagcgcagaaattcgcca

SEQ ID NO: 11181 - DNA, 20 bp, Artificial Sequence
  sgRNA
  Avpr1a_19
gcgctatgctttggcagcat

SEQ ID NO: 11182 - DNA, 20 bp, Artificial Sequence
  sgRNA
  Avpr1a_20
cctgcaagtgcttcaccacc

SEQ ID NO: 11183 - DNA, 20 bp, Artificial Sequence
  sgRNA
  Avpr1b_1
aacgaaaaaatgaacacttg

SEQ ID NO: 11184 - DNA, 20 bp, Artificial Sequence
  sgRNA
  Avpr1b_2
gaacctgaaagtcaagacac

SEQ ID NO: 11185 - DNA, 20 bp, Artificial Sequence
  sgRNA
  Avpr1b_3
gggagcgcttatggccctgg

SEQ ID NO: 11186 - DNA, 20 bp, Artificial Sequence
  sgRNA
  Avpr1b_4
ctgatgctgctgacccggga

SEQ ID NO: 11187 - DNA, 20 bp, Artificial Sequence
  sgRNA
  Avpr1b_5
gcaagctgtgagcaccacca

SEQ ID NO: 11188 - DNA, 20 bp, Artificial Sequence
  sgRNA
  Avpr1b_6
gctgctggaggcttcgaaga

SEQ ID NO: 11189 - DNA, 20 bp, Artificial Sequence
  sgRNA
  Avpr1b_7
tcgttgcgagaggtgatcca

SEQ ID NO: 11190 - DNA, 20 bp, Artificial Sequence
  sgRNA
  Avpr1b_8
gcagcacgaacagatgcatg

SEQ ID NO: 11191 - DNA, 20 bp, Artificial Sequence
  sgRNA
  Avpr1b_9
tgaagcccatatagatccag

SEQ ID NO: 11192 - DNA, 20 bp, Artificial Sequence
  sgRNA
  Avpr1b_10
gtgttgtgcggcggctagcg

SEQ ID NO: 11193 - DNA, 20 bp, Artificial Sequence
  sgRNA
  Avpr1b_11
ttgaagcccatatagatcca

SEQ ID NO: 11194 - DNA, 20 bp, Artificial Sequence
  sgRNA
  Avpr1b_12
catggccagcagcatgtaag

SEQ ID NO: 11195 - DNA, 20 bp, Artificial Sequence
  sgRNA
  Avpr1b_13
gggtcagcagtgttgtgcgg

SEQ ID NO: 11196 - DNA, 20 bp, Artificial Sequence
  sgRNA
  Avpr1b_14
cagcatcagtaccatctcca

SEQ ID NO: 11197 - DNA, 20 bp, Artificial Sequence
  sgRNA
  Avpr1b_15
gttgcccagaagcatcgaga

SEQ ID NO: 11198 - DNA, 20 bp, Artificial Sequence
  sgRNA
  Avpr1b_16
ggacaaacagggtgccccca

SEQ ID NO: 11199 - DNA, 20 bp, Artificial Sequence
  sgRNA
  Avpr1b_17
gagtcaccgcgcctgctgca

SEQ ID NO: 11200 - DNA, 20 bp, Artificial Sequence
  sgRNA
  Avpr1b_18
tggaacccctgcagcaggcg

SEQ ID NO: 11201 - DNA, 20 bp, Artificial Sequence
  sgRNA
  Avpr1b_19
gttccaagccccgagtgcac

SEQ ID NO: 11202 - DNA, 20 bp, Artificial Sequence
  sgRNA
  Avpr1b_20
cgagatggtgaaagccacat

SEQ ID NO: 11203 - DNA, 20 bp, Artificial Sequence
  sgRNA
  Avpr2_1
cttggggccctaatacgacg

SEQ ID NO: 11204 - DNA, 20 bp, Artificial Sequence
  sgRNA
  Avpr2_2
agttcagcccggactaacag

SEQ ID NO: 11205 - DNA, 20 bp, Artificial Sequence
  sgRNA
  Avpr2_3
cctatgctggcataccgcca

SEQ ID NO: 11206 - DNA, 20 bp, Artificial Sequence
  sgRNA
  Avpr2_4
cggcccgacacaaggcatca

SEQ ID NO: 11207 - DNA, 20 bp, Artificial Sequence
  sgRNA
  Avpr2_5
ctaatacgacggggtcggcg

SEQ ID NO: 11208 - DNA, 20 bp, Artificial Sequence
  sgRNA
  Avpr2_6
aagcaggctacgcaactccg

SEQ ID NO: 11209 - DNA, 20 bp, Artificial Sequence
  sgRNA
  Avpr2_7
ttaacagctgtaccaacccc

SEQ ID NO: 11210 - DNA, 20 bp, Artificial Sequence
  sgRNA
  Avpr2_8
gcttggggccctaatacgac

SEQ ID NO: 11211 - DNA, 20 bp, Artificial Sequence
  sgRNA
  Avpr2_9
gcagcatgagcaacacaaag

SEQ ID NO: 11212 - DNA, 20 bp, Artificial Sequence
  sgRNA
  Avpr2_10
ggcggtatgccagcataggg

SEQ ID NO: 11213 - DNA, 20 bp, Artificial Sequence
  sgRNA
  Avpr2_11
gatgccaccgaccgcttcca

SEQ ID NO: 11214 - DNA, 20 bp, Artificial Sequence
  sgRNA
  Avpr2_12
agcgagccccacctccatgg

SEQ ID NO: 11215 - DNA, 20 bp, Artificial Sequence
  sgRNA
  Avpr2_13
ggaagcatagatccaggggt

SEQ ID NO: 11216 - DNA, 20 bp, Artificial Sequence
  sgRNA
  Avpr2_14
cggacaggaagtcccagcga

SEQ ID NO: 11217 - DNA, 20 bp, Artificial Sequence
  sgRNA
  Avpr2_15
atagcagggccagttcagcc

SEQ ID NO: 11218 - DNA, 20 bp, Artificial Sequence
  sgRNA
  Avpr2_16
gtggcatcccaagccagctg

SEQ ID NO: 11219 - DNA, 20 bp, Artificial Sequence
  sgRNA
  Avpr2_17
gattgtctacgtgctgtgct

SEQ ID NO: 11220 - DNA, 20 bp, Artificial Sequence
  sgRNA
  Avpr2_18
ggtcatccagtagctcctcc

SEQ ID NO: 11221 - DNA, 20 bp, Artificial Sequence
  sgRNA
  Avpr2_19
catacatgcccaccatctgc

SEQ ID NO: 11222 - DNA, 20 bp, Artificial Sequence
  sgRNA
  Avpr2_20
aggcacaccacacacagcct

SEQ ID NO: 11223 - DNA, 20 bp, Artificial Sequence
  sgRNA
  Axl_1
ggatatccggatgtgatacg

SEQ ID NO: 11224 - DNA, 20 bp, Artificial Sequence
  sgRNA
  Axl_2
cccagcagtacataccacca

SEQ ID NO: 11225 - DNA, 20 bp, Artificial Sequence
  sgRNA
  Axl_3
cagacaacctacggagctag

SEQ ID NO: 11226 - DNA, 20 bp, Artificial Sequence
  sgRNA
  Axl_4
ttgaccaccccaacgtcatg

SEQ ID NO: 11227 - DNA, 20 bp, Artificial Sequence
  sgRNA
  Axl_5
ctgagaacgttagcgccatg

SEQ ID NO: 11228 - DNA, 20 bp, Artificial Sequence
  sgRNA
  Axl_6
aggccaaactccctatccag

SEQ ID NO: 11229 - DNA, 20 bp, Artificial Sequence
  sgRNA
  Axl_7
atagggagtttggcctcggg

SEQ ID NO: 11230 - DNA, 20 bp, Artificial Sequence
  sgRNA
  Axl_8
ggaagccaccttgaaccccg

SEQ ID NO: 11231 - DNA, 20 bp, Artificial Sequence
  sgRNA
  Axl_9
gctcacccactgcaacctgc

SEQ ID NO: 11232 - DNA, 20 bp, Artificial Sequence
  sgRNA
  Axl_10
ggtagatgccactcaggcca

SEQ ID NO: 11233 - DNA, 20 bp, Artificial Sequence
  sgRNA
  Axl_11
gaggcctcaccatctccacg

SEQ ID NO: 11234 - DNA, 20 bp, Artificial Sequence
  sgRNA
  Axl_12
caggtgccagaggactcacg

SEQ ID NO: 11235 - DNA, 20 bp, Artificial Sequence
  sgRNA
  Axl_13
gaggtgaccttggaactgcg

SEQ ID NO: 11236 - DNA, 20 bp, Artificial Sequence
  sgRNA
  Axl_14
ggaggtgtttgagccaaccg

SEQ ID NO: 11237 - DNA, 20 bp, Artificial Sequence
  sgRNA
  Axl_15
actcaggtactccataccac

SEQ ID NO: 11238 - DNA, 20 bp, Artificial Sequence
  sgRNA
  Axl_16
ctccaagaagatctacaacg

SEQ ID NO: 11239 - DNA, 20 bp, Artificial Sequence
  sgRNA
  Axl_17
ggtgaccttggaactgcggg

SEQ ID NO: 11240 - DNA, 20 bp, Artificial Sequence
  sgRNA
  Axl_18
tggccctgttccttgtccat

SEQ ID NO: 11241 - DNA, 20 bp, Artificial Sequence
  sgRNA
  Axl_19
ggagctccgcaaaacttggc

SEQ ID NO: 11242 - DNA, 20 bp, Artificial Sequence
  sgRNA
  Axl_20
cctggcctcgatatgccagc

SEQ ID NO: 11243 - DNA, 20 bp, Artificial Sequence
  sgRNA
  BC035947_1
ggtgaggagacatcgagcgg

SEQ ID NO: 11244 - DNA, 20 bp, Artificial Sequence
  sgRNA
  BC035947_2
tttgtggtactgctaccgac

SEQ ID NO: 11245 - DNA, 20 bp, Artificial Sequence
  sgRNA
  BC035947_3
cgtcttgtcccacgtcaaga

SEQ ID NO: 11246 - DNA, 20 bp, Artificial Sequence
  sgRNA
  BC035947_4
gcagaatgataatacacacg

SEQ ID NO: 11247 - DNA, 20 bp, Artificial Sequence
  sgRNA
  BC035947_5
gggacaagacgcatgaaccc

SEQ ID NO: 11248 - DNA, 20 bp, Artificial Sequence
  sgRNA
  BC035947_6
aaaggaaccaattcgccctg

SEQ ID NO: 11249 - DNA, 20 bp, Artificial Sequence
  sgRNA
  BC035947_7
gcagaaactgaccctgacta

SEQ ID NO: 11250 - DNA, 20 bp, Artificial Sequence
  sgRNA
  BC035947_8
ttatgagcacacccactctc

SEQ ID NO: 11251 - DNA, 20 bp, Artificial Sequence
  sgRNA
  BC035947_9
tgctaccgactgggaggccg

SEQ ID NO: 11252 - DNA, 20 bp, Artificial Sequence
  sgRNA
  BC035947_10
tggtactgctaccgactggg

SEQ ID NO: 11253 - DNA, 20 bp, Artificial Sequence
  sgRNA
  BC035947_11
agtaccacaaatcctgcgaa

SEQ ID NO: 11254 - DNA, 20 bp, Artificial Sequence
  sgRNA
  BC035947_12
tgggaggtgctcaatgaaga

SEQ ID NO: 11255 - DNA, 20 bp, Artificial Sequence
  sgRNA
  BC035947_13
ggaaaggaaccaattcgccc

SEQ ID NO: 11256 - DNA, 20 bp, Artificial Sequence
  sgRNA
  BC035947_14
aacacggtccttctggaaca

SEQ ID NO: 11257 - DNA, 20 bp, Artificial Sequence
  sgRNA
  BC035947_15
actgaccctgactaaggtat

SEQ ID NO: 11258 - DNA, 20 bp, Artificial Sequence
  sgRNA
  BC035947_16
acgacaaaagcgagaacgag

SEQ ID NO: 11259 - DNA, 20 bp, Artificial Sequence
  sgRNA
  BC035947_17
tagaggagtccctttctcct

SEQ ID NO: 11260 - DNA, 20 bp, Artificial Sequence
  sgRNA
  BC035947_18
taagatcggtatgatccggg

SEQ ID NO: 11261 - DNA, 20 bp, Artificial Sequence
  sgRNA
  BC035947_19
agtccaaggagggtgcactg

SEQ ID NO: 11262 - DNA, 20 bp, Artificial Sequence
  sgRNA
  BC035947_20
tggagcctcggcctcccagt

SEQ ID NO: 11263 - DNA, 20 bp, Artificial Sequence
  sgRNA
  BC053393_1
ataggcgtactcgattgtca

SEQ ID NO: 11264 - DNA, 20 bp, Artificial Sequence
  sgRNA
  BC053393_2
gaatgcgcttctgatacatg

SEQ ID NO: 11265 - DNA, 20 bp, Artificial Sequence
  sgRNA
  BC053393_3
aagagcatggaagcgtcaca

SEQ ID NO: 11266 - DNA, 20 bp, Artificial Sequence
  sgRNA
  BC053393_4
tgcttgtccgatagttgact

SEQ ID NO: 11267 - DNA, 20 bp, Artificial Sequence
  sgRNA
  BC053393_5
ggagcgttccaggaagtcca

SEQ ID NO: 11268 - DNA, 20 bp, Artificial Sequence
  sgRNA
  BC053393_6
ggagtaggaatgtcgaaagg

SEQ ID NO: 11269 - DNA, 20 bp, Artificial Sequence
  sgRNA
  BC053393_7
atggacaccgagtcaactat

SEQ ID NO: 11270 - DNA, 20 bp, Artificial Sequence
  sgRNA
  BC053393_8
tatcagaagcgcattcgcct

SEQ ID NO: 11271 - DNA, 20 bp, Artificial Sequence
  sgRNA
  BC053393_9
cgagattcaggataagagca

SEQ ID NO: 11272 - DNA, 20 bp, Artificial Sequence
  sgRNA
  BC053393_10
acctcactgcagattcaacc

SEQ ID NO: 11273 - DNA, 20 bp, Artificial Sequence
  sgRNA
  BC053393_11
tgatacatgtggacaaacat

SEQ ID NO: 11274 - DNA, 20 bp, Artificial Sequence
  sgRNA
  BC053393_12
gaaggagtaggaatgtcgaa

SEQ ID NO: 11275 - DNA, 20 bp, Artificial Sequence
  sgRNA
  BC053393_13
atactctcatttgtgtgctg

SEQ ID NO: 11276 - DNA, 20 bp, Artificial Sequence
  sgRNA
  BC053393_14
atgtcgaaaggaggacttga

SEQ ID NO: 11277 - DNA, 20 bp, Artificial Sequence
  sgRNA
  BC053393_15
cggtctctactgctgtcgag

SEQ ID NO: 11278 - DNA, 20 bp, Artificial Sequence
  sgRNA
  BC053393_16
aaatggagagtccaatagca

SEQ ID NO: 11279 - DNA, 20 bp, Artificial Sequence
  sgRNA
  BC053393_17
caggaagtccatggaacagg

SEQ ID NO: 11280 - DNA, 20 bp, Artificial Sequence
  sgRNA
  BC053393_18
attacatccttatgaaaaag

SEQ ID NO: 11281 - DNA, 20 bp, Artificial Sequence
  sgRNA
  BC053393_19
cagaactttactaaataaag

SEQ ID NO: 11282 - DNA, 20 bp, Artificial Sequence
  sgRNA
  BC053393_20
aggactaaaggccttgctat

SEQ ID NO: 11283 - DNA, 20 bp, Artificial Sequence
  sgRNA
  Bace1_1
gctgccccgggagaccgacg

SEQ ID NO: 11284 - DNA, 20 bp, Artificial Sequence
  sgRNA
  Bace1_2
gactgcccgtgtatagcgag

SEQ ID NO: 11285 - DNA, 20 bp, Artificial Sequence
  sgRNA
  Bace1_3
cacatatcgagacctccgaa

SEQ ID NO: 11286 - DNA, 20 bp, Artificial Sequence
  sgRNA
  Bace1_4
cagacggagaagttcccgga

SEQ ID NO: 11287 - DNA, 20 bp, Artificial Sequence
  sgRNA
  Bace1_5
gattcctcgtcggtctcccg

SEQ ID NO: 11288 - DNA, 20 bp, Artificial Sequence
  sgRNA
  Bace1_6
ataataccactcccgccgga

SEQ ID NO: 11289 - DNA, 20 bp, Artificial Sequence
  sgRNA
  Bace1_7
gcacatacacaccctttcgg

SEQ ID NO: 11290 - DNA, 20 bp, Artificial Sequence
  sgRNA
  Bace1_8
atactttcttgggcaagcga

SEQ ID NO: 11291 - DNA, 20 bp, Artificial Sequence
  sgRNA
  Bace1_9
agcgccactgacataccatg

SEQ ID NO: 11292 - DNA, 20 bp, Artificial Sequence
  sgRNA
  Bace1_10
aggctcctccgattcctcgt

SEQ ID NO: 11293 - DNA, 20 bp, Artificial Sequence
  sgRNA
  Bace1_11
gtaacagtcgtcttgggacg

SEQ ID NO: 11294 - DNA, 20 bp, Artificial Sequence
  sgRNA
  Bace1_12
gcacgatgagttcaggacgg

SEQ ID NO: 11295 - DNA, 20 bp, Artificial Sequence
  sgRNA
  Bace1_13
gcaatacctacggccggtgg

SEQ ID NO: 11296 - DNA, 20 bp, Artificial Sequence
  sgRNA
  Bace1_14
tctggtacacacccatccgg

SEQ ID NO: 11297 - DNA, 20 bp, Artificial Sequence
  sgRNA
  Bace1_15
tatcgaccactcgctataca

SEQ ID NO: 11298 - DNA, 20 bp, Artificial Sequence
  sgRNA
  Bace1_16
ggtagtagcgatgcaggaaa

SEQ ID NO: 11299 - DNA, 20 bp, Artificial Sequence
  sgRNA
  Bace1_17
gctgtctcacagtcatccac

SEQ ID NO: 11300 - DNA, 20 bp, Artificial Sequence
  sgRNA
  Bace1_18
tcctgcatcgctactaccag

SEQ ID NO: 11301 - DNA, 20 bp, Artificial Sequence
  sgRNA
  Bace1_19
ctggtacacacccatccggc

SEQ ID NO: 11302 - DNA, 20 bp, Artificial Sequence
  sgRNA
  Bace1_20
gattggtgacttcacccatg

SEQ ID NO: 11303 - DNA, 20 bp, Artificial Sequence
  sgRNA
  Bace2_1
acacctactttgactcagag

SEQ ID NO: 11304 - DNA, 20 bp, Artificial Sequence
  sgRNA
  Bace2_2
gtttcagtataacgcagaca

SEQ ID NO: 11305 - DNA, 20 bp, Artificial Sequence
  sgRNA
  Bace2_3
agggccagaccatcggcccg

SEQ ID NO: 11306 - DNA, 20 bp, Artificial Sequence
  sgRNA
  Bace2_4
taccaacggaggtagtcttg

SEQ ID NO: 11307 - DNA, 20 bp, Artificial Sequence
  sgRNA
  Bace2_5
actcatcgttaactacctca

SEQ ID NO: 11308 - DNA, 20 bp, Artificial Sequence
  sgRNA
  Bace2_6
gcatctctaggtagtagccg

SEQ ID NO: 11309 - DNA, 20 bp, Artificial Sequence
  sgRNA
  Bace2_7
tcatgccccccgagaccctg

SEQ ID NO: 11310 - DNA, 20 bp, Artificial Sequence
  sgRNA
  Bace2_8
cgtgatggaaggcttctacg

SEQ ID NO: 11311 - DNA, 20 bp, Artificial Sequence
  sgRNA
  Bace2_9
tggtctttgacagagctcag

SEQ ID NO: 11312 - DNA, 20 bp, Artificial Sequence
  sgRNA
  Bace2_10
gtagctggttctggtaccaa

SEQ ID NO: 11313 - DNA, 20 bp, Artificial Sequence
  sgRNA
  Bace2_11
gtcactgtgaagtacacaca

SEQ ID NO: 11314 - DNA, 20 bp, Artificial Sequence
  sgRNA
  Bace2_12
agaatgccagtcgctccttc

SEQ ID NO: 11315 - DNA, 20 bp, Artificial Sequence
  sgRNA
  Bace2_13
tgtcactgtgaagtacacac

SEQ ID NO: 11316 - DNA, 20 bp, Artificial Sequence
  sgRNA
  Bace2_14
tccagcacataccactccaa

SEQ ID NO: 11317 - DNA, 20 bp, Artificial Sequence
  sgRNA
  Bace2_15
cttcacgctgcccctccaag

SEQ ID NO: 11318 - DNA, 20 bp, Artificial Sequence
  sgRNA
  Bace2_16
aatctttgcttgggccacca

SEQ ID NO: 11319 - DNA, 20 bp, Artificial Sequence
  sgRNA
  Bace2_17
aatttgtccagcatgccagc

SEQ ID NO: 11320 - DNA, 20 bp, Artificial Sequence
  sgRNA
  Bace2_18
gctatgtcttccgtggaaaa

SEQ ID NO: 11321 - DNA, 20 bp, Artificial Sequence
  sgRNA
  Bace2_19
gctatggtggacaaccttca

SEQ ID NO: 11322 - DNA, 20 bp, Artificial Sequence
  sgRNA
  Bace2_20
ggtgatccggaaggagcgac

SEQ ID NO: 11323 - DNA, 20 bp, Artificial Sequence
  sgRNA
  Bambi_1
gaagacatgtgcaattatcg

SEQ ID NO: 11324 - DNA, 20 bp, Artificial Sequence
  sgRNA
  Bambi_2
gaaccgctatcacagctgcg

SEQ ID NO: 11325 - DNA, 20 bp, Artificial Sequence
  sgRNA
  Bambi_3
agtggagaattggtgttctg

SEQ ID NO: 11326 - DNA, 20 bp, Artificial Sequence
  sgRNA
  Bambi_4
atggctgtgctgctcaccaa

SEQ ID NO: 11327 - DNA, 20 bp, Artificial Sequence
  sgRNA
  Bambi_5
gtacatgccccagtgcacaa

SEQ ID NO: 11328 - DNA, 20 bp, Artificial Sequence
  sgRNA
  Bambi_6
aagatcagtccgccagcaat

SEQ ID NO: 11329 - DNA, 20 bp, Artificial Sequence
  sgRNA
  Bambi_7
gcggaaccacagttctttgg

SEQ ID NO: 11330 - DNA, 20 bp, Artificial Sequence
  sgRNA
  Bambi_8
accaattctccactcaccca

SEQ ID NO: 11331 - DNA, 20 bp, Artificial Sequence
  sgRNA
  Bambi_9
cctggactcacttgcaagca

SEQ ID NO: 11332 - DNA, 20 bp, Artificial Sequence
  sgRNA
  Bambi_10
aagtgagtccaggcagccgt

SEQ ID NO: 11333 - DNA, 20 bp, Artificial Sequence
  sgRNA
  Bambi_11
gtctgacctgtgacaaaatg

SEQ ID NO: 11334 - DNA, 20 bp, Artificial Sequence
  sgRNA
  Bambi_12
gcaagttgcaaagttggact

SEQ ID NO: 11335 - DNA, 20 bp, Artificial Sequence
  sgRNA
  Bambi_13
acggacaccattccaagaag

SEQ ID NO: 11336 - DNA, 20 bp, Artificial Sequence
  sgRNA
  Bambi_14
gtgaaagctgtagtgcagac

SEQ ID NO: 11337 - DNA, 20 bp, Artificial Sequence
  sgRNA
  Bambi_15
tcacggacaccattccaaga

SEQ ID NO: 11338 - DNA, 20 bp, Artificial Sequence
  sgRNA
  Bambi_16
ctcacttcgaagcattcgca

SEQ ID NO: 11339 - DNA, 20 bp, Artificial Sequence
  sgRNA
  Bambi_17
acaagaggctgcaggatgag

SEQ ID NO: 11340 - DNA, 20 bp, Artificial Sequence
  sgRNA
  Bambi_18
tttggtgagcagcacagcca

SEQ ID NO: 11341 - DNA, 20 bp, Artificial Sequence
  sgRNA
  Bambi_19
cttcgctcttggaaggagag

SEQ ID NO: 11342 - DNA, 20 bp, Artificial Sequence
  sgRNA
  Bambi_20
agatcctctcccttgtgcac

SEQ ID NO: 11343 - DNA, 20 bp, Artificial Sequence
  sgRNA
  Bcam_1
cgagagtctacctcgtatgg

SEQ ID NO: 11344 - DNA, 20 bp, Artificial Sequence
  sgRNA
  Bcam_2
accatgtgatccgaggcacg

SEQ ID NO: 11345 - DNA, 20 bp, Artificial Sequence
  sgRNA
  Bcam_3
ggaggattacgatgccgacg

SEQ ID NO: 11346 - DNA, 20 bp, Artificial Sequence
  sgRNA
  Bcam_4
gtccatcgcacagtaggagt

SEQ ID NO: 11347 - DNA, 20 bp, Artificial Sequence
  sgRNA
  Bcam_5
gggccgcgtacccccatacg

SEQ ID NO: 11348 - DNA, 20 bp, Artificial Sequence
  sgRNA
  Bcam_6
tttcggtaccatgtgatccg

SEQ ID NO: 11349 - DNA, 20 bp, Artificial Sequence
  sgRNA
  Bcam_7
gttccgatgcacccgttcta

SEQ ID NO: 11350 - DNA, 20 bp, Artificial Sequence
  sgRNA
  Bcam_8
ggactacgtgtgcgtagtga

SEQ ID NO: 11351 - DNA, 20 bp, Artificial Sequence
  sgRNA
  Bcam_9
gattctgtgacccttgcaga

SEQ ID NO: 11352 - DNA, 20 bp, Artificial Sequence
  sgRNA
  Bcam_10
cctgaacagcagcagcacgg

SEQ ID NO: 11353 - DNA, 20 bp, Artificial Sequence
  sgRNA
  Bcam_11
ccacctctgcctcctccgga

SEQ ID NO: 11354 - DNA, 20 bp, Artificial Sequence
  sgRNA
  Bcam_12
cagcctctaccctcaaaggg

SEQ ID NO: 11355 - DNA, 20 bp, Artificial Sequence
  sgRNA
  Bcam_13
gcaaaggtccaggtgggcga

SEQ ID NO: 11356 - DNA, 20 bp, Artificial Sequence
  sgRNA
  Bcam_14
ctacctcgtatgggggtacg

SEQ ID NO: 11357 - DNA, 20 bp, Artificial Sequence
  sgRNA
  Bcam_15
tgaccagcaccctctacctg

SEQ ID NO: 11358 - DNA, 20 bp, Artificial Sequence
  sgRNA
  Bcam_16
tgaccctagaacgggtgcat

SEQ ID NO: 11359 - DNA, 20 bp, Artificial Sequence
  sgRNA
  Bcam_17
ccagaattctacatgttccg

SEQ ID NO: 11360 - DNA, 20 bp, Artificial Sequence
  sgRNA
  Bcam_18
cctggacctttgctatcacc

SEQ ID NO: 11361 - DNA, 20 bp, Artificial Sequence
  sgRNA
  Bcam_19
tctattgcatgagacgcaaa

SEQ ID NO: 11362 - DNA, 20 bp, Artificial Sequence
  sgRNA
  Bcam_20
ggtgatagcaaaggtccagg

SEQ ID NO: 11363 - DNA, 20 bp, Artificial Sequence
  sgRNA
  Bcan_1
cgaagcctaccggttccgcg

SEQ ID NO: 11364 - DNA, 20 bp, Artificial Sequence
  sgRNA
  Bcan_2
gatggagagcgagtctcgtg

SEQ ID NO: 11365 - DNA, 20 bp, Artificial Sequence
  sgRNA
  Bcan_3
tggatggctatcctggcgtg

SEQ ID NO: 11366 - DNA, 20 bp, Artificial Sequence
  sgRNA
  Bcan_4
acacccagccaacgctgtgg

SEQ ID NO: 11367 - DNA, 20 bp, Artificial Sequence
  sgRNA
  Bcan_5
acacatccgtgagcgatgcg

SEQ ID NO: 11368 - DNA, 20 bp, Artificial Sequence
  sgRNA
  Bcan_6
actgcggcccaatgattccg

SEQ ID NO: 11369 - DNA, 20 bp, Artificial Sequence
  sgRNA
  Bcan_7
gcagctgcctcaggaagcga

SEQ ID NO: 11370 - DNA, 20 bp, Artificial Sequence
  sgRNA
  Bcan_8
gagccacagccactccaccg

SEQ ID NO: 11371 - DNA, 20 bp, Artificial Sequence
  sgRNA
  Bcan_9
gcgaccaaatatttgagcca

SEQ ID NO: 11372 - DNA, 20 bp, Artificial Sequence
  sgRNA
  Bcan_10
cctggcagcggatcaacggc

SEQ ID NO: 11373 - DNA, 20 bp, Artificial Sequence
  sgRNA
  Bcan_11
agatttcctgtgtaccccgg

SEQ ID NO: 11374 - DNA, 20 bp, Artificial Sequence
  sgRNA
  Bcan_12
tcaaggtaaacgaagcctac

SEQ ID NO: 11375 - DNA, 20 bp, Artificial Sequence
  sgRNA
  Bcan_13
ttccggggtctatcgctgcg

SEQ ID NO: 11376 - DNA, 20 bp, Artificial Sequence
  sgRNA
  Bcan_14
tatcctggcgtgcggaacta

SEQ ID NO: 11377 - DNA, 20 bp, Artificial Sequence
  sgRNA
  Bcan_15
ggcagcatagagctgctccg

SEQ ID NO: 11378 - DNA, 20 bp, Artificial Sequence
  sgRNA
  Bcan_16
catgccacgtccaccacctg

SEQ ID NO: 11379 - DNA, 20 bp, Artificial Sequence
  sgRNA
  Bcan_17
cagagactttgctccccccg

SEQ ID NO: 11380 - DNA, 20 bp, Artificial Sequence
  sgRNA
  Bcan_18
tggcgtgcggaactacggag

SEQ ID NO: 11381 - DNA, 20 bp, Artificial Sequence
  sgRNA
  Bcan_19
tggacgccccagaaggacca

SEQ ID NO: 11382 - DNA, 20 bp, Artificial Sequence
  sgRNA
  Bcan_20
gcaggtggtggacgtggcat

SEQ ID NO: 11383 - DNA, 20 bp, Artificial Sequence
  sgRNA
  Bdkrb1_1
ggtataccagcaacctgtag

SEQ ID NO: 11384 - DNA, 20 bp, Artificial Sequence
  sgRNA
  Bdkrb1_2
ggaacgcagaaggaacgtgg

SEQ ID NO: 11385 - DNA, 20 bp, Artificial Sequence
  sgRNA
  Bdkrb1_3
caaagtgccaagcttcgtgg

SEQ ID NO: 11386 - DNA, 20 bp, Artificial Sequence
  sgRNA
  Bdkrb1_4
aaccatagcagaaatctacc

SEQ ID NO: 11387 - DNA, 20 bp, Artificial Sequence
  sgRNA
  Bdkrb1_5
ccaacgttctctgcccagaa

SEQ ID NO: 11388 - DNA, 20 bp, Artificial Sequence
  sgRNA
  Bdkrb1_6
agaaggctgtagcttcagcg

SEQ ID NO: 11389 - DNA, 20 bp, Artificial Sequence
  sgRNA
  Bdkrb1_7
tggaagtgacctctgccggg

SEQ ID NO: 11390 - DNA, 20 bp, Artificial Sequence
  sgRNA
  Bdkrb1_8
tataccccatgaccagctgg

SEQ ID NO: 11391 - DNA, 20 bp, Artificial Sequence
  sgRNA
  Bdkrb1_9
tgatgaccccgctgaccacc

SEQ ID NO: 11392 - DNA, 20 bp, Artificial Sequence
  sgRNA
  Bdkrb1_10
aatggggctgatcctcacac

SEQ ID NO: 11393 - DNA, 20 bp, Artificial Sequence
  sgRNA
  Bdkrb1_11
aggccggctctttaagacca

SEQ ID NO: 11394 - DNA, 20 bp, Artificial Sequence
  sgRNA
  Bdkrb1_12
cagacagtgatgacaaaccc

SEQ ID NO: 11395 - DNA, 20 bp, Artificial Sequence
  sgRNA
  Bdkrb1_13
acaggactaaaaggttcccc

SEQ ID NO: 11396 - DNA, 20 bp, Artificial Sequence
  sgRNA
  Bdkrb1_14
tgaccagctgggggaaccgg

SEQ ID NO: 11397 - DNA, 20 bp, Artificial Sequence
  sgRNA
  Bdkrb1_15
cggaacgcagaaggaacgtg

SEQ ID NO: 11398 - DNA, 20 bp, Artificial Sequence
  sgRNA
  Bdkrb1_16
tcccaacatcacctcctgcg

SEQ ID NO: 11399 - DNA, 20 bp, Artificial Sequence
  sgRNA
  Bdkrb1_17
ggaaggcaaagaagtggtaa

SEQ ID NO: 11400 - DNA, 20 bp, Artificial Sequence
  sgRNA
  Bdkrb1_18
acaaagtgccaagcttcgtg

SEQ ID NO: 11401 - DNA, 20 bp, Artificial Sequence
  sgRNA
  Bdkrb1_19
tttgggtttcctcctcccat

SEQ ID NO: 11402 - DNA, 20 bp, Artificial Sequence
  sgRNA
  Bdkrb1_20
gtataccccatgaccagctg

SEQ ID NO: 11403 - DNA, 20 bp, Artificial Sequence
  sgRNA
  Bdkrb2_1
gcacaaaaacagctgcactg

SEQ ID NO: 11404 - DNA, 20 bp, Artificial Sequence
  sgRNA
  Bdkrb2_2
ggacgggtagacgatgacgc

SEQ ID NO: 11405 - DNA, 20 bp, Artificial Sequence
  sgRNA
  Bdkrb2_3
tcccgttaagagcagacccg

SEQ ID NO: 11406 - DNA, 20 bp, Artificial Sequence
  sgRNA
  Bdkrb2_4
catcgccaataactttgact

SEQ ID NO: 11407 - DNA, 20 bp, Artificial Sequence
  sgRNA
  Bdkrb2_5
acaactgcccagacaccgag

SEQ ID NO: 11408 - DNA, 20 bp, Artificial Sequence
  sgRNA
  Bdkrb2_6
tcttcaccagcgccaggtag

SEQ ID NO: 11409 - DNA, 20 bp, Artificial Sequence
  sgRNA
  Bdkrb2_7
ccacgatcacgtacaccagt

SEQ ID NO: 11410 - DNA, 20 bp, Artificial Sequence
  sgRNA
  Bdkrb2_8
catgggagaacccgtccaga

SEQ ID NO: 11411 - DNA, 20 bp, Artificial Sequence
  sgRNA
  Bdkrb2_9
cttgtggatctgccgttcca

SEQ ID NO: 11412 - DNA, 20 bp, Artificial Sequence
  sgRNA
  Bdkrb2_10
gagcgtcatcaccttctgca

SEQ ID NO: 11413 - DNA, 20 bp, Artificial Sequence
  sgRNA
  Bdkrb2_11
ccactggtgtacgtgatcgt

SEQ ID NO: 11414 - DNA, 20 bp, Artificial Sequence
  sgRNA
  Bdkrb2_12
gaacctcgatctccgtggaa

SEQ ID NO: 11415 - DNA, 20 bp, Artificial Sequence
  sgRNA
  Bdkrb2_13
gcatgagcccatgcccaccg

SEQ ID NO: 11416 - DNA, 20 bp, Artificial Sequence
  sgRNA
  Bdkrb2_14
tttgagaacctcgatctccg

SEQ ID NO: 11417 - DNA, 20 bp, Artificial Sequence
  sgRNA
  Bdkrb2_15
gatctgcgtgatgacgtcta

SEQ ID NO: 11418 - DNA, 20 bp, Artificial Sequence
  sgRNA
  Bdkrb2_16
catggtcctgaacaccaaca

SEQ ID NO: 11419 - DNA, 20 bp, Artificial Sequence
  sgRNA
  Bdkrb2_17
ggatgaggtccgccgctgcc

SEQ ID NO: 11420 - DNA, 20 bp, Artificial Sequence
  sgRNA
  Bdkrb2_18
ggttctccagtgcggccagc

SEQ ID NO: 11421 - DNA, 20 bp, Artificial Sequence
  sgRNA
  Bdkrb2_19
actgcccagacaccgagtgg

SEQ ID NO: 11422 - DNA, 20 bp, Artificial Sequence
  sgRNA
  Bdkrb2_20
ctacccgtcccgttcctggg

SEQ ID NO: 11423 - DNA, 20 bp, Artificial Sequence
  sgRNA
  Best2_1
caggtcttctcaccgatagg

SEQ ID NO: 11424 - DNA, 20 bp, Artificial Sequence
  sgRNA
  Best2_2
cgaccacgtggtctatagtg

SEQ ID NO: 11425 - DNA, 20 bp, Artificial Sequence
  sgRNA
  Best2_3
aggctcgagaaccatacgca

SEQ ID NO: 11426 - DNA, 20 bp, Artificial Sequence
  sgRNA
  Best2_4
gatgggtacgcataggtcca

SEQ ID NO: 11427 - DNA, 20 bp, Artificial Sequence
  sgRNA
  Best2_5
gttccccactatagaccacg

SEQ ID NO: 11428 - DNA, 20 bp, Artificial Sequence
  sgRNA
  Best2_6
gcacgctcatgcgctacgca

SEQ ID NO: 11429 - DNA, 20 bp, Artificial Sequence
  sgRNA
  Best2_7
ccgaggacccggaatcgaca

SEQ ID NO: 11430 - DNA, 20 bp, Artificial Sequence
  sgRNA
  Best2_8
agaacgaaggatcagcaccg

SEQ ID NO: 11431 - DNA, 20 bp, Artificial Sequence
  sgRNA
  Best2_9
aggtgaagatgggtacgcat

SEQ ID NO: 11432 - DNA, 20 bp, Artificial Sequence
  sgRNA
  Best2_10
tcgatcgtctcgcccatgca

SEQ ID NO: 11433 - DNA, 20 bp, Artificial Sequence
  sgRNA
  Best2_11
ctgctgtgctaacagaacga

SEQ ID NO: 11434 - DNA, 20 bp, Artificial Sequence
  sgRNA
  Best2_12
cgtagcgcatgagcgtgcgc

SEQ ID NO: 11435 - DNA, 20 bp, Artificial Sequence
  sgRNA
  Best2_13
cgtcgtcgtcttccccaaaa

SEQ ID NO: 11436 - DNA, 20 bp, Artificial Sequence
  sgRNA
  Best2_14
gcagaggcatgcataggtac

SEQ ID NO: 11437 - DNA, 20 bp, Artificial Sequence
  sgRNA
  Best2_15
ctgcagttcttcttctacgc

SEQ ID NO: 11438 - DNA, 20 bp, Artificial Sequence
  sgRNA
  Best2_16
cgtccggcagaggcatgcat

SEQ ID NO: 11439 - DNA, 20 bp, Artificial Sequence
  sgRNA
  Best2_17
ggtctttgtagccctgtgca

SEQ ID NO: 11440 - DNA, 20 bp, Artificial Sequence
  sgRNA
  Best2_18
actccagctcaggctcccgc

SEQ ID NO: 11441 - DNA, 20 bp, Artificial Sequence
  sgRNA
  Best2_19
cagttcctagaccctgcaca

SEQ ID NO: 11442 - DNA, 20 bp, Artificial Sequence
  sgRNA
  Best2_20
caggctcgagaaccatacgc

SEQ ID NO: 11443 - DNA, 20 bp, Artificial Sequence
  sgRNA
  Bmpr1a_1
gggtaccataaatttctgtg

SEQ ID NO: 11444 - DNA, 20 bp, Artificial Sequence
  sgRNA
  Bmpr1a_2
tgacctacctataacaacag

SEQ ID NO: 11445 - DNA, 20 bp, Artificial Sequence
  sgRNA
  Bmpr1a_3
aatctagatagtatgctcca

SEQ ID NO: 11446 - DNA, 20 bp, Artificial Sequence
  sgRNA
  Bmpr1a_4
catacacccagaagttaatg

SEQ ID NO: 11447 - DNA, 20 bp, Artificial Sequence
  sgRNA
  Bmpr1a_5
gctcgtcgttgtattacagg

SEQ ID NO: 11448 - DNA, 20 bp, Artificial Sequence
  sgRNA
  Bmpr1a_6
catgacgcattaacaccgtc

SEQ ID NO: 11449 - DNA, 20 bp, Artificial Sequence
  sgRNA
  Bmpr1a_7
ataccagggtgggcaccaag

SEQ ID NO: 11450 - DNA, 20 bp, Artificial Sequence
  sgRNA
  Bmpr1a_8
gtgcccaccctggtattcaa

SEQ ID NO: 11451 - DNA, 20 bp, Artificial Sequence
  sgRNA
  Bmpr1a_9
cggatgctgccatcaaagaa

SEQ ID NO: 11452 - DNA, 20 bp, Artificial Sequence
  sgRNA
  Bmpr1a_10
ttacaaccgtgatttggaac

SEQ ID NO: 11453 - DNA, 20 bp, Artificial Sequence
  sgRNA
  Bmpr1a_11
acagattcagatggttcggc

SEQ ID NO: 11454 - DNA, 20 bp, Artificial Sequence
  sgRNA
  Bmpr1a_12
atcctatgaggacatgcgtg

SEQ ID NO: 11455 - DNA, 20 bp, Artificial Sequence
  sgRNA
  Bmpr1a_13
gtatggatgggtaaatggcg

SEQ ID NO: 11456 - DNA, 20 bp, Artificial Sequence
  sgRNA
  Bmpr1a_14
tgacatacccttgaatacca

SEQ ID NO: 11457 - DNA, 20 bp, Artificial Sequence
  sgRNA
  Bmpr1a_15
tctttgatggcagcatccga

SEQ ID NO: 11458 - DNA, 20 bp, Artificial Sequence
  sgRNA
  Bmpr1a_16
aaatgagcacaaccagccat

SEQ ID NO: 11459 - DNA, 20 bp, Artificial Sequence
  sgRNA
  Bmpr1a_17
ccatccatacttctccatag

SEQ ID NO: 11460 - DNA, 20 bp, Artificial Sequence
  sgRNA
  Bmpr1a_18
ggaacagcgatgaagtaagt

SEQ ID NO: 11461 - DNA, 20 bp, Artificial Sequence
  sgRNA
  Bmpr1a_19
agaataagctaacttgagta

SEQ ID NO: 11462 - DNA, 20 bp, Artificial Sequence
  sgRNA
  Bmpr1a_20
tgaatttaacagctaggccc

SEQ ID NO: 11463 - DNA, 20 bp, Artificial Sequence
  sgRNA
  Bmpr2_1
gtaggatgttggtctcacat

SEQ ID NO: 11464 - DNA, 20 bp, Artificial Sequence
  sgRNA
  Bmpr2_2
cacacagaattaccacgagg

SEQ ID NO: 11465 - DNA, 20 bp, Artificial Sequence
  sgRNA
  Bmpr2_3
gctggacatcgaatgctcag

SEQ ID NO: 11466 - DNA, 20 bp, Artificial Sequence
  sgRNA
  Bmpr2_4
agataatgcggctataagtg

SEQ ID NO: 11467 - DNA, 20 bp, Artificial Sequence
  sgRNA
  Bmpr2_5
cttcacacagaattaccacg

SEQ ID NO: 11468 - DNA, 20 bp, Artificial Sequence
  sgRNA
  Bmpr2_6
gcttcatagttggagacgag

SEQ ID NO: 11469 - DNA, 20 bp, Artificial Sequence
  sgRNA
  Bmpr2_7
gctcactgcagacggccgca

SEQ ID NO: 11470 - DNA, 20 bp, Artificial Sequence
  sgRNA
  Bmpr2_8
gcttggactcatctactggg

SEQ ID NO: 11471 - DNA, 20 bp, Artificial Sequence
  sgRNA
  Bmpr2_9
aaatcggctggtgcgcccag

SEQ ID NO: 11472 - DNA, 20 bp, Artificial Sequence
  sgRNA
  Bmpr2_10
tcacaagcaaatactccatg

SEQ ID NO: 11473 - DNA, 20 bp, Artificial Sequence
  sgRNA
  Bmpr2_11
acaaccaccacaaacaccac

SEQ ID NO: 11474 - DNA, 20 bp, Artificial Sequence
  sgRNA
  Bmpr2_12
gctgccatccaggatatttg

SEQ ID NO: 11475 - DNA, 20 bp, Artificial Sequence
  sgRNA
  Bmpr2_13
tggacaacaggacttcacac

SEQ ID NO: 11476 - DNA, 20 bp, Artificial Sequence
  sgRNA
  Bmpr2_14
tccactgcgagctttatgag

SEQ ID NO: 11477 - DNA, 20 bp, Artificial Sequence
  sgRNA
  Bmpr2_15
tgtcagctgtaagcagacag

SEQ ID NO: 11478 - DNA, 20 bp, Artificial Sequence
  sgRNA
  Bmpr2_16
cgtcctgctggtcagcacta

SEQ ID NO: 11479 - DNA, 20 bp, Artificial Sequence
  sgRNA
  Bmpr2_17
gtaactatgaatggtgtggc

SEQ ID NO: 11480 - DNA, 20 bp, Artificial Sequence
  sgRNA
  Bmpr2_18
tcagccacaaatatcctgga

SEQ ID NO: 11481 - DNA, 20 bp, Artificial Sequence
  sgRNA
  Bmpr2_19
gcatatcctcaaatgtggga

SEQ ID NO: 11482 - DNA, 20 bp, Artificial Sequence
  sgRNA
  Bmpr2_20
tctgtgggagaaatcaaaag

SEQ ID NO: 11483 - DNA, 20 bp, Artificial Sequence
  sgRNA
  Boc_1
gggaagccgccgttccctcg

SEQ ID NO: 11484 - DNA, 20 bp, Artificial Sequence
  sgRNA
  Boc_2
gtaggctgtaccgacgacgt

SEQ ID NO: 11485 - DNA, 20 bp, Artificial Sequence
  sgRNA
  Boc_3
ccgatgtatggccagcaatg

SEQ ID NO: 11486 - DNA, 20 bp, Artificial Sequence
  sgRNA
  Boc_4
ctacgtagtgaagcatcgta

SEQ ID NO: 11487 - DNA, 20 bp, Artificial Sequence
  sgRNA
  Boc_5
aatccaggttacgtacacgg

SEQ ID NO: 11488 - DNA, 20 bp, Artificial Sequence
  sgRNA
  Boc_6
gttgggggcttaacaagccc

SEQ ID NO: 11489 - DNA, 20 bp, Artificial Sequence
  sgRNA
  Boc_7
gaaaccatggaacggccggt

SEQ ID NO: 11490 - DNA, 20 bp, Artificial Sequence
  sgRNA
  Boc_8
tacgtaacctggattccccg

SEQ ID NO: 11491 - DNA, 20 bp, Artificial Sequence
  sgRNA
  Boc_9
acgtaacctggattccccga

SEQ ID NO: 11492 - DNA, 20 bp, Artificial Sequence
  sgRNA
  Boc_10
gcttattgacaccaccagcg

SEQ ID NO: 11493 - DNA, 20 bp, Artificial Sequence
  sgRNA
  Boc_11
ggtacagtgtcaaacaggag

SEQ ID NO: 11494 - DNA, 20 bp, Artificial Sequence
  sgRNA
  Boc_12
tcatatccgttgctaacaat

SEQ ID NO: 11495 - DNA, 20 bp, Artificial Sequence
  sgRNA
  Boc_13
tggattccccgagggaacgg

SEQ ID NO: 11496 - DNA, 20 bp, Artificial Sequence
  sgRNA
  Boc_14
cctacacaggacaggaacgt

SEQ ID NO: 11497 - DNA, 20 bp, Artificial Sequence
  sgRNA
  Boc_15
gcttagaccaggccctccat

SEQ ID NO: 11498 - DNA, 20 bp, Artificial Sequence
  sgRNA
  Boc_16
ttagcttcttgtactctaca

SEQ ID NO: 11499 - DNA, 20 bp, Artificial Sequence
  sgRNA
  Boc_17
gagtccgtcttggaggtccg

SEQ ID NO: 11500 - DNA, 20 bp, Artificial Sequence
  sgRNA
  Boc_18
tgttaagcccccaacgtcgt

SEQ ID NO: 11501 - DNA, 20 bp, Artificial Sequence
  sgRNA
  Boc_19
catgtgattgaagtagacga

SEQ ID NO: 11502 - DNA, 20 bp, Artificial Sequence
  sgRNA
  Boc_20
ccactgacgccaccaaggta

SEQ ID NO: 11503 - DNA, 20 bp, Artificial Sequence
  sgRNA
  Brs3_1
tagacagagataatcgagag

SEQ ID NO: 11504 - DNA, 20 bp, Artificial Sequence
  sgRNA
  Brs3_2
aagcctctcagagatagggt

SEQ ID NO: 11505 - DNA, 20 bp, Artificial Sequence
  sgRNA
  Brs3_3
caccctgaacataccgactg

SEQ ID NO: 11506 - DNA, 20 bp, Artificial Sequence
  sgRNA
  Brs3_4
acgatactacacataaagga

SEQ ID NO: 11507 - DNA, 20 bp, Artificial Sequence
  sgRNA
  Brs3_5
tgatgaggatagcatttccg

SEQ ID NO: 11508 - DNA, 20 bp, Artificial Sequence
  sgRNA
  Brs3_6
ggatggctgtttggaaaggt

SEQ ID NO: 11509 - DNA, 20 bp, Artificial Sequence
  sgRNA
  Brs3_7
gcaaaagcctctcagagata

SEQ ID NO: 11510 - DNA, 20 bp, Artificial Sequence
  sgRNA
  Brs3_8
attagtgtgaccctgttcag

SEQ ID NO: 11511 - DNA, 20 bp, Artificial Sequence
  sgRNA
  Brs3_9
gtaacaggtctccgaaagcc

SEQ ID NO: 11512 - DNA, 20 bp, Artificial Sequence
  sgRNA
  Brs3_10
ggcactactgccactgaaca

SEQ ID NO: 11513 - DNA, 20 bp, Artificial Sequence
  sgRNA
  Brs3_11
gtcttcagaatggcattggg

SEQ ID NO: 11514 - DNA, 20 bp, Artificial Sequence
  sgRNA
  Brs3_12
tgtggatgcaacccactacc

SEQ ID NO: 11515 - DNA, 20 bp, Artificial Sequence
  sgRNA
  Brs3_13
agggggatgtcaccaagagg

SEQ ID NO: 11516 - DNA, 20 bp, Artificial Sequence
  sgRNA
  Brs3_14
ggacccgccccatcacagtg

SEQ ID NO: 11517 - DNA, 20 bp, Artificial Sequence
  sgRNA
  Brs3_15
ttaacaacctcactgtgatg

SEQ ID NO: 11518 - DNA, 20 bp, Artificial Sequence
  sgRNA
  Brs3_16
agtggcagtagtgccaagaa

SEQ ID NO: 11519 - DNA, 20 bp, Artificial Sequence
  sgRNA
  Brs3_17
catcacagtgaggttgttaa

SEQ ID NO: 11520 - DNA, 20 bp, Artificial Sequence
  sgRNA
  Brs3_18
ttaagggggatgtcaccaag

SEQ ID NO: 11521 - DNA, 20 bp, Artificial Sequence
  sgRNA
  Brs3_19
caaacagccatccttctgcc

SEQ ID NO: 11522 - DNA, 20 bp, Artificial Sequence
  sgRNA
  Brs3_20
tgaacccctttgctctctat

SEQ ID NO: 11523 - DNA, 20 bp, Artificial Sequence
  sgRNA
  Bsg_1
ggacgcagatgaccgctctg

SEQ ID NO: 11524 - DNA, 20 bp, Artificial Sequence
  sgRNA
  Bsg_2
ccaccttactcggccaccca

SEQ ID NO: 11525 - DNA, 20 bp, Artificial Sequence
  sgRNA
  Bsg_3
gaaatcagagcattccagtg

SEQ ID NO: 11526 - DNA, 20 bp, Artificial Sequence
  sgRNA
  Bsg_4
caaaccaccactggatctcg

SEQ ID NO: 11527 - DNA, 20 bp, Artificial Sequence
  sgRNA
  Bsg_5
cctaccctcctattacagat

SEQ ID NO: 11528 - DNA, 20 bp, Artificial Sequence
  sgRNA
  Bsg_6
gcacggacccacttgaccct

SEQ ID NO: 11529 - DNA, 20 bp, Artificial Sequence
  sgRNA
  Bsg_7
tgtaatgccaccaacgccca

SEQ ID NO: 11530 - DNA, 20 bp, Artificial Sequence
  sgRNA
  Bsg_8
actggctgcatgctgacggt

SEQ ID NO: 11531 - DNA, 20 bp, Artificial Sequence
  sgRNA
  Bsg_9
ggacctcagccacgatgcct

SEQ ID NO: 11532 - DNA, 20 bp, Artificial Sequence
  sgRNA
  Bsg_10
cattacacacgtaggtgcca

SEQ ID NO: 11533 - DNA, 20 bp, Artificial Sequence
  sgRNA
  Bsg_11
gttggtggcattacacacgt

SEQ ID NO: 11534 - DNA, 20 bp, Artificial Sequence
  sgRNA
  Bsg_12
gggccacccaggatcaaggt

SEQ ID NO: 11535 - DNA, 20 bp, Artificial Sequence
  sgRNA
  Bsg_13
aggacaagaatgtacgccag

SEQ ID NO: 11536 - DNA, 20 bp, Artificial Sequence
  sgRNA
  Bsg_14
agatccagtggtggtttgaa

SEQ ID NO: 11537 - DNA, 20 bp, Artificial Sequence
  sgRNA
  Bsg_15
tctttatctatgagaagagg

SEQ ID NO: 11538 - DNA, 20 bp, Artificial Sequence
  sgRNA
  Bsg_16
ctggccttcacgctcttgag

SEQ ID NO: 11539 - DNA, 20 bp, Artificial Sequence
  sgRNA
  Bsg_17
ggctgcatgctgacggtagg

SEQ ID NO: 11540 - DNA, 20 bp, Artificial Sequence
  sgRNA
  Bsg_18
tcagccacgatgcctaggaa

SEQ ID NO: 11541 - DNA, 20 bp, Artificial Sequence
  sgRNA
  Bsg_19
tgacttcctggacagaggtt

SEQ ID NO: 11542 - DNA, 20 bp, Artificial Sequence
  sgRNA
  Bsg_20
gatgcctaggaagggccaga

SEQ ID NO: 11543 - DNA, 20 bp, Artificial Sequence
  sgRNA
  Bst1_1
agactgtgaaaacaacgccg

SEQ ID NO: 11544 - DNA, 20 bp, Artificial Sequence
  sgRNA
  Bst1_2
ttctgggggcaagagcgcgg

SEQ ID NO: 11545 - DNA, 20 bp, Artificial Sequence
  sgRNA
  Bst1_3
cctgctcgttatgagctatg

SEQ ID NO: 11546 - DNA, 20 bp, Artificial Sequence
  sgRNA
  Bst1_4
aaaggagcctatcccacgag

SEQ ID NO: 11547 - DNA, 20 bp, Artificial Sequence
  sgRNA
  Bst1_5
gcgtggtgtactctgcgcag

SEQ ID NO: 11548 - DNA, 20 bp, Artificial Sequence
  sgRNA
  Bst1_6
catagctcataacgagcagg

SEQ ID NO: 11549 - DNA, 20 bp, Artificial Sequence
  sgRNA
  Bst1_7
agcctcagcatctatgcgga

SEQ ID NO: 11550 - DNA, 20 bp, Artificial Sequence
  sgRNA
  Bst1_8
acagctgtgctggaacccca

SEQ ID NO: 11551 - DNA, 20 bp, Artificial Sequence
  sgRNA
  Bst1_9
acaacgccgtggactcctat

SEQ ID NO: 11552 - DNA, 20 bp, Artificial Sequence
  sgRNA
  Bst1_10
gtattcaagagacagttcag

SEQ ID NO: 11553 - DNA, 20 bp, Artificial Sequence
  sgRNA
  Bst1_11
tttcttgagctggtgtcgac

SEQ ID NO: 11554 - DNA, 20 bp, Artificial Sequence
  sgRNA
  Bst1_12
gccatacagcacgtcgcaca

SEQ ID NO: 11555 - DNA, 20 bp, Artificial Sequence
  sgRNA
  Bst1_13
tgaagagatcatagtctgag

SEQ ID NO: 11556 - DNA, 20 bp, Artificial Sequence
  sgRNA
  Bst1_14
aaactgcacagccatctggg

SEQ ID NO: 11557 - DNA, 20 bp, Artificial Sequence
  sgRNA
  Bst1_15
gggttatgcatgacgttgga

SEQ ID NO: 11558 - DNA, 20 bp, Artificial Sequence
  sgRNA
  Bst1_16
tgaaatcccgtacttacaaa

SEQ ID NO: 11559 - DNA, 20 bp, Artificial Sequence
  sgRNA
  Bst1_17
gcacgtcgcacagggccacg

SEQ ID NO: 11560 - DNA, 20 bp, Artificial Sequence
  sgRNA
  Bst1_18
catctgggaggccttcaagg

SEQ ID NO: 11561 - DNA, 20 bp, Artificial Sequence
  sgRNA
  Bst1_19
ccccatagctcataacgagc

SEQ ID NO: 11562 - DNA, 20 bp, Artificial Sequence
  sgRNA
  Bst1_20
tgtcgacaggaaaatgcctc

SEQ ID NO: 11563 - DNA, 20 bp, Artificial Sequence
  sgRNA
  Bst2_1
cgccgtcacagcgaacagcg

SEQ ID NO: 11564 - DNA, 20 bp, Artificial Sequence
  sgRNA
  Bst2_2
ccgtgcccatggatgagatg

SEQ ID NO: 11565 - DNA, 20 bp, Artificial Sequence
  sgRNA
  Bst2_3
aaactcctgcaacctgaccg

SEQ ID NO: 11566 - DNA, 20 bp, Artificial Sequence
  sgRNA
  Bst2_4
ctggcgctgcaacaggtgcg

SEQ ID NO: 11567 - DNA, 20 bp, Artificial Sequence
  sgRNA
  Bst2_5
gtgacactttgagcaccagt

SEQ ID NO: 11568 - DNA, 20 bp, Artificial Sequence
  sgRNA
  Bst2_6
gatgcgggcctgctgctcca

SEQ ID NO: 11569 - DNA, 20 bp, Artificial Sequence
  sgRNA
  Bst2_7
gaacaggaccaccaagatcg

SEQ ID NO: 11570 - DNA, 20 bp, Artificial Sequence
  sgRNA
  Bst2_8
gatcttggtggtcctgttcg

SEQ ID NO: 11571 - DNA, 20 bp, Artificial Sequence
  sgRNA
  Bst2_9
ggtgaactctggcagctcca

SEQ ID NO: 11572 - DNA, 20 bp, Artificial Sequence
  sgRNA
  Bst2_10
gtgcccatggatgagatggg

SEQ ID NO: 11573 - DNA, 20 bp, Artificial Sequence
  sgRNA
  Bst2_11
gctgggggccgcgatcttgg

SEQ ID NO: 11574 - DNA, 20 bp, Artificial Sequence
  sgRNA
  Bst2_12
ttgagacaccttcttctcca

SEQ ID NO: 11575 - DNA, 20 bp, Artificial Sequence
  sgRNA
  Bst2_13
tcttctccagggactcctga

SEQ ID NO: 11576 - DNA, 20 bp, Artificial Sequence
  sgRNA
  Bst2_14
ggcagatagtgatagaaaga

SEQ ID NO: 11577 - DNA, 20 bp, Artificial Sequence
  sgRNA
  Bst2_15
ttcccccccatctcatccat

SEQ ID NO: 11578 - DNA, 20 bp, Artificial Sequence
  sgRNA
  Bst2_16
ggagacttctagcacagtgc

SEQ ID NO: 11579 - DNA, 20 bp, Artificial Sequence
  sgRNA
  Bst2_17
cagtaggctggagaccacca

SEQ ID NO: 11580 - DNA, 20 bp, Artificial Sequence
  sgRNA
  Bst2_18
gggcagatagtgatagaaag

SEQ ID NO: 11581 - DNA, 20 bp, Artificial Sequence
  sgRNA
  Bst2_19
tgaagtcacgaagctgaacc

SEQ ID NO: 11582 - DNA, 20 bp, Artificial Sequence
  sgRNA
  Bst2_20
tcactatctgcccgtgccca

SEQ ID NO: 11583 - DNA, 20 bp, Artificial Sequence
  sgRNA
  Btc_1
tcagaatgaacacttaccca

SEQ ID NO: 11584 - DNA, 20 bp, Artificial Sequence
  sgRNA
  Btc_2
tgggagatgccgcttcgtgg

SEQ ID NO: 11585 - DNA, 20 bp, Artificial Sequence
  sgRNA
  Btc_3
ctgtgagaaaggctactttg

SEQ ID NO: 11586 - DNA, 20 bp, Artificial Sequence
  sgRNA
  Btc_4
agtaatgcttgtactgcttg

SEQ ID NO: 11587 - DNA, 20 bp, Artificial Sequence
  sgRNA
  Btc_5
tttacctccagcaggaccgg

SEQ ID NO: 11588 - DNA, 20 bp, Artificial Sequence
  sgRNA
  Btc_6
tttgctcgtccaccacgaag

SEQ ID NO: 11589 - DNA, 20 bp, Artificial Sequence
  sgRNA
  Btc_7
gaaacatcgtaaaaaaaaga

SEQ ID NO: 11590 - DNA, 20 bp, Artificial Sequence
  sgRNA
  Btc_8
ggtcctgctggaggtaaaac

SEQ ID NO: 11591 - DNA, 20 bp, Artificial Sequence
  sgRNA
  Btc_9
accagaacaccagaaaccaa

SEQ ID NO: 11592 - DNA, 20 bp, Artificial Sequence
  sgRNA
  Btc_10
agaccaccaggatctgcccc

SEQ ID NO: 11593 - DNA, 20 bp, Artificial Sequence
  sgRNA
  Btc_11
ggagctgacactgctacccg

SEQ ID NO: 11594 - DNA, 20 bp, Artificial Sequence
  sgRNA
  Btc_12
agggcaaggaccaggagcag

SEQ ID NO: 11595 - DNA, 20 bp, Artificial Sequence
  sgRNA
  Btc_13
gctcctggggaaaactgcac

SEQ ID NO: 11596 - DNA, 20 bp, Artificial Sequence
  sgRNA
  Btc_14
ccacgaagcggcatctccca

SEQ ID NO: 11597 - DNA, 20 bp, Artificial Sequence
  sgRNA
  Btc_15
tcccatctgctaccacacag

SEQ ID NO: 11598 - DNA, 20 bp, Artificial Sequence
  sgRNA
  Btc_16
ggatctgcccccggtcctgc

SEQ ID NO: 11599 - DNA, 20 bp, Artificial Sequence
  sgRNA
  Btc_17
cttggggcaccgagagaagt

SEQ ID NO: 11600 - DNA, 20 bp, Artificial Sequence
  sgRNA
  Btc_18
gcagtaatgcttgtactgct

SEQ ID NO: 11601 - DNA, 20 bp, Artificial Sequence
  sgRNA
  Btc_19
ccactatcaagcagaccacc

SEQ ID NO: 11602 - DNA, 20 bp, Artificial Sequence
  sgRNA
  Btc_20
gctgtgagaaaggctacttt

SEQ ID NO: 11603 - DNA, 20 bp, Artificial Sequence
  sgRNA
  Btla_1
cagtgcaacttactattacg

SEQ ID NO: 11604 - DNA, 20 bp, Artificial Sequence
  sgRNA
  Btla_2
ttcatagacctaatgtgact

SEQ ID NO: 11605 - DNA, 20 bp, Artificial Sequence
  sgRNA
  Btla_3
tcacatggatggttactgaa

SEQ ID NO: 11606 - DNA, 20 bp, Artificial Sequence
  sgRNA
  Btla_4
tttgatacttacttattagt

SEQ ID NO: 11607 - DNA, 20 bp, Artificial Sequence
  sgRNA
  Btla_5
aagaattccctaaataaccg

SEQ ID NO: 11608 - DNA, 20 bp, Artificial Sequence
  sgRNA
  Btla_6
gcaatcagagagaaacaacc

SEQ ID NO: 11609 - DNA, 20 bp, Artificial Sequence
  sgRNA
  Btla_7
caatcagagagaaacaacca

SEQ ID NO: 11610 - DNA, 20 bp, Artificial Sequence
  sgRNA
  Btla_8
tcatcctgcatgctagacca

SEQ ID NO: 11611 - DNA, 20 bp, Artificial Sequence
  sgRNA
  Btla_9
tcataaattccagttcctga

SEQ ID NO: 11612 - DNA, 20 bp, Artificial Sequence
  sgRNA
  Btla_10
tgatttgtcctggaactggc

SEQ ID NO: 11613 - DNA, 20 bp, Artificial Sequence
  sgRNA
  Btla_11
agcagaagcaatgcccccaa

SEQ ID NO: 11614 - DNA, 20 bp, Artificial Sequence
  sgRNA
  Btla_12
aagaagcataaacaatgccc

SEQ ID NO: 11615 - DNA, 20 bp, Artificial Sequence
  sgRNA
  Btla_13
caatacatctcagtgataat

SEQ ID NO: 11616 - DNA, 20 bp, Artificial Sequence
  sgRNA
  Btla_14
acaggaaaacaacatgcagg

SEQ ID NO: 11617 - DNA, 20 bp, Artificial Sequence
  sgRNA
  Btla_15
tccaccatggaagagaggcc

SEQ ID NO: 11618 - DNA, 20 bp, Artificial Sequence
  sgRNA
  Btla_16
ctgccatgcttgggactcct

SEQ ID NO: 11619 - DNA, 20 bp, Artificial Sequence
  sgRNA
  Btla_17
tcccaactagtgtatagctg

SEQ ID NO: 11620 - DNA, 20 bp, Artificial Sequence
  sgRNA
  Btla_18
tttgtgagaaagctactaag

SEQ ID NO: 11621 - DNA, 20 bp, Artificial Sequence
  sgRNA
  Btla_19
tcttagtagctttctcacaa

SEQ ID NO: 11622 - DNA, 20 bp, Artificial Sequence
  sgRNA
  Btla_20
tgaaccattgtgttattgga

SEQ ID NO: 11623 - DNA, 20 bp, Artificial Sequence
  sgRNA
  Btn1a1_1
gcggtacttctataccggga

SEQ ID NO: 11624 - DNA, 20 bp, Artificial Sequence
  sgRNA
  Btn1a1_2
ggccgccgtatacctcaaag

SEQ ID NO: 11625 - DNA, 20 bp, Artificial Sequence
  sgRNA
  Btn1a1_3
gggagtcagccttggcacga

SEQ ID NO: 11626 - DNA, 20 bp, Artificial Sequence
  sgRNA
  Btn1a1_4
ttcttggactctgacgtgga

SEQ ID NO: 11627 - DNA, 20 bp, Artificial Sequence
  sgRNA
  Btn1a1_5
tgtcgcctcgtcactccgcg

SEQ ID NO: 11628 - DNA, 20 bp, Artificial Sequence
  sgRNA
  Btn1a1_6
ccaaagtgagagtctccgcg

SEQ ID NO: 11629 - DNA, 20 bp, Artificial Sequence
  sgRNA
  Btn1a1_7
tgaggtgcggtcacatcgaa

SEQ ID NO: 11630 - DNA, 20 bp, Artificial Sequence
  sgRNA
  Btn1a1_8
ggacctctctccgattagca

SEQ ID NO: 11631 - DNA, 20 bp, Artificial Sequence
  sgRNA
  Btn1a1_9
gatgacggagtaccgcggga

SEQ ID NO: 11632 - DNA, 20 bp, Artificial Sequence
  sgRNA
  Btn1a1_10
agacaacgacgacttcgagg

SEQ ID NO: 11633 - DNA, 20 bp, Artificial Sequence
  sgRNA
  Btn1a1_11
tcgacagacgaggtcgacag

SEQ ID NO: 11634 - DNA, 20 bp, Artificial Sequence
  sgRNA
  Btn1a1_12
agccactttgaggtatacgg

SEQ ID NO: 11635 - DNA, 20 bp, Artificial Sequence
  sgRNA
  Btn1a1_13
gggtgagcagacagaccagg

SEQ ID NO: 11636 - DNA, 20 bp, Artificial Sequence
  sgRNA
  Btn1a1_14
agaaaaaccccaactctgcg

SEQ ID NO: 11637 - DNA, 20 bp, Artificial Sequence
  sgRNA
  Btn1a1_15
agtacagccttcccccagcg

SEQ ID NO: 11638 - DNA, 20 bp, Artificial Sequence
  sgRNA
  Btn1a1_16
cccgttctcacctagccaag

SEQ ID NO: 11639 - DNA, 20 bp, Artificial Sequence
  sgRNA
  Btn1a1_17
gaaaaaccccaactctgcga

SEQ ID NO: 11640 - DNA, 20 bp, Artificial Sequence
  sgRNA
  Btn1a1_18
cagcagatgacggagtaccg

SEQ ID NO: 11641 - DNA, 20 bp, Artificial Sequence
  sgRNA
  Btn1a1_19
cagacaaaagaagggacgga

SEQ ID NO: 11642 - DNA, 20 bp, Artificial Sequence
  sgRNA
  Btn1a1_20
accccatgactcctgataat

SEQ ID NO: 11643 - DNA, 20 bp, Artificial Sequence
  sgRNA
  Btn2a2_1
ggcaaccatgaagcttatgg

SEQ ID NO: 11644 - DNA, 20 bp, Artificial Sequence
  sgRNA
  Btn2a2_2
gagcagatggtggcataccg

SEQ ID NO: 11645 - DNA, 20 bp, Artificial Sequence
  sgRNA
  Btn2a2_3
tggtcctatgacagtaaact

SEQ ID NO: 11646 - DNA, 20 bp, Artificial Sequence
  sgRNA
  Btn2a2_4
caggtacaacttcatcatag

SEQ ID NO: 11647 - DNA, 20 bp, Artificial Sequence
  sgRNA
  Btn2a2_5
tcagaaccaagcctaaagaa

SEQ ID NO: 11648 - DNA, 20 bp, Artificial Sequence
  sgRNA
  Btn2a2_6
tggtgtttgtagagacagcg

SEQ ID NO: 11649 - DNA, 20 bp, Artificial Sequence
  sgRNA
  Btn2a2_7
gaccagagaagtgtaatacg

SEQ ID NO: 11650 - DNA, 20 bp, Artificial Sequence
  sgRNA
  Btn2a2_8
gtgtaatacgaggctcttcg

SEQ ID NO: 11651 - DNA, 20 bp, Artificial Sequence
  sgRNA
  Btn2a2_9
gcagggaaagcttctcctca

SEQ ID NO: 11652 - DNA, 20 bp, Artificial Sequence
  sgRNA
  Btn2a2_10
gccttgtcaagaaacaccgc

SEQ ID NO: 11653 - DNA, 20 bp, Artificial Sequence
  sgRNA
  Btn2a2_11
aggccatcaagagagaccag

SEQ ID NO: 11654 - DNA, 20 bp, Artificial Sequence
  sgRNA
  Btn2a2_12
ctggcttccaaacatctcca

SEQ ID NO: 11655 - DNA, 20 bp, Artificial Sequence
  sgRNA
  Btn2a2_13
ctctgtacaccagcactgca

SEQ ID NO: 11656 - DNA, 20 bp, Artificial Sequence
  sgRNA
  Btn2a2_14
tattctctcctaccatggcc

SEQ ID NO: 11657 - DNA, 20 bp, Artificial Sequence
  sgRNA
  Btn2a2_15
cagggagttacaatacctga

SEQ ID NO: 11658 - DNA, 20 bp, Artificial Sequence
  sgRNA
  Btn2a2_16
gacggcagtcaaatctctca

SEQ ID NO: 11659 - DNA, 20 bp, Artificial Sequence
  sgRNA
  Btn2a2_17
tcatctgtccagcattcaca

SEQ ID NO: 11660 - DNA, 20 bp, Artificial Sequence
  sgRNA
  Btn2a2_18
atgcgcacagacatcagcaa

SEQ ID NO: 11661 - DNA, 20 bp, Artificial Sequence
  sgRNA
  Btn2a2_19
gctcctctggtctctcttga

SEQ ID NO: 11662 - DNA, 20 bp, Artificial Sequence
  sgRNA
  Btn2a2_20
ggagttacaatacctgaggg

SEQ ID NO: 11663 - DNA, 20 bp, Artificial Sequence
  sgRNA
  Btnl9_1
ctggtacaggtacaccacgt

SEQ ID NO: 11664 - DNA, 20 bp, Artificial Sequence
  sgRNA
  Btnl9_2
gagacatccgtgattgtccg

SEQ ID NO: 11665 - DNA, 20 bp, Artificial Sequence
  sgRNA
  Btnl9_3
taaagtgcttccctccgacg

SEQ ID NO: 11666 - DNA, 20 bp, Artificial Sequence
  sgRNA
  Btnl9_4
gggccaaaatggactcctca

SEQ ID NO: 11667 - DNA, 20 bp, Artificial Sequence
  sgRNA
  Btnl9_5
gtgagcacaatcagactgag

SEQ ID NO: 11668 - DNA, 20 bp, Artificial Sequence
  sgRNA
  Btnl9_6
cgtgctggacccgcatcgcg

SEQ ID NO: 11669 - DNA, 20 bp, Artificial Sequence
  sgRNA
  Btnl9_7
gcttcaccgacactttctca

SEQ ID NO: 11670 - DNA, 20 bp, Artificial Sequence
  sgRNA
  Btnl9_8
cgtgcacctcccagtagtgg

SEQ ID NO: 11671 - DNA, 20 bp, Artificial Sequence
  sgRNA
  Btnl9_9
cctcattaacagcccaggcg

SEQ ID NO: 11672 - DNA, 20 bp, Artificial Sequence
  sgRNA
  Btnl9_10
tctgctctttgccggttaga

SEQ ID NO: 11673 - DNA, 20 bp, Artificial Sequence
  sgRNA
  Btnl9_11
ggtatgatgataagcgacat

SEQ ID NO: 11674 - DNA, 20 bp, Artificial Sequence
  sgRNA
  Btnl9_12
gctcccactgaagatgtaac

SEQ ID NO: 11675 - DNA, 20 bp, Artificial Sequence
  sgRNA
  Btnl9_13
aattcactactgtggaggaa

SEQ ID NO: 11676 - DNA, 20 bp, Artificial Sequence
  sgRNA
  Btnl9_14
agttcacctcccacaactga

SEQ ID NO: 11677 - DNA, 20 bp, Artificial Sequence
  sgRNA
  Btnl9_15
aggcgtcctgttggactacg

SEQ ID NO: 11678 - DNA, 20 bp, Artificial Sequence
  sgRNA
  Btnl9_16
ggtttctgaagcaaatacct

SEQ ID NO: 11679 - DNA, 20 bp, Artificial Sequence
  sgRNA
  Btnl9_17
gcacaatcagactgagcggc

SEQ ID NO: 11680 - DNA, 20 bp, Artificial Sequence
  sgRNA
  Btnl9_18
tgctacttccagctcccacg

SEQ ID NO: 11681 - DNA, 20 bp, Artificial Sequence
  sgRNA
  Btnl9_19
aggacctgtggccctctaac

SEQ ID NO: 11682 - DNA, 20 bp, Artificial Sequence
  sgRNA
  Btnl9_20
gacaggcgcccaggaaccag

SEQ ID NO: 11683 - DNA, 20 bp, Artificial Sequence
  sgRNA
  Bves_1
gggccaggtttacgccacag

SEQ ID NO: 11684 - DNA, 20 bp, Artificial Sequence
  sgRNA
  Bves_2
ggagtggttcaaacaaccga

SEQ ID NO: 11685 - DNA, 20 bp, Artificial Sequence
  sgRNA
  Bves_3
agatcaacgcagatgcacaa

SEQ ID NO: 11686 - DNA, 20 bp, Artificial Sequence
  sgRNA
  Bves_4
ctctgagcagtatcatatgg

SEQ ID NO: 11687 - DNA, 20 bp, Artificial Sequence
  sgRNA
  Bves_5
agtggcccagaccacataaa

SEQ ID NO: 11688 - DNA, 20 bp, Artificial Sequence
  sgRNA
  Bves_6
accttctaaacaaatccgga

SEQ ID NO: 11689 - DNA, 20 bp, Artificial Sequence
  sgRNA
  Bves_7
tcatcacatccaaggcacag

SEQ ID NO: 11690 - DNA, 20 bp, Artificial Sequence
  sgRNA
  Bves_8
agctgggtggtgtctaccat

SEQ ID NO: 11691 - DNA, 20 bp, Artificial Sequence
  sgRNA
  Bves_9
ggcctgcaccactttctgcg

SEQ ID NO: 11692 - DNA, 20 bp, Artificial Sequence
  sgRNA
  Bves_10
gcagttatcatctgcaacaa

SEQ ID NO: 11693 - DNA, 20 bp, Artificial Sequence
  sgRNA
  Bves_11
gatgaagccaatcgaggaag

SEQ ID NO: 11694 - DNA, 20 bp, Artificial Sequence
  sgRNA
  Bves_12
tatgatccagaccttgaaaa

SEQ ID NO: 11695 - DNA, 20 bp, Artificial Sequence
  sgRNA
  Bves_13
ttgctacatgaaaaaccaga

SEQ ID NO: 11696 - DNA, 20 bp, Artificial Sequence
  sgRNA
  Bves_14
tatcatatggaggtgaagag

SEQ ID NO: 11697 - DNA, 20 bp, Artificial Sequence
  sgRNA
  Bves_15
aaccttctaaacaaatccgg

SEQ ID NO: 11698 - DNA, 20 bp, Artificial Sequence
  sgRNA
  Bves_16
agatgaagccaatcgaggaa

SEQ ID NO: 11699 - DNA, 20 bp, Artificial Sequence
  sgRNA
  Bves_17
ctacagttgactgtgccagc

SEQ ID NO: 11700 - DNA, 20 bp, Artificial Sequence
  sgRNA
  Bves_18
agtatcaccagctccagcga

SEQ ID NO: 11701 - DNA, 20 bp, Artificial Sequence
  sgRNA
  Bves_19
gcatggagatctgtgtgcag

SEQ ID NO: 11702 - DNA, 20 bp, Artificial Sequence
  sgRNA
  Bves_20
agaggctcgctgctgcgggg

SEQ ID NO: 11703 - DNA, 20 bp, Artificial Sequence
  sgRNA
  C130060K24Rik_1
ggtcaccacatagactacca

SEQ ID NO: 11704 - DNA, 20 bp, Artificial Sequence
  sgRNA
  C130060K24Rik_2
tcatcataggatcacccatg

SEQ ID NO: 11705 - DNA, 20 bp, Artificial Sequence
  sgRNA
  C130060K24Rik_3
ttggatcaagaaaagaatcg

SEQ ID NO: 11706 - DNA, 20 bp, Artificial Sequence
  sgRNA
  C130060K24Rik_4
tcatcgcgcactatgggctg

SEQ ID NO: 11707 - DNA, 20 bp, Artificial Sequence
  sgRNA
  C130060K24Rik_5
tgtagatcttctggtgcacg

SEQ ID NO: 11708 - DNA, 20 bp, Artificial Sequence
  sgRNA
  C130060K24Rik_6
agctatggtgatgcacagga

SEQ ID NO: 11709 - DNA, 20 bp, Artificial Sequence
  sgRNA
  C130060K24Rik_7
cttcacaatgcaatagcaaa

SEQ ID NO: 11710 - DNA, 20 bp, Artificial Sequence
  sgRNA
  C130060K24Rik_8
ccttcttcagcacggaagca

SEQ ID NO: 11711 - DNA, 20 bp, Artificial Sequence
  sgRNA
  C130060K24Rik_9
gagcaggtcgctgagtgcca

SEQ ID NO: 11712 - DNA, 20 bp, Artificial Sequence
  sgRNA
  C130060K24Rik_10
aagtcgctgcacatgccaca

SEQ ID NO: 11713 - DNA, 20 bp, Artificial Sequence
  sgRNA
  C130060K24Rik_11
cgtttgctattgcattgtga

SEQ ID NO: 11714 - DNA, 20 bp, Artificial Sequence
  sgRNA
  C130060K24Rik_12
aggctggccctcctgctggt

SEQ ID NO: 11715 - DNA, 20 bp, Artificial Sequence
  sgRNA
  C130060K24Rik_13
aggacagagagcagcaacag

SEQ ID NO: 11716 - DNA, 20 bp, Artificial Sequence
  sgRNA
  C130060K24Rik_14
gagaatcctgtagagatcaa

SEQ ID NO: 11717 - DNA, 20 bp, Artificial Sequence
  sgRNA
  C130060K24Rik_15
gcagcaacatcgatatcaag

SEQ ID NO: 11718 - DNA, 20 bp, Artificial Sequence
  sgRNA
  C130060K24Rik_16
aggaaacaccttcttcagca

SEQ ID NO: 11719 - DNA, 20 bp, Artificial Sequence
  sgRNA
  C130060K24Rik_17
gagcatgccgaccagcagga

SEQ ID NO: 11720 - DNA, 20 bp, Artificial Sequence
  sgRNA
  C130060K24Rik_18
ggcgttgccgaagagcgcca

SEQ ID NO: 11721 - DNA, 20 bp, Artificial Sequence
  sgRNA
  C130060K24Rik_19
agtcgctgcacatgccacat

SEQ ID NO: 11722 - DNA, 20 bp, Artificial Sequence
  sgRNA
  C130060K24Rik_20
gctcagttcatcgcgcacta

SEQ ID NO: 11723 - DNA, 20 bp, Artificial Sequence
  sgRNA
  C3ar1_1
gcttatgtactatcagacat

SEQ ID NO: 11724 - DNA, 20 bp, Artificial Sequence
  sgRNA
  C3ar1_2
ggaggctttccaccataatg

SEQ ID NO: 11725 - DNA, 20 bp, Artificial Sequence
  sgRNA
  C3ar1_3
tggatgggataagtttgcac

SEQ ID NO: 11726 - DNA, 20 bp, Artificial Sequence
  sgRNA
  C3ar1_4
gagaccaagaatgaccatgg

SEQ ID NO: 11727 - DNA, 20 bp, Artificial Sequence
  sgRNA
  C3ar1_5
tcttcaacaggaaacccgct

SEQ ID NO: 11728 - DNA, 20 bp, Artificial Sequence
  sgRNA
  C3ar1_6
atacccctatgatttccagg

SEQ ID NO: 11729 - DNA, 20 bp, Artificial Sequence
  sgRNA
  C3ar1_7
tggactccataccatcttgt

SEQ ID NO: 11730 - DNA, 20 bp, Artificial Sequence
  sgRNA
  C3ar1_8
gcggctgtgaggacattagg

SEQ ID NO: 11731 - DNA, 20 bp, Artificial Sequence
  sgRNA
  C3ar1_9
attggtcaacataatccccc

SEQ ID NO: 11732 - DNA, 20 bp, Artificial Sequence
  sgRNA
  C3ar1_10
atagcaggactccgacaaga

SEQ ID NO: 11733 - DNA, 20 bp, Artificial Sequence
  sgRNA
  C3ar1_11
tcacagccgccgtacccagc

SEQ ID NO: 11734 - DNA, 20 bp, Artificial Sequence
  sgRNA
  C3ar1_12
gtactatcagacatcggtcc

SEQ ID NO: 11735 - DNA, 20 bp, Artificial Sequence
  sgRNA
  C3ar1_13
atgtccagttagctgagcag

SEQ ID NO: 11736 - DNA, 20 bp, Artificial Sequence
  sgRNA
  C3ar1_14
ttatacccctatgatttcca

SEQ ID NO: 11737 - DNA, 20 bp, Artificial Sequence
  sgRNA
  C3ar1_15
agtctcggaacaaaaccttt

SEQ ID NO: 11738 - DNA, 20 bp, Artificial Sequence
  sgRNA
  C3ar1_16
acatccacagatggcgaagg

SEQ ID NO: 11739 - DNA, 20 bp, Artificial Sequence
  sgRNA
  C3ar1_17
cgatgattctggcaccagat

SEQ ID NO: 11740 - DNA, 20 bp, Artificial Sequence
  sgRNA
  C3ar1_18
gtaatcccttgcctgtacag

SEQ ID NO: 11741 - DNA, 20 bp, Artificial Sequence
  sgRNA
  C3ar1_19
ggctttgtcttgggtacagt

SEQ ID NO: 11742 - DNA, 20 bp, Artificial Sequence
  sgRNA
  C3ar1_20
aggaaacccgctgggtacgg

SEQ ID NO: 11743 - DNA, 20 bp, Artificial Sequence
  sgRNA
  C5ar1_1
cgagggcaggactatacagg

SEQ ID NO: 11744 - DNA, 20 bp, Artificial Sequence
  sgRNA
  C5ar1_2
tccatccttcgtgtaccggg

SEQ ID NO: 11745 - DNA, 20 bp, Artificial Sequence
  sgRNA
  C5ar1_3
gaacaccagcaggaaacggt

SEQ ID NO: 11746 - DNA, 20 bp, Artificial Sequence
  sgRNA
  C5ar1_4
gcagtgccaagcacgagagg

SEQ ID NO: 11747 - DNA, 20 bp, Artificial Sequence
  sgRNA
  C5ar1_5
catggatcctaacatacctg

SEQ ID NO: 11748 - DNA, 20 bp, Artificial Sequence
  sgRNA
  C5ar1_6
gatcctaacatacctgcgga

SEQ ID NO: 11749 - DNA, 20 bp, Artificial Sequence
  sgRNA
  C5ar1_7
gctgccctatcaggtgaccg

SEQ ID NO: 11750 - DNA, 20 bp, Artificial Sequence
  sgRNA
  C5ar1_8
atatgcctcccggtacacga

SEQ ID NO: 11751 - DNA, 20 bp, Artificial Sequence
  sgRNA
  C5ar1_9
gactttcactccgtccacga

SEQ ID NO: 11752 - DNA, 20 bp, Artificial Sequence
  sgRNA
  C5ar1_10
gctccggacctggagtcgca

SEQ ID NO: 11753 - DNA, 20 bp, Artificial Sequence
  sgRNA
  C5ar1_11
tccatgccaggccagtcccg

SEQ ID NO: 11754 - DNA, 20 bp, Artificial Sequence
  sgRNA
  C5ar1_12
cggaccttctgacaccagat

SEQ ID NO: 11755 - DNA, 20 bp, Artificial Sequence
  sgRNA
  C5ar1_13
acagcagttgatgtaggcca

SEQ ID NO: 11756 - DNA, 20 bp, Artificial Sequence
  sgRNA
  C5ar1_14
gcttgaacaccagcaggaaa

SEQ ID NO: 11757 - DNA, 20 bp, Artificial Sequence
  sgRNA
  C5ar1_15
gagaccttaggagtcgtcca

SEQ ID NO: 11758 - DNA, 20 bp, Artificial Sequence
  sgRNA
  C5ar1_16
tgacagccttcgaggccaga

SEQ ID NO: 11759 - DNA, 20 bp, Artificial Sequence
  sgRNA
  C5ar1_17
atgttgagcaggatgagcga

SEQ ID NO: 11760 - DNA, 20 bp, Artificial Sequence
  sgRNA
  C5ar1_18
tatgtggtattaactatggt

SEQ ID NO: 11761 - DNA, 20 bp, Artificial Sequence
  sgRNA
  C5ar1_19
tctggtgtcagaaggtccgc

SEQ ID NO: 11762 - DNA, 20 bp, Artificial Sequence
  sgRNA
  C5ar1_20
atctacgtcatggctggcca

SEQ ID NO: 11763 - DNA, 20 bp, Artificial Sequence
  sgRNA
  C5ar2_1
tctatgccacacacaagtcg

SEQ ID NO: 11764 - DNA, 20 bp, Artificial Sequence
  sgRNA
  C5ar2_2
gccaaagaggaatcgaacag

SEQ ID NO: 11765 - DNA, 20 bp, Artificial Sequence
  sgRNA
  C5ar2_3
tgcagatcatcgaacatttg

SEQ ID NO: 11766 - DNA, 20 bp, Artificial Sequence
  sgRNA
  C5ar2_4
agtctacgggcacgtccgga

SEQ ID NO: 11767 - DNA, 20 bp, Artificial Sequence
  sgRNA
  C5ar2_5
gcatctcagacaccatttcg

SEQ ID NO: 11768 - DNA, 20 bp, Artificial Sequence
  sgRNA
  C5ar2_6
gttgtcacggcatcctccaa

SEQ ID NO: 11769 - DNA, 20 bp, Artificial Sequence
  sgRNA
  C5ar2_7
gcgaggagcaaggagtgcgg

SEQ ID NO: 11770 - DNA, 20 bp, Artificial Sequence
  sgRNA
  C5ar2_8
ttacccgcaggacgtgataa

SEQ ID NO: 11771 - DNA, 20 bp, Artificial Sequence
  sgRNA
  C5ar2_9
gaccccttatcacgtcctgc

SEQ ID NO: 11772 - DNA, 20 bp, Artificial Sequence
  sgRNA
  C5ar2_10
agtgctcctgaagcagccta

SEQ ID NO: 11773 - DNA, 20 bp, Artificial Sequence
  sgRNA
  C5ar2_11
aaagggccactggccatacg

SEQ ID NO: 11774 - DNA, 20 bp, Artificial Sequence
  sgRNA
  C5ar2_12
gctgtgcccatcgcccaaaa

SEQ ID NO: 11775 - DNA, 20 bp, Artificial Sequence
  sgRNA
  C5ar2_13
ccgctgcaatgattacccgc

SEQ ID NO: 11776 - DNA, 20 bp, Artificial Sequence
  sgRNA
  C5ar2_14
tgatctgcacccttccagga

SEQ ID NO: 11777 - DNA, 20 bp, Artificial Sequence
  sgRNA
  C5ar2_15
tacccgcaggacgtgataag

SEQ ID NO: 11778 - DNA, 20 bp, Artificial Sequence
  sgRNA
  C5ar2_16
gcgatgggcacagccaggaa

SEQ ID NO: 11779 - DNA, 20 bp, Artificial Sequence
  sgRNA
  C5ar2_17
cctgcgggtaatcattgcag

SEQ ID NO: 11780 - DNA, 20 bp, Artificial Sequence
  sgRNA
  C5ar2_18
atgccacacacaagtcgggg

SEQ ID NO: 11781 - DNA, 20 bp, Artificial Sequence
  sgRNA
  C5ar2_19
atagtcataatactcgctgg

SEQ ID NO: 11782 - DNA, 20 bp, Artificial Sequence
  sgRNA
  C5ar2_20
tatgcagccgtcttcctggt

SEQ ID NO: 11783 - DNA, 20 bp, Artificial Sequence
  sgRNA
  Cachd1_1
cctaccgttcatgagggcgt

SEQ ID NO: 11784 - DNA, 20 bp, Artificial Sequence
  sgRNA
  Cachd1_2
tcccaaccggatgattgatg

SEQ ID NO: 11785 - DNA, 20 bp, Artificial Sequence
  sgRNA
  Cachd1_3
tgggtgttgctatgtaacgg

SEQ ID NO: 11786 - DNA, 20 bp, Artificial Sequence
  sgRNA
  Cachd1_4
tgggtatcgacttcacactg

SEQ ID NO: 11787 - DNA, 20 bp, Artificial Sequence
  sgRNA
  Cachd1_5
gtgataatctggctgccgag

SEQ ID NO: 11788 - DNA, 20 bp, Artificial Sequence
  sgRNA
  Cachd1_6
gctcccatgtcatcaacata

SEQ ID NO: 11789 - DNA, 20 bp, Artificial Sequence
  sgRNA
  Cachd1_7
ccacgcctacgattcccagg

SEQ ID NO: 11790 - DNA, 20 bp, Artificial Sequence
  sgRNA
  Cachd1_8
ggtcaatcggaacaagcaag

SEQ ID NO: 11791 - DNA, 20 bp, Artificial Sequence
  sgRNA
  Cachd1_9
gcacacaagttccggtgtaa

SEQ ID NO: 11792 - DNA, 20 bp, Artificial Sequence
  sgRNA
  Cachd1_10
ccgaccctcgttgaccccaa

SEQ ID NO: 11793 - DNA, 20 bp, Artificial Sequence
  sgRNA
  Cachd1_11
ggaagaggagaccgtaaggc

SEQ ID NO: 11794 - DNA, 20 bp, Artificial Sequence
  sgRNA
  Cachd1_12
gacgatgccgacaaacgcgt

SEQ ID NO: 11795 - DNA, 20 bp, Artificial Sequence
  sgRNA
  Cachd1_13
ttcatgcagtagccaatcca

SEQ ID NO: 11796 - DNA, 20 bp, Artificial Sequence
  sgRNA
  Cachd1_14
ggagaagtcggcgtcggcca

SEQ ID NO: 11797 - DNA, 20 bp, Artificial Sequence
  sgRNA
  Cachd1_15
gtaatgctccaccatgcgtt

SEQ ID NO: 11798 - DNA, 20 bp, Artificial Sequence
  sgRNA
  Cachd1_16
gatttgacgaaccttgtgca

SEQ ID NO: 11799 - DNA, 20 bp, Artificial Sequence
  sgRNA
  Cachd1_17
tctacactaaccttcccaac

SEQ ID NO: 11800 - DNA, 20 bp, Artificial Sequence
  sgRNA
  Cachd1_18
cattgggtgttgctatgtaa

SEQ ID NO: 11801 - DNA, 20 bp, Artificial Sequence
  sgRNA
  Cachd1_19
gattgaccacatccaggtag

SEQ ID NO: 11802 - DNA, 20 bp, Artificial Sequence
  sgRNA
  Cachd1_20
cgttacatagcaacacccaa

SEQ ID NO: 11803 - DNA, 20 bp, Artificial Sequence
  sgRNA
  Cacna1c_1
ccagtaaattccaaccattg

SEQ ID NO: 11804 - DNA, 20 bp, Artificial Sequence
  sgRNA
  Cacna1c_2
aatcagggtggataagacgt

SEQ ID NO: 11805 - DNA, 20 bp, Artificial Sequence
  sgRNA
  Cacna1c_3
gacatcgagggagaaaactg

SEQ ID NO: 11806 - DNA, 20 bp, Artificial Sequence
  sgRNA
  Cacna1c_4
ccagtacaaagtgtggtacg

SEQ ID NO: 11807 - DNA, 20 bp, Artificial Sequence
  sgRNA
  Cacna1c_5
cgttggacttaactgctgca

SEQ ID NO: 11808 - DNA, 20 bp, Artificial Sequence
  sgRNA
  Cacna1c_6
tacggcccatccctacccta

SEQ ID NO: 11809 - DNA, 20 bp, Artificial Sequence
  sgRNA
  Cacna1c_7
tgttgatatagcaatcaccg

SEQ ID NO: 11810 - DNA, 20 bp, Artificial Sequence
  sgRNA
  Cacna1c_8
cctgaagaaccctatccgga

SEQ ID NO: 11811 - DNA, 20 bp, Artificial Sequence
  sgRNA
  Cacna1c_9
ttggggatgtaccttcgcaa

SEQ ID NO: 11812 - DNA, 20 bp, Artificial Sequence
  sgRNA
  Cacna1c_10
gtaaattccaaccattgcgg

SEQ ID NO: 11813 - DNA, 20 bp, Artificial Sequence
  sgRNA
  Cacna1c_11
aggcagccatcgatgccgcc

SEQ ID NO: 11814 - DNA, 20 bp, Artificial Sequence
  sgRNA
  Cacna1c_12
gggttcggatgccttccccg

SEQ ID NO: 11815 - DNA, 20 bp, Artificial Sequence
  sgRNA
  Cacna1c_13
cctgtcactccaggcagccg

SEQ ID NO: 11816 - DNA, 20 bp, Artificial Sequence
  sgRNA
  Cacna1c_14
aggggggcacaaccgccaca

SEQ ID NO: 11817 - DNA, 20 bp, Artificial Sequence
  sgRNA
  Cacna1c_15
ggtgaagctgctgagccgcg

SEQ ID NO: 11818 - DNA, 20 bp, Artificial Sequence
  sgRNA
  Cacna1c_16
tcgtgtcattgacaatacgg

SEQ ID NO: 11819 - DNA, 20 bp, Artificial Sequence
  sgRNA
  Cacna1c_17
gattccacctgcgccagtag

SEQ ID NO: 11820 - DNA, 20 bp, Artificial Sequence
  sgRNA
  Cacna1c_18
tcaaggcccgacccttgcga

SEQ ID NO: 11821 - DNA, 20 bp, Artificial Sequence
  sgRNA
  Cacna1c_19
ggatagttctaaacagacgg

SEQ ID NO: 11822 - DNA, 20 bp, Artificial Sequence
  sgRNA
  Cacna1c_20
ctaccgtcagttccacacag

SEQ ID NO: 11823 - DNA, 20 bp, Artificial Sequence
  sgRNA
  Cacna1g_1
cagaccaggaatctcgctct

SEQ ID NO: 11824 - DNA, 20 bp, Artificial Sequence
  sgRNA
  Cacna1g_2
ggcaacggactggctccaag

SEQ ID NO: 11825 - DNA, 20 bp, Artificial Sequence
  sgRNA
  Cacna1g_3
ggcaaacgggaagatacgag

SEQ ID NO: 11826 - DNA, 20 bp, Artificial Sequence
  sgRNA
  Cacna1g_4
ggattcttaatgtagccgaa

SEQ ID NO: 11827 - DNA, 20 bp, Artificial Sequence
  sgRNA
  Cacna1g_5
gatcgcatgccgttctcccg

SEQ ID NO: 11828 - DNA, 20 bp, Artificial Sequence
  sgRNA
  Cacna1g_6
gttgcaagttcgcatctgaa

SEQ ID NO: 11829 - DNA, 20 bp, Artificial Sequence
  sgRNA
  Cacna1g_7
gcggagctggtgtctccgca

SEQ ID NO: 11830 - DNA, 20 bp, Artificial Sequence
  sgRNA
  Cacna1g_8
ggtcctggctagacgaacag

SEQ ID NO: 11831 - DNA, 20 bp, Artificial Sequence
  sgRNA
  Cacna1g_9
gcctcatagtccagaccgca

SEQ ID NO: 11832 - DNA, 20 bp, Artificial Sequence
  sgRNA
  Cacna1g_10
gtgcggagacaccagctccg

SEQ ID NO: 11833 - DNA, 20 bp, Artificial Sequence
  sgRNA
  Cacna1g_11
gggatccccacagacggcga

SEQ ID NO: 11834 - DNA, 20 bp, Artificial Sequence
  sgRNA
  Cacna1g_12
ccttcactgtcatttcagcc

SEQ ID NO: 11835 - DNA, 20 bp, Artificial Sequence
  sgRNA
  Cacna1g_13
gccggcccaagccctcacaa

SEQ ID NO: 11836 - DNA, 20 bp, Artificial Sequence
  sgRNA
  Cacna1g_14
ctaccatgctgactgccact

SEQ ID NO: 11837 - DNA, 20 bp, Artificial Sequence
  sgRNA
  Cacna1g_15
tttggggcgctccatagcga

SEQ ID NO: 11838 - DNA, 20 bp, Artificial Sequence
  sgRNA
  Cacna1g_16
gggtcgacggaaaaggaccc

SEQ ID NO: 11839 - DNA, 20 bp, Artificial Sequence
  sgRNA
  Cacna1g_17
atgaccacaatgttgccaat

SEQ ID NO: 11840 - DNA, 20 bp, Artificial Sequence
  sgRNA
  Cacna1g_18
gatgagacacacccttgtga

SEQ ID NO: 11841 - DNA, 20 bp, Artificial Sequence
  sgRNA
  Cacna1g_19
gtattggttccagttgacac

SEQ ID NO: 11842 - DNA, 20 bp, Artificial Sequence
  sgRNA
  Cacna1g_20
gctggctgttcgatgaagcc

SEQ ID NO: 11843 - DNA, 20 bp, Artificial Sequence
  sgRNA
  Cacna1i_1
actgggtcgctatgacaacg

SEQ ID NO: 11844 - DNA, 20 bp, Artificial Sequence
  sgRNA
  Cacna1i_2
caccaaccgatcagactgtg

SEQ ID NO: 11845 - DNA, 20 bp, Artificial Sequence
  sgRNA
  Cacna1i_3
caagggacagtgtccgacgg

SEQ ID NO: 11846 - DNA, 20 bp, Artificial Sequence
  sgRNA
  Cacna1i_4
taatcgctcctactcagacg

SEQ ID NO: 11847 - DNA, 20 bp, Artificial Sequence
  sgRNA
  Cacna1i_5
tgactggtgcgaagtccgcg

SEQ ID NO: 11848 - DNA, 20 bp, Artificial Sequence
  sgRNA
  Cacna1i_6
agatgtagttagacaccgtg

SEQ ID NO: 11849 - DNA, 20 bp, Artificial Sequence
  sgRNA
  Cacna1i_7
attgcagtcctcgtgcccag

SEQ ID NO: 11850 - DNA, 20 bp, Artificial Sequence
  sgRNA
  Cacna1i_8
gtttgagccaggactggacg

SEQ ID NO: 11851 - DNA, 20 bp, Artificial Sequence
  sgRNA
  Cacna1i_9
ggtagaccgaccagtcctcg

SEQ ID NO: 11852 - DNA, 20 bp, Artificial Sequence
  sgRNA
  Cacna1i_10
tggcggccacacagtctgat

SEQ ID NO: 11853 - DNA, 20 bp, Artificial Sequence
  sgRNA
  Cacna1i_11
ggatgcccaccagttcaccg

SEQ ID NO: 11854 - DNA, 20 bp, Artificial Sequence
  sgRNA
  Cacna1i_12
ccaatacccatgacacccaa

SEQ ID NO: 11855 - DNA, 20 bp, Artificial Sequence
  sgRNA
  Cacna1i_13
agtggggtccatgatgcgcg

SEQ ID NO: 11856 - DNA, 20 bp, Artificial Sequence
  sgRNA
  Cacna1i_14
tcttgatgcaccagttccgt

SEQ ID NO: 11857 - DNA, 20 bp, Artificial Sequence
  sgRNA
  Cacna1i_15
gcggaaccgctgcttcctgg

SEQ ID NO: 11858 - DNA, 20 bp, Artificial Sequence
  sgRNA
  Cacna1i_16
gcatccgttgactccccggg

SEQ ID NO: 11859 - DNA, 20 bp, Artificial Sequence
  sgRNA
  Cacna1i_17
tgacacttgtcacagccggc

SEQ ID NO: 11860 - DNA, 20 bp, Artificial Sequence
  sgRNA
  Cacna1i_18
agtcgtggtaagtgcagcca

SEQ ID NO: 11861 - DNA, 20 bp, Artificial Sequence
  sgRNA
  Cacna1i_19
cttcatcatctgcctcaacg

SEQ ID NO: 11862 - DNA, 20 bp, Artificial Sequence
  sgRNA
  Cacna1i_20
tgcgtgttctgcgtattgcc

SEQ ID NO: 11863 - DNA, 20 bp, Artificial Sequence
  sgRNA
  Cacng1_1
gttgtgcacggcaacccgag

SEQ ID NO: 11864 - DNA, 20 bp, Artificial Sequence
  sgRNA
  Cacng1_2
gcaccacaatgaaacgtgcg

SEQ ID NO: 11865 - DNA, 20 bp, Artificial Sequence
  sgRNA
  Cacng1_3
gagcacgtcacaccatcagg

SEQ ID NO: 11866 - DNA, 20 bp, Artificial Sequence
  sgRNA
  Cacng1_4
gtggactcagcacggcccag

SEQ ID NO: 11867 - DNA, 20 bp, Artificial Sequence
  sgRNA
  Cacng1_5
gtaatcacgcttattcccga

SEQ ID NO: 11868 - DNA, 20 bp, Artificial Sequence
  sgRNA
  Cacng1_6
gaggaagagcaagatgaacg

SEQ ID NO: 11869 - DNA, 20 bp, Artificial Sequence
  sgRNA
  Cacng1_7
gcgtccatgcaggattccca

SEQ ID NO: 11870 - DNA, 20 bp, Artificial Sequence
  sgRNA
  Cacng1_8
tgagcacgtcacaccatcag

SEQ ID NO: 11871 - DNA, 20 bp, Artificial Sequence
  sgRNA
  Cacng1_9
aacccacaatgatgaagccg

SEQ ID NO: 11872 - DNA, 20 bp, Artificial Sequence
  sgRNA
  Cacng1_10
gctctgcctcatcgtctccg

SEQ ID NO: 11873 - DNA, 20 bp, Artificial Sequence
  sgRNA
  Cacng1_11
gaagcgtatgattgacagcg

SEQ ID NO: 11874 - DNA, 20 bp, Artificial Sequence
  sgRNA
  Cacng1_12
ggtgctcgccatggtggccg

SEQ ID NO: 11875 - DNA, 20 bp, Artificial Sequence
  sgRNA
  Cacng1_13
actcttgtctttgttgtgca

SEQ ID NO: 11876 - DNA, 20 bp, Artificial Sequence
  sgRNA
  Cacng1_14
tctggaggatctgcaccgct

SEQ ID NO: 11877 - DNA, 20 bp, Artificial Sequence
  sgRNA
  Cacng1_15
gcccaccaggatgaagaaga

SEQ ID NO: 11878 - DNA, 20 bp, Artificial Sequence
  sgRNA
  Cacng1_16
gccgaggctgaagatggcaa

SEQ ID NO: 11879 - DNA, 20 bp, Artificial Sequence
  sgRNA
  Cacng1_17
ggatagagcactactattcg

SEQ ID NO: 11880 - DNA, 20 bp, Artificial Sequence
  sgRNA
  Cacng1_18
ggcccagtggtcagtcacca

SEQ ID NO: 11881 - DNA, 20 bp, Artificial Sequence
  sgRNA
  Cacng1_19
tcatcttgctcttcctcggt

SEQ ID NO: 11882 - DNA, 20 bp, Artificial Sequence
  sgRNA
  Cacng1_20
cgtccatgcaggattcccag

SEQ ID NO: 11883 - DNA, 20 bp, Artificial Sequence
  sgRNA
  Cacng2_1
gcggtcgataaacatgtgca

SEQ ID NO: 11884 - DNA, 20 bp, Artificial Sequence
  sgRNA
  Cacng2_2
caggatcgggaagatactcg

SEQ ID NO: 11885 - DNA, 20 bp, Artificial Sequence
  sgRNA
  Cacng2_3
tctggagtacagccaatagt

SEQ ID NO: 11886 - DNA, 20 bp, Artificial Sequence
  sgRNA
  Cacng2_4
catgggtggcctctgcatcg

SEQ ID NO: 11887 - DNA, 20 bp, Artificial Sequence
  sgRNA
  Cacng2_5
catcatcgccgagatggtcg

SEQ ID NO: 11888 - DNA, 20 bp, Artificial Sequence
  sgRNA
  Cacng2_6
actcgctcgccgcgatgcag

SEQ ID NO: 11889 - DNA, 20 bp, Artificial Sequence
  sgRNA
  Cacng2_7
cgaccactttccggaagacg

SEQ ID NO: 11890 - DNA, 20 bp, Artificial Sequence
  sgRNA
  Cacng2_8
tcgaccgccacaaacagctg

SEQ ID NO: 11891 - DNA, 20 bp, Artificial Sequence
  sgRNA
  Cacng2_9
acgccaacacagccaaccgc

SEQ ID NO: 11892 - DNA, 20 bp, Artificial Sequence
  sgRNA
  Cacng2_10
cggctggtccttctacttcg

SEQ ID NO: 11893 - DNA, 20 bp, Artificial Sequence
  sgRNA
  Cacng2_11
ggtccacaactgtatccaga

SEQ ID NO: 11894 - DNA, 20 bp, Artificial Sequence
  sgRNA
  Cacng2_12
actattggctgtactccaga

SEQ ID NO: 11895 - DNA, 20 bp, Artificial Sequence
  sgRNA
  Cacng2_13
cctgtccgagttgtaggtgg

SEQ ID NO: 11896 - DNA, 20 bp, Artificial Sequence
  sgRNA
  Cacng2_14
ggttctccataatccggaat

SEQ ID NO: 11897 - DNA, 20 bp, Artificial Sequence
  sgRNA
  Cacng2_15
ttcatcatcgccgagatggt

SEQ ID NO: 11898 - DNA, 20 bp, Artificial Sequence
  sgRNA
  Cacng2_16
tctccatgtacaccctcagt

SEQ ID NO: 11899 - DNA, 20 bp, Artificial Sequence
  sgRNA
  Cacng2_17
cctggaggtagtcggtggcg

SEQ ID NO: 11900 - DNA, 20 bp, Artificial Sequence
  sgRNA
  Cacng2_18
tggcccgcagctgtttgtgg

SEQ ID NO: 11901 - DNA, 20 bp, Artificial Sequence
  sgRNA
  Cacng2_19
agtccgcgtcttccggaaag

SEQ ID NO: 11902 - DNA, 20 bp, Artificial Sequence
  sgRNA
  Cacng2_20
gcccaccgccacctacaact

SEQ ID NO: 11903 - DNA, 20 bp, Artificial Sequence
  sgRNA
  Cacng3_1
cattaaactaaaagctgcga

SEQ ID NO: 11904 - DNA, 20 bp, Artificial Sequence
  sgRNA
  Cacng3_2
aagaagtaatgacccactcc

SEQ ID NO: 11905 - DNA, 20 bp, Artificial Sequence
  sgRNA
  Cacng3_3
aaaataaaaggaccagccgt

SEQ ID NO: 11906 - DNA, 20 bp, Artificial Sequence
  sgRNA
  Cacng3_4
gactactggctatattccag

SEQ ID NO: 11907 - DNA, 20 bp, Artificial Sequence
  sgRNA
  Cacng3_5
acaggtatagattccgaaga

SEQ ID NO: 11908 - DNA, 20 bp, Artificial Sequence
  sgRNA
  Cacng3_6
ggacccctctaagcttacca

SEQ ID NO: 11909 - DNA, 20 bp, Artificial Sequence
  sgRNA
  Cacng3_7
gtagtccgtgcccactgcaa

SEQ ID NO: 11910 - DNA, 20 bp, Artificial Sequence
  sgRNA
  Cacng3_8
caagtgacaatgaaaccagc

SEQ ID NO: 11911 - DNA, 20 bp, Artificial Sequence
  sgRNA
  Cacng3_9
ggcgtggtacgtctgttggc

SEQ ID NO: 11912 - DNA, 20 bp, Artificial Sequence
  sgRNA
  Cacng3_10
gtgtggaagcctttgctgat

SEQ ID NO: 11913 - DNA, 20 bp, Artificial Sequence
  sgRNA
  Cacng3_11
gcagcaggtcctccacaacc

SEQ ID NO: 11914 - DNA, 20 bp, Artificial Sequence
  sgRNA
  Cacng3_12
gacccctctaagcttaccat

SEQ ID NO: 11915 - DNA, 20 bp, Artificial Sequence
  sgRNA
  Cacng3_13
tcttcggaatctatacctgt

SEQ ID NO: 11916 - DNA, 20 bp, Artificial Sequence
  sgRNA
  Cacng3_14
agccttctctttcatcatcg

SEQ ID NO: 11917 - DNA, 20 bp, Artificial Sequence
  sgRNA
  Cacng3_15
tgtggaactgtagaaaagca

SEQ ID NO: 11918 - DNA, 20 bp, Artificial Sequence
  sgRNA
  Cacng3_16
ggacccttctcaactctgac

SEQ ID NO: 11919 - DNA, 20 bp, Artificial Sequence
  sgRNA
  Cacng3_17
ggtgaacatggagatgtcgg

SEQ ID NO: 11920 - DNA, 20 bp, Artificial Sequence
  sgRNA
  Cacng3_18
cggaatctatacctgtaggg

SEQ ID NO: 11921 - DNA, 20 bp, Artificial Sequence
  sgRNA
  Cacng3_19
aaaacagcagagtgacgctg

SEQ ID NO: 11922 - DNA, 20 bp, Artificial Sequence
  sgRNA
  Cacng3_20
ttcatcatcgcggaaattgt

SEQ ID NO: 11923 - DNA, 20 bp, Artificial Sequence
  sgRNA
  Cacng4_1
tgataccgatgatattactg

SEQ ID NO: 11924 - DNA, 20 bp, Artificial Sequence
  sgRNA
  Cacng4_2
ctccgccacaataaacgaca

SEQ ID NO: 11925 - DNA, 20 bp, Artificial Sequence
  sgRNA
  Cacng4_3
ggaggtactcggagctgtcg

SEQ ID NO: 11926 - DNA, 20 bp, Artificial Sequence
  sgRNA
  Cacng4_4
ttcctccaggcatctataga

SEQ ID NO: 11927 - DNA, 20 bp, Artificial Sequence
  sgRNA
  Cacng4_5
gctacaggtaccggcgacgg

SEQ ID NO: 11928 - DNA, 20 bp, Artificial Sequence
  sgRNA
  Cacng4_6
agttgaggtttaagaccaag

SEQ ID NO: 11929 - DNA, 20 bp, Artificial Sequence
  sgRNA
  Cacng4_7
gcagctgtggtcaccttaag

SEQ ID NO: 11930 - DNA, 20 bp, Artificial Sequence
  sgRNA
  Cacng4_8
atgtcagcatgctgaaccgg

SEQ ID NO: 11931 - DNA, 20 bp, Artificial Sequence
  sgRNA
  Cacng4_9
tctccgccacaataaacgac

SEQ ID NO: 11932 - DNA, 20 bp, Artificial Sequence
  sgRNA
  Cacng4_10
gatggccatgagcgagaagg

SEQ ID NO: 11933 - DNA, 20 bp, Artificial Sequence
  sgRNA
  Cacng4_11
ccggatcaaccacttcccag

SEQ ID NO: 11934 - DNA, 20 bp, Artificial Sequence
  sgRNA
  Cacng4_12
agccctgtcgtttattgtgg

SEQ ID NO: 11935 - DNA, 20 bp, Artificial Sequence
  sgRNA
  Cacng4_13
gtttacagccaggacgccca

SEQ ID NO: 11936 - DNA, 20 bp, Artificial Sequence
  sgRNA
  Cacng4_14
gaacaatattgtcctcagcg

SEQ ID NO: 11937 - DNA, 20 bp, Artificial Sequence
  sgRNA
  Cacng4_15
gatgcatgacttcttccaac

SEQ ID NO: 11938 - DNA, 20 bp, Artificial Sequence
  sgRNA
  Cacng4_16
tccagggatgcatctcccgt

SEQ ID NO: 11939 - DNA, 20 bp, Artificial Sequence
  sgRNA
  Cacng4_17
gtttattgtggcggagaccg

SEQ ID NO: 11940 - DNA, 20 bp, Artificial Sequence
  sgRNA
  Cacng4_18
gtacatggacagctcaccca

SEQ ID NO: 11941 - DNA, 20 bp, Artificial Sequence
  sgRNA
  Cacng4_19
tttattgtggcggagaccgt

SEQ ID NO: 11942 - DNA, 20 bp, Artificial Sequence
  sgRNA
  Cacng4_20
ggccttaaggaactcccgct

SEQ ID NO: 11943 - DNA, 20 bp, Artificial Sequence
  sgRNA
  Cacng5_1
aaggccagtatggtccggtg

SEQ ID NO: 11944 - DNA, 20 bp, Artificial Sequence
  sgRNA
  Cacng5_2
cttacttagaacattgacag

SEQ ID NO: 11945 - DNA, 20 bp, Artificial Sequence
  sgRNA
  Cacng5_3
cgagatgctcaacagaacca

SEQ ID NO: 11946 - DNA, 20 bp, Artificial Sequence
  sgRNA
  Cacng5_4
gctgggtatcgcggtcagca

SEQ ID NO: 11947 - DNA, 20 bp, Artificial Sequence
  sgRNA
  Cacng5_5
gcgtcgctggagatgtccga

SEQ ID NO: 11948 - DNA, 20 bp, Artificial Sequence
  sgRNA
  Cacng5_6
cgtcgctggagatgtccgag

SEQ ID NO: 11949 - DNA, 20 bp, Artificial Sequence
  sgRNA
  Cacng5_7
atgaagaagaggctgacgag

SEQ ID NO: 11950 - DNA, 20 bp, Artificial Sequence
  sgRNA
  Cacng5_8
gacatgtacagacctcaccc

SEQ ID NO: 11951 - DNA, 20 bp, Artificial Sequence
  sgRNA
  Cacng5_9
gggtttatcctgagcaacat

SEQ ID NO: 11952 - DNA, 20 bp, Artificial Sequence
  sgRNA
  Cacng5_10
catgaagaagaggctgacga

SEQ ID NO: 11953 - DNA, 20 bp, Artificial Sequence
  sgRNA
  Cacng5_11
ggtttatcctgagcaacatc

SEQ ID NO: 11954 - DNA, 20 bp, Artificial Sequence
  sgRNA
  Cacng5_12
tcggagcagttgctcagacg

SEQ ID NO: 11955 - DNA, 20 bp, Artificial Sequence
  sgRNA
  Cacng5_13
tcgggcacatccgtccgcac

SEQ ID NO: 11956 - DNA, 20 bp, Artificial Sequence
  sgRNA
  Cacng5_14
gacgtggccggtagaagcct

SEQ ID NO: 11957 - DNA, 20 bp, Artificial Sequence
  sgRNA
  Cacng5_15
ggcgtcgctggagatgtccg

SEQ ID NO: 11958 - DNA, 20 bp, Artificial Sequence
  sgRNA
  Cacng5_16
ccagtatggtccggtgcgga

SEQ ID NO: 11959 - DNA, 20 bp, Artificial Sequence
  sgRNA
  Cacng5_17
ggaggattatgccttcttcc

SEQ ID NO: 11960 - DNA, 20 bp, Artificial Sequence
  sgRNA
  Cacng5_18
ccaggcccaccacaagagag

SEQ ID NO: 11961 - DNA, 20 bp, Artificial Sequence
  sgRNA
  Cacng5_19
gacgtcatctgggagttcat

SEQ ID NO: 11962 - DNA, 20 bp, Artificial Sequence
  sgRNA
  Cacng5_20
cacggactactggctctacc

SEQ ID NO: 11963 - DNA, 20 bp, Artificial Sequence
  sgRNA
  Cacng6_1
acttcaaattcttcaccacg

SEQ ID NO: 11964 - DNA, 20 bp, Artificial Sequence
  sgRNA
  Cacng6_2
ggcttgactccggagcgaga

SEQ ID NO: 11965 - DNA, 20 bp, Artificial Sequence
  sgRNA
  Cacng6_3
aggtgtgcatcaagcgactg

SEQ ID NO: 11966 - DNA, 20 bp, Artificial Sequence
  sgRNA
  Cacng6_4
gctgttcttgggcacgacgc

SEQ ID NO: 11967 - DNA, 20 bp, Artificial Sequence
  sgRNA
  Cacng6_5
gcagggctcctacggaatgc

SEQ ID NO: 11968 - DNA, 20 bp, Artificial Sequence
  sgRNA
  Cacng6_6
gcagaatctcggcttgactc

SEQ ID NO: 11969 - DNA, 20 bp, Artificial Sequence
  sgRNA
  Cacng6_7
cttccacagccccaaatggg

SEQ ID NO: 11970 - DNA, 20 bp, Artificial Sequence
  sgRNA
  Cacng6_8
gaggtgttccggcattccgt

SEQ ID NO: 11971 - DNA, 20 bp, Artificial Sequence
  sgRNA
  Cacng6_9
caaagcagacagctcccaat

SEQ ID NO: 11972 - DNA, 20 bp, Artificial Sequence
  sgRNA
  Cacng6_10
gggttgctggtggcaatcgt

SEQ ID NO: 11973 - DNA, 20 bp, Artificial Sequence
  sgRNA
  Cacng6_11
gctggtctaatcctgctgct

SEQ ID NO: 11974 - DNA, 20 bp, Artificial Sequence
  sgRNA
  Cacng6_12
tgcagagtccctgctccgat

SEQ ID NO: 11975 - DNA, 20 bp, Artificial Sequence
  sgRNA
  Cacng6_13
ggtctaatcctgctgctggg

SEQ ID NO: 11976 - DNA, 20 bp, Artificial Sequence
  sgRNA
  Cacng6_14
caaatgggcggcctcacaga

SEQ ID NO: 11977 - DNA, 20 bp, Artificial Sequence
  sgRNA
  Cacng6_15
taaggaccaggaatactcat

SEQ ID NO: 11978 - DNA, 20 bp, Artificial Sequence
  sgRNA
  Cacng6_16
cgtggtgaagaatttgaagt

SEQ ID NO: 11979 - DNA, 20 bp, Artificial Sequence
  sgRNA
  Cacng6_17
tgagcaccatgatgacacag

SEQ ID NO: 11980 - DNA, 20 bp, Artificial Sequence
  sgRNA
  Cacng6_18
attgagttccacccagaact

SEQ ID NO: 11981 - DNA, 20 bp, Artificial Sequence
  sgRNA
  Cacng6_19
ttgatcttgccctctcgctc

SEQ ID NO: 11982 - DNA, 20 bp, Artificial Sequence
  sgRNA
  Cacng6_20
ctacttcaaattcttcacca

SEQ ID NO: 11983 - DNA, 20 bp, Artificial Sequence
  sgRNA
  Cacng7_1
gccgcagaaccagaccaccg

SEQ ID NO: 11984 - DNA, 20 bp, Artificial Sequence
  sgRNA
  Cacng7_2
actttcactatcgctacggg

SEQ ID NO: 11985 - DNA, 20 bp, Artificial Sequence
  sgRNA
  Cacng7_3
tcggccacatccgacctcag

SEQ ID NO: 11986 - DNA, 20 bp, Artificial Sequence
  sgRNA
  Cacng7_4
catctccagcatcaacgacg

SEQ ID NO: 11987 - DNA, 20 bp, Artificial Sequence
  sgRNA
  Cacng7_5
gttcaccaagcgctacgcgg

SEQ ID NO: 11988 - DNA, 20 bp, Artificial Sequence
  sgRNA
  Cacng7_6
gatgacgcaaaattaccccc

SEQ ID NO: 11989 - DNA, 20 bp, Artificial Sequence
  sgRNA
  Cacng7_7
acgtcgctagagatgtcgga

SEQ ID NO: 11990 - DNA, 20 bp, Artificial Sequence
  sgRNA
  Cacng7_8
tcggagcagtcgctgagacg

SEQ ID NO: 11991 - DNA, 20 bp, Artificial Sequence
  sgRNA
  Cacng7_9
agcagtcgctgagacgcggt

SEQ ID NO: 11992 - DNA, 20 bp, Artificial Sequence
  sgRNA
  Cacng7_10
gtccgggtacttgatggccg

SEQ ID NO: 11993 - DNA, 20 bp, Artificial Sequence
  sgRNA
  Cacng7_11
aagagactgaccatagggaa

SEQ ID NO: 11994 - DNA, 20 bp, Artificial Sequence
  sgRNA
  Cacng7_12
tcttgaaccagagatcaact

SEQ ID NO: 11995 - DNA, 20 bp, Artificial Sequence
  sgRNA
  Cacng7_13
ggtctggttctgcggcaaaa

SEQ ID NO: 11996 - DNA, 20 bp, Artificial Sequence
  sgRNA
  Cacng7_14
cgtcgctagagatgtcggaa

SEQ ID NO: 11997 - DNA, 20 bp, Artificial Sequence
  sgRNA
  Cacng7_15
gatgttgctgatgacaaagg

SEQ ID NO: 11998 - DNA, 20 bp, Artificial Sequence
  sgRNA
  Cacng7_16
ctactggctgtacatggagg

SEQ ID NO: 11999 - DNA, 20 bp, Artificial Sequence
  sgRNA
  Cacng7_17
gcgcttggtgaacaagtaca

SEQ ID NO: 12000 - DNA, 20 bp, Artificial Sequence
  sgRNA
  Cacng7_18
gagatggtccgggtacttga

SEQ ID NO: 12001 - DNA, 20 bp, Artificial Sequence
  sgRNA
  Cacng7_19
gtgcagcgccatcttgacct

SEQ ID NO: 12002 - DNA, 20 bp, Artificial Sequence
  sgRNA
  Cacng7_20
agagatgtatcgcccgcacc

SEQ ID NO: 12003 - DNA, 20 bp, Artificial Sequence
  sgRNA
  Cacng8_1
gatgacggaccaccccatcg

SEQ ID NO: 12004 - DNA, 20 bp, Artificial Sequence
  sgRNA
  Cacng8_2
gtgtacatatcggccaacgc

SEQ ID NO: 12005 - DNA, 20 bp, Artificial Sequence
  sgRNA
  Cacng8_3
agccgcgaaggcgccgatgg

SEQ ID NO: 12006 - DNA, 20 bp, Artificial Sequence
  sgRNA
  Cacng8_4
ggactacgaccacgacagcg

SEQ ID NO: 12007 - DNA, 20 bp, Artificial Sequence
  sgRNA
  Cacng8_5
gtactccgatcacctcagcc

SEQ ID NO: 12008 - DNA, 20 bp, Artificial Sequence
  sgRNA
  Cacng8_6
cgtgttggtgttggacgccg

SEQ ID NO: 12009 - DNA, 20 bp, Artificial Sequence
  sgRNA
  Cacng8_7
ctcagccgcgacccgtccaa

SEQ ID NO: 12010 - DNA, 20 bp, Artificial Sequence
  sgRNA
  Cacng8_8
ctacatcgagcgcagccgcg

SEQ ID NO: 12011 - DNA, 20 bp, Artificial Sequence
  sgRNA
  Cacng8_9
gctgcacaacgccttcccca

SEQ ID NO: 12012 - DNA, 20 bp, Artificial Sequence
  sgRNA
  Cacng8_10
gcagacggaggatggccgag

SEQ ID NO: 12013 - DNA, 20 bp, Artificial Sequence
  sgRNA
  Cacng8_11
gaaaacccgccgagctcccg

SEQ ID NO: 12014 - DNA, 20 bp, Artificial Sequence
  sgRNA
  Cacng8_12
cgacccgtccaagggcagcg

SEQ ID NO: 12015 - DNA, 20 bp, Artificial Sequence
  sgRNA
  Cacng8_13
tttggacttgtagacgcggg

SEQ ID NO: 12016 - DNA, 20 bp, Artificial Sequence
  sgRNA
  Cacng8_14
cccgcgtctacaagtccaaa

SEQ ID NO: 12017 - DNA, 20 bp, Artificial Sequence
  sgRNA
  Cacng8_15
ggcacactgccaatcacgct

SEQ ID NO: 12018 - DNA, 20 bp, Artificial Sequence
  sgRNA
  Cacng8_16
gggcagacggaggatggccg

SEQ ID NO: 12019 - DNA, 20 bp, Artificial Sequence
  sgRNA
  Cacng8_17
gcgctcgatgtagatgttga

SEQ ID NO: 12020 - DNA, 20 bp, Artificial Sequence
  sgRNA
  Cacng8_18
gacggaccaccccatcgtgg

SEQ ID NO: 12021 - DNA, 20 bp, Artificial Sequence
  sgRNA
  Cacng8_19
gaccctgtccaaagaggccg

SEQ ID NO: 12022 - DNA, 20 bp, Artificial Sequence
  sgRNA
  Cacng8_20
ggtgactgtgaccgtgacgc

SEQ ID NO: 12023 - DNA, 20 bp, Artificial Sequence
  sgRNA
  Cadm1_1
atatcgatcatcaagttacg

SEQ ID NO: 12024 - DNA, 20 bp, Artificial Sequence
  sgRNA
  Cadm1_2
agccagcgacgaccatcagg

SEQ ID NO: 12025 - DNA, 20 bp, Artificial Sequence
  sgRNA
  Cadm1_3
gccgcggcactgatccccac

SEQ ID NO: 12026 - DNA, 20 bp, Artificial Sequence
  sgRNA
  Cadm1_4
actgacgaatgtctcaatct

SEQ ID NO: 12027 - DNA, 20 bp, Artificial Sequence
  sgRNA
  Cadm1_5
gctgttgctcctttcggccg

SEQ ID NO: 12028 - DNA, 20 bp, Artificial Sequence
  sgRNA
  Cadm1_6
tcgatcatcaagttacgtgg

SEQ ID NO: 12029 - DNA, 20 bp, Artificial Sequence
  sgRNA
  Cadm1_7
agttaacgtgtgaagccatc

SEQ ID NO: 12030 - DNA, 20 bp, Artificial Sequence
  sgRNA
  Cadm1_8
ggatcagtgccgcggccgaa

SEQ ID NO: 12031 - DNA, 20 bp, Artificial Sequence
  sgRNA
  Cadm1_9
gccgcacactgggatccgct

SEQ ID NO: 12032 - DNA, 20 bp, Artificial Sequence
  sgRNA
  Cadm1_10
tgctggttctgtcgtcgccg

SEQ ID NO: 12033 - DNA, 20 bp, Artificial Sequence
  sgRNA
  Cadm1_11
gttccctttgaaccacctga

SEQ ID NO: 12034 - DNA, 20 bp, Artificial Sequence
  sgRNA
  Cadm1_12
gagcggatcccagtgtgcgg

SEQ ID NO: 12035 - DNA, 20 bp, Artificial Sequence
  sgRNA
  Cadm1_13
tgtgaggcttccaacatagt

SEQ ID NO: 12036 - DNA, 20 bp, Artificial Sequence
  sgRNA
  Cadm1_14
ccctctgcaaggcctaaccc

SEQ ID NO: 12037 - DNA, 20 bp, Artificial Sequence
  sgRNA
  Cadm1_15
gctataatcaatgcagaagg

SEQ ID NO: 12038 - DNA, 20 bp, Artificial Sequence
  sgRNA
  Cadm1_16
gcaggtttccagtgaccgca

SEQ ID NO: 12039 - DNA, 20 bp, Artificial Sequence
  sgRNA
  Cadm1_17
ctatgttggaagcctcacag

SEQ ID NO: 12040 - DNA, 20 bp, Artificial Sequence
  sgRNA
  Cadm1_18
acctgtggggatcagtgccg

SEQ ID NO: 12041 - DNA, 20 bp, Artificial Sequence
  sgRNA
  Cadm1_19
ctgcacttctagatagcgct

SEQ ID NO: 12042 - DNA, 20 bp, Artificial Sequence
  sgRNA
  Cadm1_20
gctcctgctgttgctccttt

SEQ ID NO: 12043 - DNA, 20 bp, Artificial Sequence
  sgRNA
  Cadm2_1
gacgaaaatccactaatctg

SEQ ID NO: 12044 - DNA, 20 bp, Artificial Sequence
  sgRNA
  Cadm2_2
ccgccactccatcatcgcta

SEQ ID NO: 12045 - DNA, 20 bp, Artificial Sequence
  sgRNA
  Cadm2_3
tccactaactcagaatgtca

SEQ ID NO: 12046 - DNA, 20 bp, Artificial Sequence
  sgRNA
  Cadm2_4
atgataacacctccctccag

SEQ ID NO: 12047 - DNA, 20 bp, Artificial Sequence
  sgRNA
  Cadm2_5
tggtgttagtggcttcacat

SEQ ID NO: 12048 - DNA, 20 bp, Artificial Sequence
  sgRNA
  Cadm2_6
catcatcgctacggtccact

SEQ ID NO: 12049 - DNA, 20 bp, Artificial Sequence
  sgRNA
  Cadm2_7
tcttgtggaaaaggagtcga

SEQ ID NO: 12050 - DNA, 20 bp, Artificial Sequence
  sgRNA
  Cadm2_8
attaccagatcctgatcgaa

SEQ ID NO: 12051 - DNA, 20 bp, Artificial Sequence
  sgRNA
  Cadm2_9
cagctgacgtgtaagacgtc

SEQ ID NO: 12052 - DNA, 20 bp, Artificial Sequence
  sgRNA
  Cadm2_10
tggatttgaccactggaggg

SEQ ID NO: 12053 - DNA, 20 bp, Artificial Sequence
  sgRNA
  Cadm2_11
gatggtataatcttaactga

SEQ ID NO: 12054 - DNA, 20 bp, Artificial Sequence
  sgRNA
  Cadm2_12
gtgaacaatgaggacatact

SEQ ID NO: 12055 - DNA, 20 bp, Artificial Sequence
  sgRNA
  Cadm2_13
caacctttccttggtaccag

SEQ ID NO: 12056 - DNA, 20 bp, Artificial Sequence
  sgRNA
  Cadm2_14
gcacctgcatggctacctga

SEQ ID NO: 12057 - DNA, 20 bp, Artificial Sequence
  sgRNA
  Cadm2_15
catcaggtctccctccatga

SEQ ID NO: 12058 - DNA, 20 bp, Artificial Sequence
  sgRNA
  Cadm2_16
agatgtgaagtacttgaaag

SEQ ID NO: 12059 - DNA, 20 bp, Artificial Sequence
  sgRNA
  Cadm2_17
tgtgaagccactaacaccat

SEQ ID NO: 12060 - DNA, 20 bp, Artificial Sequence
  sgRNA
  Cadm2_18
ctttatgtcttgccagatat

SEQ ID NO: 12061 - DNA, 20 bp, Artificial Sequence
  sgRNA
  Cadm2_19
gctggttgttatggttacag

SEQ ID NO: 12062 - DNA, 20 bp, Artificial Sequence
  sgRNA
  Cadm2_20
gctgccttcagcattgataa

SEQ ID NO: 12063 - DNA, 20 bp, Artificial Sequence
  sgRNA
  Cadm3_1
ctggttataagtcatcattg

SEQ ID NO: 12064 - DNA, 20 bp, Artificial Sequence
  sgRNA
  Cadm3_2
ctgaatccgattatctcgaa

SEQ ID NO: 12065 - DNA, 20 bp, Artificial Sequence
  sgRNA
  Cadm3_3
agctgttgttacattgtgag

SEQ ID NO: 12066 - DNA, 20 bp, Artificial Sequence
  sgRNA
  Cadm3_4
gacatctgatgaaacagttg

SEQ ID NO: 12067 - DNA, 20 bp, Artificial Sequence
  sgRNA
  Cadm3_5
tacctgacacacgaagcgaa

SEQ ID NO: 12068 - DNA, 20 bp, Artificial Sequence
  sgRNA
  Cadm3_6
gcacgtgtactccccctcat

SEQ ID NO: 12069 - DNA, 20 bp, Artificial Sequence
  sgRNA
  Cadm3_7
gctcagcagaccctatactt

SEQ ID NO: 12070 - DNA, 20 bp, Artificial Sequence
  sgRNA
  Cadm3_8
gctgaatccgattatctcga

SEQ ID NO: 12071 - DNA, 20 bp, Artificial Sequence
  sgRNA
  Cadm3_9
agaagactgacaatttagag

SEQ ID NO: 12072 - DNA, 20 bp, Artificial Sequence
  sgRNA
  Cadm3_10
gtgaaccatgaatctctgaa

SEQ ID NO: 12073 - DNA, 20 bp, Artificial Sequence
  sgRNA
  Cadm3_11
ccatcatcaacgcagaaggc

SEQ ID NO: 12074 - DNA, 20 bp, Artificial Sequence
  sgRNA
  Cadm3_12
gtcattccaggttacccggg

SEQ ID NO: 12075 - DNA, 20 bp, Artificial Sequence
  sgRNA
  Cadm3_13
tctcttctccccgaagtata

SEQ ID NO: 12076 - DNA, 20 bp, Artificial Sequence
  sgRNA
  Cadm3_14
tcagcagaccctatacttcg

SEQ ID NO: 12077 - DNA, 20 bp, Artificial Sequence
  sgRNA
  Cadm3_15
tggtaggtactggaggacga

SEQ ID NO: 12078 - DNA, 20 bp, Artificial Sequence
  sgRNA
  Cadm3_16
cctaccacgccatcattgga

SEQ ID NO: 12079 - DNA, 20 bp, Artificial Sequence
  sgRNA
  Cadm3_17
ctacctgacacacgaagcga

SEQ ID NO: 12080 - DNA, 20 bp, Artificial Sequence
  sgRNA
  Cadm3_18
cagtacgtgtgggtaaagga

SEQ ID NO: 12081 - DNA, 20 bp, Artificial Sequence
  sgRNA
  Cadm3_19
cgaatccaggaagatcccaa

SEQ ID NO: 12082 - DNA, 20 bp, Artificial Sequence
  sgRNA
  Cadm3_20
ctgtcactcttattcaaaaa

SEQ ID NO: 12083 - DNA, 20 bp, Artificial Sequence
  sgRNA
  Cadm4_1
gtggatcgcaaggacgacgg

SEQ ID NO: 12084 - DNA, 20 bp, Artificial Sequence
  sgRNA
  Cadm4_2
gagcgtggcgatctgatggt

SEQ ID NO: 12085 - DNA, 20 bp, Artificial Sequence
  sgRNA
  Cadm4_3
tcgtcattcagaacccagcc

SEQ ID NO: 12086 - DNA, 20 bp, Artificial Sequence
  sgRNA
  Cadm4_4
acagaccgagaatgtgactg

SEQ ID NO: 12087 - DNA, 20 bp, Artificial Sequence
  sgRNA
  Cadm4_5
gcgctggtatcgggatcgca

SEQ ID NO: 12088 - DNA, 20 bp, Artificial Sequence
  sgRNA
  Cadm4_6
gtctgcttgctgtgtcccga

SEQ ID NO: 12089 - DNA, 20 bp, Artificial Sequence
  sgRNA
  Cadm4_7
tcagaaacaccagtagcgcc

SEQ ID NO: 12090 - DNA, 20 bp, Artificial Sequence
  sgRNA
  Cadm4_8
ataccagcgcaggaccgctg

SEQ ID NO: 12091 - DNA, 20 bp, Artificial Sequence
  sgRNA
  Cadm4_9
tctggtgccattgaaaaaga

SEQ ID NO: 12092 - DNA, 20 bp, Artificial Sequence
  sgRNA
  Cadm4_10
cgtcgtccttgcgatccaca

SEQ ID NO: 12093 - DNA, 20 bp, Artificial Sequence
  sgRNA
  Cadm4_11
gttccttacgccattgtggg

SEQ ID NO: 12094 - DNA, 20 bp, Artificial Sequence
  sgRNA
  Cadm4_12
cgtgtggatcgcaaggacga

SEQ ID NO: 12095 - DNA, 20 bp, Artificial Sequence
  sgRNA
  Cadm4_13
acccatcgtactgatgcaga

SEQ ID NO: 12096 - DNA, 20 bp, Artificial Sequence
  sgRNA
  Cadm4_14
cgaacaagcacggccacgcg

SEQ ID NO: 12097 - DNA, 20 bp, Artificial Sequence
  sgRNA
  Cadm4_15
tctcaagctgtagtgaggga

SEQ ID NO: 12098 - DNA, 20 bp, Artificial Sequence
  sgRNA
  Cadm4_16
gcgatccacacggaaccgca

SEQ ID NO: 12099 - DNA, 20 bp, Artificial Sequence
  sgRNA
  Cadm4_17
ctggcagagactcattccca

SEQ ID NO: 12100 - DNA, 20 bp, Artificial Sequence
  sgRNA
  Cadm4_18
taacggcacctacacctgcg

SEQ ID NO: 12101 - DNA, 20 bp, Artificial Sequence
  sgRNA
  Cadm4_19
gcacgtagagcgccctcgcg

SEQ ID NO: 12102 - DNA, 20 bp, Artificial Sequence
  sgRNA
  Cadm4_20
atggcggcgatggacacaaa

SEQ ID NO: 12103 - DNA, 20 bp, Artificial Sequence
  sgRNA
  Calcr_1
gtgatggcgtggataatggt

SEQ ID NO: 12104 - DNA, 20 bp, Artificial Sequence
  sgRNA
  Calcr_2
caaagtccgggaagtagtca

SEQ ID NO: 12105 - DNA, 20 bp, Artificial Sequence
  sgRNA
  Calcr_3
cctaccaatctcactgactc

SEQ ID NO: 12106 - DNA, 20 bp, Artificial Sequence
  sgRNA
  Calcr_4
acatatgtggacaatgcagt

SEQ ID NO: 12107 - DNA, 20 bp, Artificial Sequence
  sgRNA
  Calcr_5
cccgaggagcactaactacg

SEQ ID NO: 12108 - DNA, 20 bp, Artificial Sequence
  sgRNA
  Calcr_6
acttctggatgctctgcgag

SEQ ID NO: 12109 - DNA, 20 bp, Artificial Sequence
  sgRNA
  Calcr_7
cctccaatcagcaacaacga

SEQ ID NO: 12110 - DNA, 20 bp, Artificial Sequence
  sgRNA
  Calcr_8
cgagtcctacatgtacctga

SEQ ID NO: 12111 - DNA, 20 bp, Artificial Sequence
  sgRNA
  Calcr_9
ctacttctggatgctctgcg

SEQ ID NO: 12112 - DNA, 20 bp, Artificial Sequence
  sgRNA
  Calcr_10
ttacccctgagtgcacacga

SEQ ID NO: 12113 - DNA, 20 bp, Artificial Sequence
  sgRNA
  Calcr_11
gcttgtgcaaggtcaccctc

SEQ ID NO: 12114 - DNA, 20 bp, Artificial Sequence
  sgRNA
  Calcr_12
cattgggcacaacctcaacc

SEQ ID NO: 12115 - DNA, 20 bp, Artificial Sequence
  sgRNA
  Calcr_13
cttgctggatgacgttcatg

SEQ ID NO: 12116 - DNA, 20 bp, Artificial Sequence
  sgRNA
  Calcr_14
ttgctgattggaggattccg

SEQ ID NO: 12117 - DNA, 20 bp, Artificial Sequence
  sgRNA
  Calcr_15
gatccagtggagccaacgct

SEQ ID NO: 12118 - DNA, 20 bp, Artificial Sequence
  sgRNA
  Calcr_16
cgccgcaccagatctccatt

SEQ ID NO: 12119 - DNA, 20 bp, Artificial Sequence
  sgRNA
  Calcr_17
gcgtgcttgtgaccaagatg

SEQ ID NO: 12120 - DNA, 20 bp, Artificial Sequence
  sgRNA
  Calcr_18
gtagccttcgctgagccaga

SEQ ID NO: 12121 - DNA, 20 bp, Artificial Sequence
  sgRNA
  Calcr_19
tgtgcactcaggggtaaggg

SEQ ID NO: 12122 - DNA, 20 bp, Artificial Sequence
  sgRNA
  Calcr_20
ttcccaagcaccttgttgga

SEQ ID NO: 12123 - DNA, 20 bp, Artificial Sequence
  sgRNA
  Calcrl_1
tgtaacaatcatccacctca

SEQ ID NO: 12124 - DNA, 20 bp, Artificial Sequence
  sgRNA
  Calcrl_2
atccggatagtaatagaaca

SEQ ID NO: 12125 - DNA, 20 bp, Artificial Sequence
  sgRNA
  Calcrl_3
ttacctgcacacactcatcg

SEQ ID NO: 12126 - DNA, 20 bp, Artificial Sequence
  sgRNA
  Calcrl_4
cactagaaacaagatcatga

SEQ ID NO: 12127 - DNA, 20 bp, Artificial Sequence
  sgRNA
  Calcrl_5
agttaggtagaacagattca

SEQ ID NO: 12128 - DNA, 20 bp, Artificial Sequence
  sgRNA
  Calcrl_6
catctcctctacattatcca

SEQ ID NO: 12129 - DNA, 20 bp, Artificial Sequence
  sgRNA
  Calcrl_7
cctgcacacactcatcgtgg

SEQ ID NO: 12130 - DNA, 20 bp, Artificial Sequence
  sgRNA
  Calcrl_8
gcaataggacctgggacgga

SEQ ID NO: 12131 - DNA, 20 bp, Artificial Sequence
  sgRNA
  Calcrl_9
gtttatccatctctacctga

SEQ ID NO: 12132 - DNA, 20 bp, Artificial Sequence
  sgRNA
  Calcrl_10
caacaatcagtgacatgcaa

SEQ ID NO: 12133 - DNA, 20 bp, Artificial Sequence
  sgRNA
  Calcrl_11
acaagcttctggcaatggcg

SEQ ID NO: 12134 - DNA, 20 bp, Artificial Sequence
  sgRNA
  Calcrl_12
catgcgtgctgttattacac

SEQ ID NO: 12135 - DNA, 20 bp, Artificial Sequence
  sgRNA
  Calcrl_13
ggttattggccactgccgtg

SEQ ID NO: 12136 - DNA, 20 bp, Artificial Sequence
  sgRNA
  Calcrl_14
gcaatggcgtggatgcaggc

SEQ ID NO: 12137 - DNA, 20 bp, Artificial Sequence
  sgRNA
  Calcrl_15
gttgaaagttacacaccaag

SEQ ID NO: 12138 - DNA, 20 bp, Artificial Sequence
  sgRNA
  Calcrl_16
aatcatccacctcacggcag

SEQ ID NO: 12139 - DNA, 20 bp, Artificial Sequence
  sgRNA
  Calcrl_17
caaaatcctgaaaatagtca

SEQ ID NO: 12140 - DNA, 20 bp, Artificial Sequence
  sgRNA
  Calcrl_18
atgttaccagaagatcatgc

SEQ ID NO: 12141 - DNA, 20 bp, Artificial Sequence
  sgRNA
  Calcrl_19
acactgtgtaggatgcactg

SEQ ID NO: 12142 - DNA, 20 bp, Artificial Sequence
  sgRNA
  Calcrl_20
ttccatttaagtgttcagtg

SEQ ID NO: 12143 - DNA, 20 bp, Artificial Sequence
  sgRNA
  Calhm2_1
tccatacaggtagttccggg

SEQ ID NO: 12144 - DNA, 20 bp, Artificial Sequence
  sgRNA
  Calhm2_2
caacctatcgagcttccgag

SEQ ID NO: 12145 - DNA, 20 bp, Artificial Sequence
  sgRNA
  Calhm2_3
ccccccagcccatgctacgg

SEQ ID NO: 12146 - DNA, 20 bp, Artificial Sequence
  sgRNA
  Calhm2_4
tagtcgccgagtgccagtac

SEQ ID NO: 12147 - DNA, 20 bp, Artificial Sequence
  sgRNA
  Calhm2_5
ggctcagtaccgtaccaacg

SEQ ID NO: 12148 - DNA, 20 bp, Artificial Sequence
  sgRNA
  Calhm2_6
cgccgagtgccagtaccgga

SEQ ID NO: 12149 - DNA, 20 bp, Artificial Sequence
  sgRNA
  Calhm2_7
gagggccaagaactgctccg

SEQ ID NO: 12150 - DNA, 20 bp, Artificial Sequence
  sgRNA
  Calhm2_8
ctacagccgcctacacaagt

SEQ ID NO: 12151 - DNA, 20 bp, Artificial Sequence
  sgRNA
  Calhm2_9
cctcctctcggaagctcgat

SEQ ID NO: 12152 - DNA, 20 bp, Artificial Sequence
  sgRNA
  Calhm2_10
ccagtgatagcgttccactg

SEQ ID NO: 12153 - DNA, 20 bp, Artificial Sequence
  sgRNA
  Calhm2_11
ggccatctccacattgtcag

SEQ ID NO: 12154 - DNA, 20 bp, Artificial Sequence
  sgRNA
  Calhm2_12
gtggctgtgtgccttccact

SEQ ID NO: 12155 - DNA, 20 bp, Artificial Sequence
  sgRNA
  Calhm2_13
tgactggagccacagctgca

SEQ ID NO: 12156 - DNA, 20 bp, Artificial Sequence
  sgRNA
  Calhm2_14
gagccacaaagccaaagaaa

SEQ ID NO: 12157 - DNA, 20 bp, Artificial Sequence
  sgRNA
  Calhm2_15
gctggtcgccaagttcccag

SEQ ID NO: 12158 - DNA, 20 bp, Artificial Sequence
  sgRNA
  Calhm2_16
tgtcatctccctgctccgag

SEQ ID NO: 12159 - DNA, 20 bp, Artificial Sequence
  sgRNA
  Calhm2_17
gagcccagtaggcctcctga

SEQ ID NO: 12160 - DNA, 20 bp, Artificial Sequence
  sgRNA
  Calhm2_18
ggtacggtactgagcccagt

SEQ ID NO: 12161 - DNA, 20 bp, Artificial Sequence
  sgRNA
  Calhm2_19
gccactcagctaccgtcagg

SEQ ID NO: 12162 - DNA, 20 bp, Artificial Sequence
  sgRNA
  Calhm2_20
atagcgttccactgtggccg

SEQ ID NO: 12163 - DNA, 20 bp, Artificial Sequence
  sgRNA
  Caly_1
ccctcaggcttacccgaagt

SEQ ID NO: 12164 - DNA, 20 bp, Artificial Sequence
  sgRNA
  Caly_2
agcaaaagcgatcatccttg

SEQ ID NO: 12165 - DNA, 20 bp, Artificial Sequence
  sgRNA
  Caly_3
ggagatgtactacaccgaga

SEQ ID NO: 12166 - DNA, 20 bp, Artificial Sequence
  sgRNA
  Caly_4
ggtaaactggtcataccaga

SEQ ID NO: 12167 - DNA, 20 bp, Artificial Sequence
  sgRNA
  Caly_5
gaagctggctgacatccagg

SEQ ID NO: 12168 - DNA, 20 bp, Artificial Sequence
  sgRNA
  Caly_6
aaagcgatcatccttgcggt

SEQ ID NO: 12169 - DNA, 20 bp, Artificial Sequence
  sgRNA
  Caly_7
tggacacagccatcgccgca

SEQ ID NO: 12170 - DNA, 20 bp, Artificial Sequence
  sgRNA
  Caly_8
gctggcttgcagtcactcag

SEQ ID NO: 12171 - DNA, 20 bp, Artificial Sequence
  sgRNA
  Caly_9
ctcggtgtagtacatctcca

SEQ ID NO: 12172 - DNA, 20 bp, Artificial Sequence
  sgRNA
  Caly_10
gcataagggcactacccctg

SEQ ID NO: 12173 - DNA, 20 bp, Artificial Sequence
  sgRNA
  Caly_11
ggacacagccatcgccgcag

SEQ ID NO: 12174 - DNA, 20 bp, Artificial Sequence
  sgRNA
  Caly_12
gtgtccaaagacttccctga

SEQ ID NO: 12175 - DNA, 20 bp, Artificial Sequence
  sgRNA
  Caly_13
tacccactgagccgcaaaca

SEQ ID NO: 12176 - DNA, 20 bp, Artificial Sequence
  sgRNA
  Caly_14
gaaagaagacccgcagaagg

SEQ ID NO: 12177 - DNA, 20 bp, Artificial Sequence
  sgRNA
  Caly_15
tagttgtttccccagacagc

SEQ ID NO: 12178 - DNA, 20 bp, Artificial Sequence
  sgRNA
  Caly_16
gcagcatcctggcagccatc

SEQ ID NO: 12179 - DNA, 20 bp, Artificial Sequence
  sgRNA
  Caly_17
gcatctcagtgccgtgtttg

SEQ ID NO: 12180 - DNA, 20 bp, Artificial Sequence
  sgRNA
  Caly_18
ctgtctggggaaacaactac

SEQ ID NO: 12181 - DNA, 20 bp, Artificial Sequence
  sgRNA
  Caly_19
agtacatctccagggtcagt

SEQ ID NO: 12182 - DNA, 20 bp, Artificial Sequence
  sgRNA
  Caly_20
aaacaactaccggaccgcca

SEQ ID NO: 12183 - DNA, 20 bp, Artificial Sequence
  sgRNA
  Car12_1
gtcgctatgtaggtctatcg

SEQ ID NO: 12184 - DNA, 20 bp, Artificial Sequence
  sgRNA
  Car12_2
catagcggtaatactcgcca

SEQ ID NO: 12185 - DNA, 20 bp, Artificial Sequence
  sgRNA
  Car12_3
agaaactttaccgttgagtg

SEQ ID NO: 12186 - DNA, 20 bp, Artificial Sequence
  sgRNA
  Car12_4
cttgtcatatgatggattgg

SEQ ID NO: 12187 - DNA, 20 bp, Artificial Sequence
  sgRNA
  Car12_5
gcttcttaaggatcaccaac

SEQ ID NO: 12188 - DNA, 20 bp, Artificial Sequence
  sgRNA
  Car12_6
gcaggaggcctccacacgat

SEQ ID NO: 12189 - DNA, 20 bp, Artificial Sequence
  sgRNA
  Car12_7
ggaggacgacagtcgcgcgc

SEQ ID NO: 12190 - DNA, 20 bp, Artificial Sequence
  sgRNA
  Car12_8
gcgagtattaccgctatgaa

SEQ ID NO: 12191 - DNA, 20 bp, Artificial Sequence
  sgRNA
  Car12_9
tcttaaggatcaccaacagg

SEQ ID NO: 12192 - DNA, 20 bp, Artificial Sequence
  sgRNA
  Car12_10
gctctgaacacaccgtgagt

SEQ ID NO: 12193 - DNA, 20 bp, Artificial Sequence
  sgRNA
  Car12_11
agcacggtagggtagcaagg

SEQ ID NO: 12194 - DNA, 20 bp, Artificial Sequence
  sgRNA
  Car12_12
aatgatcaacaacttccggc

SEQ ID NO: 12195 - DNA, 20 bp, Artificial Sequence
  sgRNA
  Car12_13
accgccagtgacaagtccga

SEQ ID NO: 12196 - DNA, 20 bp, Artificial Sequence
  sgRNA
  Car12_14
tcagcctccttcttgatggc

SEQ ID NO: 12197 - DNA, 20 bp, Artificial Sequence
  sgRNA
  Car12_15
ttataaaccagccatcaaga

SEQ ID NO: 12198 - DNA, 20 bp, Artificial Sequence
  sgRNA
  Car12_16
taaaccagccatcaagaagg

SEQ ID NO: 12199 - DNA, 20 bp, Artificial Sequence
  sgRNA
  Car12_17
gcagctgctctgctctgtag

SEQ ID NO: 12200 - DNA, 20 bp, Artificial Sequence
  sgRNA
  Car12_18
gtgtatatctccttccgaca

SEQ ID NO: 12201 - DNA, 20 bp, Artificial Sequence
  sgRNA
  Car12_19
attgtaaccttggaactgga

SEQ ID NO: 12202 - DNA, 20 bp, Artificial Sequence
  sgRNA
  Car12_20
tccagctcagccccactcaa

SEQ ID NO: 12203 - DNA, 20 bp, Artificial Sequence
  sgRNA
  Car14_1
ccaagctggtcatatccatg

SEQ ID NO: 12204 - DNA, 20 bp, Artificial Sequence
  sgRNA
  Car14_2
gccaatggtcctgaccgtgt

SEQ ID NO: 12205 - DNA, 20 bp, Artificial Sequence
  sgRNA
  Car14_3
gggagtcatagtgaaccacg

SEQ ID NO: 12206 - DNA, 20 bp, Artificial Sequence
  sgRNA
  Car14_4
gggtcagagaggatccctcg

SEQ ID NO: 12207 - DNA, 20 bp, Artificial Sequence
  sgRNA
  Car14_5
gagcaattcttccgctacaa

SEQ ID NO: 12208 - DNA, 20 bp, Artificial Sequence
  sgRNA
  Car14_6
ggtcagagaggatccctcga

SEQ ID NO: 12209 - DNA, 20 bp, Artificial Sequence
  sgRNA
  Car14_7
gcaggaccactgtataccac

SEQ ID NO: 12210 - DNA, 20 bp, Artificial Sequence
  sgRNA
  Car14_8
gcctccacactcaggataag

SEQ ID NO: 12211 - DNA, 20 bp, Artificial Sequence
  sgRNA
  Car14_9
agctctctcacgctgaaggg

SEQ ID NO: 12212 - DNA, 20 bp, Artificial Sequence
  sgRNA
  Car14_10
gggcagtccacccaggtgca

SEQ ID NO: 12213 - DNA, 20 bp, Artificial Sequence
  sgRNA
  Car14_11
ctctgtggtagcccgagcag

SEQ ID NO: 12214 - DNA, 20 bp, Artificial Sequence
  sgRNA
  Car14_12
tctggtgctctgatccctcg

SEQ ID NO: 12215 - DNA, 20 bp, Artificial Sequence
  sgRNA
  Car14_13
ccacactcaggataagaggt

SEQ ID NO: 12216 - DNA, 20 bp, Artificial Sequence
  sgRNA
  Car14_14
agcacactctggtagcaggg

SEQ ID NO: 12217 - DNA, 20 bp, Artificial Sequence
  sgRNA
  Car14_15
gagcacactctggtagcagg

SEQ ID NO: 12218 - DNA, 20 bp, Artificial Sequence
  sgRNA
  Car14_16
ggatccaagtcacctttaac

SEQ ID NO: 12219 - DNA, 20 bp, Artificial Sequence
  sgRNA
  Car14_17
gaggcagctcagaagccaca

SEQ ID NO: 12220 - DNA, 20 bp, Artificial Sequence
  sgRNA
  Car14_18
agaagggcccagatttcaat

SEQ ID NO: 12221 - DNA, 20 bp, Artificial Sequence
  sgRNA
  Car14_19
gactctgtagttctgtacaa

SEQ ID NO: 12222 - DNA, 20 bp, Artificial Sequence
  sgRNA
  Car14_20
ctgcctgctgtacagcccca

SEQ ID NO: 12223 - DNA, 20 bp, Artificial Sequence
  sgRNA
  Car4_1
ctgtacagcctcgtaccggg

SEQ ID NO: 12224 - DNA, 20 bp, Artificial Sequence
  sgRNA
  Car4_2
gaagttgacatctagcaagg

SEQ ID NO: 12225 - DNA, 20 bp, Artificial Sequence
  sgRNA
  Car4_3
tcacggggtttggagatact

SEQ ID NO: 12226 - DNA, 20 bp, Artificial Sequence
  sgRNA
  Car4_4
gaggataccttcagtagagg

SEQ ID NO: 12227 - DNA, 20 bp, Artificial Sequence
  sgRNA
  Car4_5
tcatagccgacgaggatgaa

SEQ ID NO: 12228 - DNA, 20 bp, Artificial Sequence
  sgRNA
  Car4_6
gcagccgctgggaaaacgcc

SEQ ID NO: 12229 - DNA, 20 bp, Artificial Sequence
  sgRNA
  Car4_7
gtgctatgagattcaaacca

SEQ ID NO: 12230 - DNA, 20 bp, Artificial Sequence
  sgRNA
  Car4_8
ggaggtgcgtgcattatcgg

SEQ ID NO: 12231 - DNA, 20 bp, Artificial Sequence
  sgRNA
  Car4_9
ctgacacccttcatcctcgt

SEQ ID NO: 12232 - DNA, 20 bp, Artificial Sequence
  sgRNA
  Car4_10
gcaactgtacagcctcgtac

SEQ ID NO: 12233 - DNA, 20 bp, Artificial Sequence
  sgRNA
  Car4_11
gttcagagcacagtattgat

SEQ ID NO: 12234 - DNA, 20 bp, Artificial Sequence
  sgRNA
  Car4_12
tactgggcagtgcttccacc

SEQ ID NO: 12235 - DNA, 20 bp, Artificial Sequence
  sgRNA
  Car4_13
tgcacctgcactggtcaaat

SEQ ID NO: 12236 - DNA, 20 bp, Artificial Sequence
  sgRNA
  Car4_14
tgatgggagacactttgcca

SEQ ID NO: 12237 - DNA, 20 bp, Artificial Sequence
  sgRNA
  Car4_15
tggtcaaatgggaatgacaa

SEQ ID NO: 12238 - DNA, 20 bp, Artificial Sequence
  sgRNA
  Car4_16
agacctgcccgcccggtacg

SEQ ID NO: 12239 - DNA, 20 bp, Artificial Sequence
  sgRNA
  Car4_17
gtaggagacaaggtgaacaa

SEQ ID NO: 12240 - DNA, 20 bp, Artificial Sequence
  sgRNA
  Car4_18
agtctcatcacagtttggtg

SEQ ID NO: 12241 - DNA, 20 bp, Artificial Sequence
  sgRNA
  Car4_19
gctatgaccaaaagcaacag

SEQ ID NO: 12242 - DNA, 20 bp, Artificial Sequence
  sgRNA
  Car4_20
tatacctacttccgttacaa

SEQ ID NO: 12243 - DNA, 20 bp, Artificial Sequence
  sgRNA
  Casd1_1
catgcacattcgagttctgg

SEQ ID NO: 12244 - DNA, 20 bp, Artificial Sequence
  sgRNA
  Casd1_2
tgtgaataccttctctcgag

SEQ ID NO: 12245 - DNA, 20 bp, Artificial Sequence
  sgRNA
  Casd1_3
tgtggtgttatgtatcgtaa

SEQ ID NO: 12246 - DNA, 20 bp, Artificial Sequence
  sgRNA
  Casd1_4
gaagatagacgcctacaatg

SEQ ID NO: 12247 - DNA, 20 bp, Artificial Sequence
  sgRNA
  Casd1_5
ttgtccccttggttaccgtg

SEQ ID NO: 12248 - DNA, 20 bp, Artificial Sequence
  sgRNA
  Casd1_6
gatcaccactgacctcgcgc

SEQ ID NO: 12249 - DNA, 20 bp, Artificial Sequence
  sgRNA
  Casd1_7
tgttgagtgtcgggtttcca

SEQ ID NO: 12250 - DNA, 20 bp, Artificial Sequence
  sgRNA
  Casd1_8
taggaataacgacctgcgcg

SEQ ID NO: 12251 - DNA, 20 bp, Artificial Sequence
  sgRNA
  Casd1_9
gctcctgctacaatcacatg

SEQ ID NO: 12252 - DNA, 20 bp, Artificial Sequence
  sgRNA
  Casd1_10
actcgaatgtgcatgtacac

SEQ ID NO: 12253 - DNA, 20 bp, Artificial Sequence
  sgRNA
  Casd1_11
ataacccgtctctcttccga

SEQ ID NO: 12254 - DNA, 20 bp, Artificial Sequence
  sgRNA
  Casd1_12
atgaaccacacggtaaccaa

SEQ ID NO: 12255 - DNA, 20 bp, Artificial Sequence
  sgRNA
  Casd1_13
ttatgcatcatacaactgtg

SEQ ID NO: 12256 - DNA, 20 bp, Artificial Sequence
  sgRNA
  Casd1_14
tgaaccacacggtaaccaag

SEQ ID NO: 12257 - DNA, 20 bp, Artificial Sequence
  sgRNA
  Casd1_15
tgacaacaggaaccatccac

SEQ ID NO: 12258 - DNA, 20 bp, Artificial Sequence
  sgRNA
  Casd1_16
gtaggcgtctatcttctcat

SEQ ID NO: 12259 - DNA, 20 bp, Artificial Sequence
  sgRNA
  Casd1_17
atgagagtgagaggtggccg

SEQ ID NO: 12260 - DNA, 20 bp, Artificial Sequence
  sgRNA
  Casd1_18
gattcataatggcagcgagg

SEQ ID NO: 12261 - DNA, 20 bp, Artificial Sequence
  sgRNA
  Casd1_19
gcatcctgaacagcagcacc

SEQ ID NO: 12262 - DNA, 20 bp, Artificial Sequence
  sgRNA
  Casd1_20
gctgctagcccagatggaat

SEQ ID NO: 12263 - DNA, 20 bp, Artificial Sequence
  sgRNA
  Casr_1
gataatgtcagccatcgcgg

SEQ ID NO: 12264 - DNA, 20 bp, Artificial Sequence
  sgRNA
  Casr_2
cccaacttccttgaacacaa

SEQ ID NO: 12265 - DNA, 20 bp, Artificial Sequence
  sgRNA
  Casr_3
agccttcagaccgaacccaa

SEQ ID NO: 12266 - DNA, 20 bp, Artificial Sequence
  sgRNA
  Casr_4
ttcctcgtgacttctcacga

SEQ ID NO: 12267 - DNA, 20 bp, Artificial Sequence
  sgRNA
  Casr_5
gagtacttccatgtagtcgg

SEQ ID NO: 12268 - DNA, 20 bp, Artificial Sequence
  sgRNA
  Casr_6
gcaggtgtatatatcttgca

SEQ ID NO: 12269 - DNA, 20 bp, Artificial Sequence
  sgRNA
  Casr_7
tggcattgagaagttccgag

SEQ ID NO: 12270 - DNA, 20 bp, Artificial Sequence
  sgRNA
  Casr_8
tctcggagcttcgtcatcag

SEQ ID NO: 12271 - DNA, 20 bp, Artificial Sequence
  sgRNA
  Casr_9
ggaggtgcgctccagcactg

SEQ ID NO: 12272 - DNA, 20 bp, Artificial Sequence
  sgRNA
  Casr_10
ggttgctcccaccactgcga

SEQ ID NO: 12273 - DNA, 20 bp, Artificial Sequence
  sgRNA
  Casr_11
ccaccactgcgatggttgaa

SEQ ID NO: 12274 - DNA, 20 bp, Artificial Sequence
  sgRNA
  Casr_12
gctgatgacgaagctccgag

SEQ ID NO: 12275 - DNA, 20 bp, Artificial Sequence
  sgRNA
  Casr_13
atgtagtcgggggtaccatt

SEQ ID NO: 12276 - DNA, 20 bp, Artificial Sequence
  sgRNA
  Casr_14
gcaaaagcaacagcgaagac

SEQ ID NO: 12277 - DNA, 20 bp, Artificial Sequence
  sgRNA
  Casr_15
ataacttccgtggattccga

SEQ ID NO: 12278 - DNA, 20 bp, Artificial Sequence
  sgRNA
  Casr_16
caccttcgtgagaagtcacg

SEQ ID NO: 12279 - DNA, 20 bp, Artificial Sequence
  sgRNA
  Casr_17
cttctcacgaaggtgtccac

SEQ ID NO: 12280 - DNA, 20 bp, Artificial Sequence
  sgRNA
  Casr_18
cttccgacccctctgcacgg

SEQ ID NO: 12281 - DNA, 20 bp, Artificial Sequence
  sgRNA
  Casr_19
gatgtctgcacaggacccgt

SEQ ID NO: 12282 - DNA, 20 bp, Artificial Sequence
  sgRNA
  Casr_20
gcaggaagtgtggttctcat

SEQ ID NO: 12283 - DNA, 20 bp, Artificial Sequence
  sgRNA
  Catsperd_1
atccccatactatggttcag

SEQ ID NO: 12284 - DNA, 20 bp, Artificial Sequence
  sgRNA
  Catsperd_2
taccgccaatgacttgggaa

SEQ ID NO: 12285 - DNA, 20 bp, Artificial Sequence
  sgRNA
  Catsperd_3
gccagattgttgaacacgtg

SEQ ID NO: 12286 - DNA, 20 bp, Artificial Sequence
  sgRNA
  Catsperd_4
aaagtgtgggtcagcaacag

SEQ ID NO: 12287 - DNA, 20 bp, Artificial Sequence
  sgRNA
  Catsperd_5
gtagggttctcgcccttccg

SEQ ID NO: 12288 - DNA, 20 bp, Artificial Sequence
  sgRNA
  Catsperd_6
tcgacattcggccatagcag

SEQ ID NO: 12289 - DNA, 20 bp, Artificial Sequence
  sgRNA
  Catsperd_7
gtaccccctgaaccatagta

SEQ ID NO: 12290 - DNA, 20 bp, Artificial Sequence
  sgRNA
  Catsperd_8
gccctcatgataccccggaa

SEQ ID NO: 12291 - DNA, 20 bp, Artificial Sequence
  sgRNA
  Catsperd_9
cgacattcggccatagcagg

SEQ ID NO: 12292 - DNA, 20 bp, Artificial Sequence
  sgRNA
  Catsperd_10
attcagcgtgtacgtgcacg

SEQ ID NO: 12293 - DNA, 20 bp, Artificial Sequence
  sgRNA
  Catsperd_11
tgtcatagtagactaggcgc

SEQ ID NO: 12294 - DNA, 20 bp, Artificial Sequence
  sgRNA
  Catsperd_12
gatactccagctctgcctag

SEQ ID NO: 12295 - DNA, 20 bp, Artificial Sequence
  sgRNA
  Catsperd_13
gcgttgtggtgaccatcagg

SEQ ID NO: 12296 - DNA, 20 bp, Artificial Sequence
  sgRNA
  Catsperd_14
gcccttccggggtatcatga

SEQ ID NO: 12297 - DNA, 20 bp, Artificial Sequence
  sgRNA
  Catsperd_15
tgccatctcctctgtaaccg

SEQ ID NO: 12298 - DNA, 20 bp, Artificial Sequence
  sgRNA
  Catsperd_16
agtccaatatacaacttcaa

SEQ ID NO: 12299 - DNA, 20 bp, Artificial Sequence
  sgRNA
  Catsperd_17
ttgtcatagtagactaggcg

SEQ ID NO: 12300 - DNA, 20 bp, Artificial Sequence
  sgRNA
  Catsperd_18
cctgagacatggaatgtaag

SEQ ID NO: 12301 - DNA, 20 bp, Artificial Sequence
  sgRNA
  Catsperd_19
cacctattcatactccttga

SEQ ID NO: 12302 - DNA, 20 bp, Artificial Sequence
  sgRNA
  Catsperd_20
ttacattccatgtctcaggt

SEQ ID NO: 12303 - DNA, 20 bp, Artificial Sequence
  sgRNA
  Catsperg1_1
gctgtcgttgaagtcgtggg

SEQ ID NO: 12304 - DNA, 20 bp, Artificial Sequence
  sgRNA
  Catsperg1_2
gcagagtgttgcgattaaga

SEQ ID NO: 12305 - DNA, 20 bp, Artificial Sequence
  sgRNA
  Catsperg1_3
ggaggacagccgatgaatat

SEQ ID NO: 12306 - DNA, 20 bp, Artificial Sequence
  sgRNA
  Catsperg1_4
aggctggtaccaatattcat

SEQ ID NO: 12307 - DNA, 20 bp, Artificial Sequence
  sgRNA
  Catsperg1_5
aatgaagagtgtgctctcgg

SEQ ID NO: 12308 - DNA, 20 bp, Artificial Sequence
  sgRNA
  Catsperg1_6
catcttctgcagtttaaggt

SEQ ID NO: 12309 - DNA, 20 bp, Artificial Sequence
  sgRNA
  Catsperg1_7
ctacacgattaagcattctg

SEQ ID NO: 12310 - DNA, 20 bp, Artificial Sequence
  sgRNA
  Catsperg1_8
gcctccaaggatgaacacgg

SEQ ID NO: 12311 - DNA, 20 bp, Artificial Sequence
  sgRNA
  Catsperg1_9
gcctttcagtaactgcgact

SEQ ID NO: 12312 - DNA, 20 bp, Artificial Sequence
  sgRNA
  Catsperg1_10
ctacatacatcactgatgag

SEQ ID NO: 12313 - DNA, 20 bp, Artificial Sequence
  sgRNA
  Catsperg1_11
acgctctttgacaaaagcca

SEQ ID NO: 12314 - DNA, 20 bp, Artificial Sequence
  sgRNA
  Catsperg1_12
gactcatttgtagaatacag

SEQ ID NO: 12315 - DNA, 20 bp, Artificial Sequence
  sgRNA
  Catsperg1_13
tcatcttcctcctcttctgg

SEQ ID NO: 12316 - DNA, 20 bp, Artificial Sequence
  sgRNA
  Catsperg1_14
aaaggtcgaaaggaccacgg

SEQ ID NO: 12317 - DNA, 20 bp, Artificial Sequence
  sgRNA
  Catsperg1_15
ggatgcacatggcctctgcc

SEQ ID NO: 12318 - DNA, 20 bp, Artificial Sequence
  sgRNA
  Catsperg1_16
ccattgccactgaaatacac

SEQ ID NO: 12319 - DNA, 20 bp, Artificial Sequence
  sgRNA
  Catsperg1_17
ctgtgcccggtgtatttcag

SEQ ID NO: 12320 - DNA, 20 bp, Artificial Sequence
  sgRNA
  Catsperg1_18
ggtgaagcccccagaagagg

SEQ ID NO: 12321 - DNA, 20 bp, Artificial Sequence
  sgRNA
  Catsperg1_19
gaggaccgcttgctgctgag

SEQ ID NO: 12322 - DNA, 20 bp, Artificial Sequence
  sgRNA
  Catsperg1_20
gtgggggatctggaatagga

SEQ ID NO: 12323 - DNA, 20 bp, Artificial Sequence
  sgRNA
  Catsperg2_1
acactcttcgacaaaagcca

SEQ ID NO: 12324 - DNA, 20 bp, Artificial Sequence
  sgRNA
  Catsperg2_2
ctacacgattatgcattccg

SEQ ID NO: 12325 - DNA, 20 bp, Artificial Sequence
  sgRNA
  Catsperg2_3
gggggatgatgtcataacaa

SEQ ID NO: 12326 - DNA, 20 bp, Artificial Sequence
  sgRNA
  Catsperg2_4
tctttcgaaccagctctgga

SEQ ID NO: 12327 - DNA, 20 bp, Artificial Sequence
  sgRNA
  Catsperg2_5
aaaggtcgaaaggaccaccg

SEQ ID NO: 12328 - DNA, 20 bp, Artificial Sequence
  sgRNA
  Catsperg2_6
tcactgcgttgcgattaaga

SEQ ID NO: 12329 - DNA, 20 bp, Artificial Sequence
  sgRNA
  Catsperg2_7
attgctgtcattgaagtcgt

SEQ ID NO: 12330 - DNA, 20 bp, Artificial Sequence
  sgRNA
  Catsperg2_8
gtaccagttcaggacgcaca

SEQ ID NO: 12331 - DNA, 20 bp, Artificial Sequence
  sgRNA
  Catsperg2_9
aaagtggtaccaatattcat

SEQ ID NO: 12332 - DNA, 20 bp, Artificial Sequence
  sgRNA
  Catsperg2_10
gaggtccgcttgctgctgag

SEQ ID NO: 12333 - DNA, 20 bp, Artificial Sequence
  sgRNA
  Catsperg2_11
gtactcagaaccattgccac

SEQ ID NO: 12334 - DNA, 20 bp, Artificial Sequence
  sgRNA
  Catsperg2_12
tttcatcataaaagccccca

SEQ ID NO: 12335 - DNA, 20 bp, Artificial Sequence
  sgRNA
  Catsperg2_13
catcttctgcaggttatggt

SEQ ID NO: 12336 - DNA, 20 bp, Artificial Sequence
  sgRNA
  Catsperg2_14
tctccctcttctttgaggat

SEQ ID NO: 12337 - DNA, 20 bp, Artificial Sequence
  sgRNA
  Catsperg2_15
ggggatgatgtcataacaag

SEQ ID NO: 12338 - DNA, 20 bp, Artificial Sequence
  sgRNA
  Catsperg2_16
atattcatcggctgtccgcc

SEQ ID NO: 12339 - DNA, 20 bp, Artificial Sequence
  sgRNA
  Catsperg2_17
ctcggaatgcataatcgtgt

SEQ ID NO: 12340 - DNA, 20 bp, Artificial Sequence
  sgRNA
  Catsperg2_18
ccattgccactggcatacac

SEQ ID NO: 12341 - DNA, 20 bp, Artificial Sequence
  sgRNA
  Catsperg2_19
cttcccatcctcaaagaaga

SEQ ID NO: 12342 - DNA, 20 bp, Artificial Sequence
  sgRNA
  Catsperg2_20
gtgcattaagagactgtgcc

SEQ ID NO: 12343 - DNA, 20 bp, Artificial Sequence
  sgRNA
  Cckar_1
gcaccaagttgctgtaaatg

SEQ ID NO: 12344 - DNA, 20 bp, Artificial Sequence
  sgRNA
  Cckar_2
agccgatatgaggatagcga

SEQ ID NO: 12345 - DNA, 20 bp, Artificial Sequence
  sgRNA
  Cckar_3
tgccagacgcgggattgtag

SEQ ID NO: 12346 - DNA, 20 bp, Artificial Sequence
  sgRNA
  Cckar_4
gtaggtggtagtcttgcaca

SEQ ID NO: 12347 - DNA, 20 bp, Artificial Sequence
  sgRNA
  Cckar_5
cggtgctgattcgaaacaag

SEQ ID NO: 12348 - DNA, 20 bp, Artificial Sequence
  sgRNA
  Cckar_6
gagtgtttccaccttcaacc

SEQ ID NO: 12349 - DNA, 20 bp, Artificial Sequence
  sgRNA
  Cckar_7
tgaaggtcatcgctgccacc

SEQ ID NO: 12350 - DNA, 20 bp, Artificial Sequence
  sgRNA
  Cckar_8
ccaccaccatcacaacccca

SEQ ID NO: 12351 - DNA, 20 bp, Artificial Sequence
  sgRNA
  Cckar_9
tttccagcccgagttcacag

SEQ ID NO: 12352 - DNA, 20 bp, Artificial Sequence
  sgRNA
  Cckar_10
ggtaaaggagaggcaccagg

SEQ ID NO: 12353 - DNA, 20 bp, Artificial Sequence
  sgRNA
  Cckar_11
acttctcctctcaccccggt

SEQ ID NO: 12354 - DNA, 20 bp, Artificial Sequence
  sgRNA
  Cckar_12
atctctctggaactctacca

SEQ ID NO: 12355 - DNA, 20 bp, Artificial Sequence
  sgRNA
  Cckar_13
ggactttgtttgccagacgc

SEQ ID NO: 12356 - DNA, 20 bp, Artificial Sequence
  sgRNA
  Cckar_14
tcttcagtgccaatgcctgg

SEQ ID NO: 12357 - DNA, 20 bp, Artificial Sequence
  sgRNA
  Cckar_15
gcatagcgtcacttggcaac

SEQ ID NO: 12358 - DNA, 20 bp, Artificial Sequence
  sgRNA
  Cckar_16
gctgtaggaataccgggaca

SEQ ID NO: 12359 - DNA, 20 bp, Artificial Sequence
  sgRNA
  Cckar_17
atgaacaaacgctttcgcct

SEQ ID NO: 12360 - DNA, 20 bp, Artificial Sequence
  sgRNA
  Cckar_18
gtacggagtcatgatggtaa

SEQ ID NO: 12361 - DNA, 20 bp, Artificial Sequence
  sgRNA
  Cckar_19
gagtcatgatggtaaaggag

SEQ ID NO: 12362 - DNA, 20 bp, Artificial Sequence
  sgRNA
  Cckar_20
gtcatatgcccgccaggcat

SEQ ID NO: 12363 - DNA, 20 bp, Artificial Sequence
  sgRNA
  Cckbr_1
gatggccgcgagatttagag

SEQ ID NO: 12364 - DNA, 20 bp, Artificial Sequence
  sgRNA
  Cckbr_2
agccgggtccgaaaccaagg

SEQ ID NO: 12365 - DNA, 20 bp, Artificial Sequence
  sgRNA
  Cckbr_3
cgaagatgaatgtgcccatg

SEQ ID NO: 12366 - DNA, 20 bp, Artificial Sequence
  sgRNA
  Cckbr_4
cccggttccgcggatacgag

SEQ ID NO: 12367 - DNA, 20 bp, Artificial Sequence
  sgRNA
  Cckbr_5
gggcctgtccaccagaacgg

SEQ ID NO: 12368 - DNA, 20 bp, Artificial Sequence
  sgRNA
  Cckbr_6
actgagccgacgcctaagaa

SEQ ID NO: 12369 - DNA, 20 bp, Artificial Sequence
  sgRNA
  Cckbr_7
tggtgaccgttcttaggcgt

SEQ ID NO: 12370 - DNA, 20 bp, Artificial Sequence
  sgRNA
  Cckbr_8
catgcaccgccgattccgcc

SEQ ID NO: 12371 - DNA, 20 bp, Artificial Sequence
  sgRNA
  Cckbr_9
tgcgagacccctcgtatccg

SEQ ID NO: 12372 - DNA, 20 bp, Artificial Sequence
  sgRNA
  Cckbr_10
tcagcgttgtcatctccagt

SEQ ID NO: 12373 - DNA, 20 bp, Artificial Sequence
  sgRNA
  Cckbr_11
ctaagatcacccgagctgcg

SEQ ID NO: 12374 - DNA, 20 bp, Artificial Sequence
  sgRNA
  Cckbr_12
gtgcatgaaacagtagacca

SEQ ID NO: 12375 - DNA, 20 bp, Artificial Sequence
  sgRNA
  Cckbr_13
tcccggttccgcggatacga

SEQ ID NO: 12376 - DNA, 20 bp, Artificial Sequence
  sgRNA
  Cckbr_14
tctcccgcgaactctaccta

SEQ ID NO: 12377 - DNA, 20 bp, Artificial Sequence
  sgRNA
  Cckbr_15
gatggcgctgtatcgctcca

SEQ ID NO: 12378 - DNA, 20 bp, Artificial Sequence
  sgRNA
  Cckbr_16
cccctaccccgtgtacaccg

SEQ ID NO: 12379 - DNA, 20 bp, Artificial Sequence
  sgRNA
  Cckbr_17
gcaacttccgcgttcccgac

SEQ ID NO: 12380 - DNA, 20 bp, Artificial Sequence
  sgRNA
  Cckbr_18
cagtgtacagcgccaacacg

SEQ ID NO: 12381 - DNA, 20 bp, Artificial Sequence
  sgRNA
  Cckbr_19
gcatgtgaccagcctgactg

SEQ ID NO: 12382 - DNA, 20 bp, Artificial Sequence
  sgRNA
  Cckbr_20
acactcgtgcttgcagtggt

SEQ ID NO: 12383 - DNA, 20 bp, Artificial Sequence
  sgRNA
  Ccr1_1
gaacactagagaatacaggg

SEQ ID NO: 12384 - DNA, 20 bp, Artificial Sequence
  sgRNA
  Ccr1_2
acggtgagtgaactcccact

SEQ ID NO: 12385 - DNA, 20 bp, Artificial Sequence
  sgRNA
  Ccr1_3
cagattatcatgactaacag

SEQ ID NO: 12386 - DNA, 20 bp, Artificial Sequence
  sgRNA
  Ccr1_4
agtaacagttcgggccctca

SEQ ID NO: 12387 - DNA, 20 bp, Artificial Sequence
  sgRNA
  Ccr1_5
gattgggttgacacaacagt

SEQ ID NO: 12388 - DNA, 20 bp, Artificial Sequence
  sgRNA
  Ccr1_6
tgaacactagagaatacagg

SEQ ID NO: 12389 - DNA, 20 bp, Artificial Sequence
  sgRNA
  Ccr1_7
aatagcaaatatcagacgca

SEQ ID NO: 12390 - DNA, 20 bp, Artificial Sequence
  sgRNA
  Ccr1_8
gctttgaccttcttctcact

SEQ ID NO: 12391 - DNA, 20 bp, Artificial Sequence
  sgRNA
  Ccr1_9
actacaagttgaaagacgac

SEQ ID NO: 12392 - DNA, 20 bp, Artificial Sequence
  sgRNA
  Ccr1_10
catggaagctaagatggcta

SEQ ID NO: 12393 - DNA, 20 bp, Artificial Sequence
  sgRNA
  Ccr1_11
ggtatctgtcaatcgtcaac

SEQ ID NO: 12394 - DNA, 20 bp, Artificial Sequence
  sgRNA
  Ccr1_12
aacactagagaatacagggg

SEQ ID NO: 12395 - DNA, 20 bp, Artificial Sequence
  sgRNA
  Ccr1_13
gtgtgagcagagtaagcaac

SEQ ID NO: 12396 - DNA, 20 bp, Artificial Sequence
  sgRNA
  Ccr1_14
acaactacagaatttgacta

SEQ ID NO: 12397 - DNA, 20 bp, Artificial Sequence
  sgRNA
  Ccr1_15
cctacaagagcctgaagcag

SEQ ID NO: 12398 - DNA, 20 bp, Artificial Sequence
  sgRNA
  Ccr1_16
tcatgataatctgctatgca

SEQ ID NO: 12399 - DNA, 20 bp, Artificial Sequence
  sgRNA
  Ccr1_17
agagagctcatgttctcctg

SEQ ID NO: 12400 - DNA, 20 bp, Artificial Sequence
  sgRNA
  Ccr1_18
cttactctgctcacactgat

SEQ ID NO: 12401 - DNA, 20 bp, Artificial Sequence
  sgRNA
  Ccr1_19
ggctcttgtaggggaaatga

SEQ ID NO: 12402 - DNA, 20 bp, Artificial Sequence
  sgRNA
  Ccr1_20
actgcttcaggctcttgtag

SEQ ID NO: 12403 - DNA, 20 bp, Artificial Sequence
  sgRNA
  Ccr10_1
gtgaaggccaacgacgctgt

SEQ ID NO: 12404 - DNA, 20 bp, Artificial Sequence
  sgRNA
  Ccr10_2
agactgaaaccaagtgcgct

SEQ ID NO: 12405 - DNA, 20 bp, Artificial Sequence
  sgRNA
  Ccr10_3
caggctgccatgacgcccag

SEQ ID NO: 12406 - DNA, 20 bp, Artificial Sequence
  sgRNA
  Ccr10_4
ccatcagggagacactgggt

SEQ ID NO: 12407 - DNA, 20 bp, Artificial Sequence
  sgRNA
  Ccr10_5
ataggcctcctcatcgtacc

SEQ ID NO: 12408 - DNA, 20 bp, Artificial Sequence
  sgRNA
  Ccr10_6
aagaaaggcggagtcgacgg

SEQ ID NO: 12409 - DNA, 20 bp, Artificial Sequence
  sgRNA
  Ccr10_7
ctcgcgggctgccagtagat

SEQ ID NO: 12410 - DNA, 20 bp, Artificial Sequence
  sgRNA
  Ccr10_8
ccagagggagcgcgaagccg

SEQ ID NO: 12411 - DNA, 20 bp, Artificial Sequence
  sgRNA
  Ccr10_9
gcagcctgttatgcgctcct

SEQ ID NO: 12412 - DNA, 20 bp, Artificial Sequence
  sgRNA
  Ccr10_10
ctagctttgctggtcaccgg

SEQ ID NO: 12413 - DNA, 20 bp, Artificial Sequence
  sgRNA
  Ccr10_11
tgcgatggccacatagcggt

SEQ ID NO: 12414 - DNA, 20 bp, Artificial Sequence
  sgRNA
  Ccr10_12
ggtccgttgcagcctcaatc

SEQ ID NO: 12415 - DNA, 20 bp, Artificial Sequence
  sgRNA
  Ccr10_13
attgaggctgcaacggacca

SEQ ID NO: 12416 - DNA, 20 bp, Artificial Sequence
  sgRNA
  Ccr10_14
aggctgccatgacgcccaga

SEQ ID NO: 12417 - DNA, 20 bp, Artificial Sequence
  sgRNA
  Ccr10_15
tttgggcctgcgtttccgcc

SEQ ID NO: 12418 - DNA, 20 bp, Artificial Sequence
  sgRNA
  Ccr10_16
gtacccggagtaaagtcccc

SEQ ID NO: 12419 - DNA, 20 bp, Artificial Sequence
  sgRNA
  Ccr10_17
ctcgtgcgatggccacatag

SEQ ID NO: 12420 - DNA, 20 bp, Artificial Sequence
  sgRNA
  Ccr10_18
ttgtaacagagctctggcag

SEQ ID NO: 12421 - DNA, 20 bp, Artificial Sequence
  sgRNA
  Ccr10_19
gggccaataaaaggtcagcc

SEQ ID NO: 12422 - DNA, 20 bp, Artificial Sequence
  sgRNA
  Ccr10_20
tcgtctggctgccagatggg

SEQ ID NO: 12423 - DNA, 20 bp, Artificial Sequence
  sgRNA
  Ccr1l1_1
ccatgattatctgctacaca

SEQ ID NO: 12424 - DNA, 20 bp, Artificial Sequence
  sgRNA
  Ccr1l1_2
tggtgctcatacaacacaag

SEQ ID NO: 12425 - DNA, 20 bp, Artificial Sequence
  sgRNA
  Ccr1l1_3
gatttgaaaacatagagaca

SEQ ID NO: 12426 - DNA, 20 bp, Artificial Sequence
  sgRNA
  Ccr1l1_4
gatgccaaaagtgacagtcc

SEQ ID NO: 12427 - DNA, 20 bp, Artificial Sequence
  sgRNA
  Ccr1l1_5
gtatctatcaatcgtaagca

SEQ ID NO: 12428 - DNA, 20 bp, Artificial Sequence
  sgRNA
  Ccr1l1_6
gcctccgaaacaactgccag

SEQ ID NO: 12429 - DNA, 20 bp, Artificial Sequence
  sgRNA
  Ccr1l1_7
cacgccaatgatgaacacca

SEQ ID NO: 12430 - DNA, 20 bp, Artificial Sequence
  sgRNA
  Ccr1l1_8
gcaccagaaccaccaagaca

SEQ ID NO: 12431 - DNA, 20 bp, Artificial Sequence
  sgRNA
  Ccr1l1_9
cagataatcatggccaacag

SEQ ID NO: 12432 - DNA, 20 bp, Artificial Sequence
  sgRNA
  Ccr1l1_10
agaggtctcaatttccactg

SEQ ID NO: 12433 - DNA, 20 bp, Artificial Sequence
  sgRNA
  Ccr1l1_11
acatgtcactatacaagccc

SEQ ID NO: 12434 - DNA, 20 bp, Artificial Sequence
  sgRNA
  Ccr1l1_12
tcaaggacaggtccacctgt

SEQ ID NO: 12435 - DNA, 20 bp, Artificial Sequence
  sgRNA
  Ccr1l1_13
gctgactcccctgtactccc

SEQ ID NO: 12436 - DNA, 20 bp, Artificial Sequence
  sgRNA
  Ccr1l1_14
gataataaggggccaagagg

SEQ ID NO: 12437 - DNA, 20 bp, Artificial Sequence
  sgRNA
  Ccr1l1_15
ttggcaactgtgttgtagga

SEQ ID NO: 12438 - DNA, 20 bp, Artificial Sequence
  sgRNA
  Ccr1l1_16
ttggcttctcaaacaactag

SEQ ID NO: 12439 - DNA, 20 bp, Artificial Sequence
  sgRNA
  Ccr1l1_17
gttggcttctcaaacaacta

SEQ ID NO: 12440 - DNA, 20 bp, Artificial Sequence
  sgRNA
  Ccr1l1_18
cttcagttatcatcaaggac

SEQ ID NO: 12441 - DNA, 20 bp, Artificial Sequence
  sgRNA
  Ccr1l1_19
ccagataataaggggccaag

SEQ ID NO: 12442 - DNA, 20 bp, Artificial Sequence
  sgRNA
  Ccr1l1_20
cagaagacccaataagaaga

SEQ ID NO: 12443 - DNA, 20 bp, Artificial Sequence
  sgRNA
  Ccr2_1
atcatcgtagtcatacggtg

SEQ ID NO: 12444 - DNA, 20 bp, Artificial Sequence
  sgRNA
  Ccr2_2
tacacttgttatcaccccaa

SEQ ID NO: 12445 - DNA, 20 bp, Artificial Sequence
  sgRNA
  Ccr2_3
gatgatcaccattacacctg

SEQ ID NO: 12446 - DNA, 20 bp, Artificial Sequence
  sgRNA
  Ccr2_4
ccagggagtagagtggaggc

SEQ ID NO: 12447 - DNA, 20 bp, Artificial Sequence
  sgRNA
  Ccr2_5
gagatgttgatagtatgccg

SEQ ID NO: 12448 - DNA, 20 bp, Artificial Sequence
  sgRNA
  Ccr2_6
tcaccatcatcgtagtcata

SEQ ID NO: 12449 - DNA, 20 bp, Artificial Sequence
  sgRNA
  Ccr2_7
ctacattcactccttccact

SEQ ID NO: 12450 - DNA, 20 bp, Artificial Sequence
  sgRNA
  Ccr2_8
agtatgccgtggatgaactg

SEQ ID NO: 12451 - DNA, 20 bp, Artificial Sequence
  sgRNA
  Ccr2_9
acaccgtatgactacgatga

SEQ ID NO: 12452 - DNA, 20 bp, Artificial Sequence
  sgRNA
  Ccr2_10
atcgtagtcatacggtgtgg

SEQ ID NO: 12453 - DNA, 20 bp, Artificial Sequence
  sgRNA
  Ccr2_11
ttgttggagagaagttccga

SEQ ID NO: 12454 - DNA, 20 bp, Artificial Sequence
  sgRNA
  Ccr2_12
gctgtctccctatagaaaac

SEQ ID NO: 12455 - DNA, 20 bp, Artificial Sequence
  sgRNA
  Ccr2_13
gtatccaagagcttgatgaa

SEQ ID NO: 12456 - DNA, 20 bp, Artificial Sequence
  sgRNA
  Ccr2_14
agatatttctcattattgtt

SEQ ID NO: 12457 - DNA, 20 bp, Artificial Sequence
  sgRNA
  Ccr2_15
cattcccaaggattcctgga

SEQ ID NO: 12458 - DNA, 20 bp, Artificial Sequence
  sgRNA
  Ccr2_16
aagccaggacagttaccttt

SEQ ID NO: 12459 - DNA, 20 bp, Artificial Sequence
  sgRNA
  Ccr2_17
cgagacctcttgctccccag

SEQ ID NO: 12460 - DNA, 20 bp, Artificial Sequence
  sgRNA
  Ccr2_18
gattgacaagcacttagacc

SEQ ID NO: 12461 - DNA, 20 bp, Artificial Sequence
  sgRNA
  Ccr2_19
agctccaatttgcttcacac

SEQ ID NO: 12462 - DNA, 20 bp, Artificial Sequence
  sgRNA
  Ccr2_20
accaccttccaggaatcctt

SEQ ID NO: 12463 - DNA, 20 bp, Artificial Sequence
  sgRNA
  Ccr3_1
ccacaccctatgaatatgag

SEQ ID NO: 12464 - DNA, 20 bp, Artificial Sequence
  sgRNA
  Ccr3_2
agtagcagataaccataatg

SEQ ID NO: 12465 - DNA, 20 bp, Artificial Sequence
  sgRNA
  Ccr3_3
atcaccagtatcattacctg

SEQ ID NO: 12466 - DNA, 20 bp, Artificial Sequence
  sgRNA
  Ccr3_4
ctgcagtcctcgctatccag

SEQ ID NO: 12467 - DNA, 20 bp, Artificial Sequence
  sgRNA
  Ccr3_5
tcttcaccctctggatagcg

SEQ ID NO: 12468 - DNA, 20 bp, Artificial Sequence
  sgRNA
  Ccr3_6
ggtaaactgccacatttctg

SEQ ID NO: 12469 - DNA, 20 bp, Artificial Sequence
  sgRNA
  Ccr3_7
agtcacagttcgggctcgaa

SEQ ID NO: 12470 - DNA, 20 bp, Artificial Sequence
  sgRNA
  Ccr3_8
ggtatctgtcaattgtcagc

SEQ ID NO: 12471 - DNA, 20 bp, Artificial Sequence
  sgRNA
  Ccr3_9
ggtgcccactcatattcata

SEQ ID NO: 12472 - DNA, 20 bp, Artificial Sequence
  sgRNA
  Ccr3_10
gtagcttcctgtactttatg

SEQ ID NO: 12473 - DNA, 20 bp, Artificial Sequence
  sgRNA
  Ccr3_11
ttactggattaatacagcag

SEQ ID NO: 12474 - DNA, 20 bp, Artificial Sequence
  sgRNA
  Ccr3_12
tgcagtcctcgctatccaga

SEQ ID NO: 12475 - DNA, 20 bp, Artificial Sequence
  sgRNA
  Ccr3_13
cagataaccataatgaggag

SEQ ID NO: 12476 - DNA, 20 bp, Artificial Sequence
  sgRNA
  Ccr3_14
ccactcatattcatagggtg

SEQ ID NO: 12477 - DNA, 20 bp, Artificial Sequence
  sgRNA
  Ccr3_15
gctctgtctccccatcaact

SEQ ID NO: 12478 - DNA, 20 bp, Artificial Sequence
  sgRNA
  Ccr3_16
tctacgcctttgttggtgag

SEQ ID NO: 12479 - DNA, 20 bp, Artificial Sequence
  sgRNA
  Ccr3_17
tgttgatcctcataaagtac

SEQ ID NO: 12480 - DNA, 20 bp, Artificial Sequence
  sgRNA
  Ccr3_18
ctatcaccagtatcattacc

SEQ ID NO: 12481 - DNA, 20 bp, Artificial Sequence
  sgRNA
  Ccr3_19
tggtgcccactcatattcat

SEQ ID NO: 12482 - DNA, 20 bp, Artificial Sequence
  sgRNA
  Ccr3_20
aagtcagaatcaaagagctg

SEQ ID NO: 12483 - DNA, 20 bp, Artificial Sequence
  sgRNA
  Ccr4_1
ggagaataccgcgtgcacga

SEQ ID NO: 12484 - DNA, 20 bp, Artificial Sequence
  sgRNA
  Ccr4_2
actcggtcaactcgacgacg

SEQ ID NO: 12485 - DNA, 20 bp, Artificial Sequence
  sgRNA
  Ccr4_3
caagaggctcaagtccatga

SEQ ID NO: 12486 - DNA, 20 bp, Artificial Sequence
  sgRNA
  Ccr4_4
ggaaggtatcaaggcatttg

SEQ ID NO: 12487 - DNA, 20 bp, Artificial Sequence
  sgRNA
  Ccr4_5
tgtacggcgtccagaagccg

SEQ ID NO: 12488 - DNA, 20 bp, Artificial Sequence
  sgRNA
  Ccr4_6
ctactacgccgccgaccagt

SEQ ID NO: 12489 - DNA, 20 bp, Artificial Sequence
  sgRNA
  Ccr4_7
atacctggccatcgtgcacg

SEQ ID NO: 12490 - DNA, 20 bp, Artificial Sequence
  sgRNA
  Ccr4_8
gacctagtccaaaaacccac

SEQ ID NO: 12491 - DNA, 20 bp, Artificial Sequence
  sgRNA
  Ccr4_9
agtgcgcatgatcttcgccg

SEQ ID NO: 12492 - DNA, 20 bp, Artificial Sequence
  sgRNA
  Ccr4_10
cttctggacgccgtacaacg

SEQ ID NO: 12493 - DNA, 20 bp, Artificial Sequence
  sgRNA
  Ccr4_11
gtagtctaggtacctctcca

SEQ ID NO: 12494 - DNA, 20 bp, Artificial Sequence
  sgRNA
  Ccr4_12
gtactgcaaaacccagtact

SEQ ID NO: 12495 - DNA, 20 bp, Artificial Sequence
  sgRNA
  Ccr4_13
tagtccaaaaacccactggt

SEQ ID NO: 12496 - DNA, 20 bp, Artificial Sequence
  sgRNA
  Ccr4_14
gctactacgccgccgaccag

SEQ ID NO: 12497 - DNA, 20 bp, Artificial Sequence
  sgRNA
  Ccr4_15
tgtcagccgagtagacctgg

SEQ ID NO: 12498 - DNA, 20 bp, Artificial Sequence
  sgRNA
  Ccr4_16
acaaaacagcatgatgccca

SEQ ID NO: 12499 - DNA, 20 bp, Artificial Sequence
  sgRNA
  Ccr4_17
tacctggtgggcttctacag

SEQ ID NO: 12500 - DNA, 20 bp, Artificial Sequence
  sgRNA
  Ccr4_18
aggaaaagcaccacgttgta

SEQ ID NO: 12501 - DNA, 20 bp, Artificial Sequence
  sgRNA
  Ccr4_19
tccaaaaacccactggtcgg

SEQ ID NO: 12502 - DNA, 20 bp, Artificial Sequence
  sgRNA
  Ccr4_20
acggaagtcatgatccacag

SEQ ID NO: 12503 - DNA, 20 bp, Artificial Sequence
  sgRNA
  Ccr5_1
agtcagaacggtcaactttg

SEQ ID NO: 12504 - DNA, 20 bp, Artificial Sequence
  sgRNA
  Ccr5_2
gaataccagggagtagagtg

SEQ ID NO: 12505 - DNA, 20 bp, Artificial Sequence
  sgRNA
  Ccr5_3
cagaaatgatactgagtgtg

SEQ ID NO: 12506 - DNA, 20 bp, Artificial Sequence
  sgRNA
  Ccr5_4
agtacctatcaattgtcagg

SEQ ID NO: 12507 - DNA, 20 bp, Artificial Sequence
  sgRNA
  Ccr5_5
tcgatgtcatagctataggt

SEQ ID NO: 12508 - DNA, 20 bp, Artificial Sequence
  sgRNA
  Ccr5_6
agaacactgagagataactc

SEQ ID NO: 12509 - DNA, 20 bp, Artificial Sequence
  sgRNA
  Ccr5_7
ataatcgatgtcatagctat

SEQ ID NO: 12510 - DNA, 20 bp, Artificial Sequence
  sgRNA
  Ccr5_8
agtgttcttccgaaaacaca

SEQ ID NO: 12511 - DNA, 20 bp, Artificial Sequence
  sgRNA
  Ccr5_9
cctttgttggagagaagttc

SEQ ID NO: 12512 - DNA, 20 bp, Artificial Sequence
  sgRNA
  Ccr5_10
ggagaacatgaagtttctac

SEQ ID NO: 12513 - DNA, 20 bp, Artificial Sequence
  sgRNA
  Ccr5_11
tcagtctatacccgatccac

SEQ ID NO: 12514 - DNA, 20 bp, Artificial Sequence
  sgRNA
  Ccr5_12
cagtccaaagaattcctgga

SEQ ID NO: 12515 - DNA, 20 bp, Artificial Sequence
  sgRNA
  Ccr5_13
gagtttccaaacattaaaga

SEQ ID NO: 12516 - DNA, 20 bp, Artificial Sequence
  sgRNA
  Ccr5_14
gtttgctttaaaagtcagaa

SEQ ID NO: 12517 - DNA, 20 bp, Artificial Sequence
  sgRNA
  Ccr5_15
aagtgtagtcacttgggcgg

SEQ ID NO: 12518 - DNA, 20 bp, Artificial Sequence
  sgRNA
  Ccr5_16
tcaacttgtatcctcaactg

SEQ ID NO: 12519 - DNA, 20 bp, Artificial Sequence
  sgRNA
  Ccr5_17
aatcaatgtgaaacaaattg

SEQ ID NO: 12520 - DNA, 20 bp, Artificial Sequence
  sgRNA
  Ccr5_18
tttaccagatctcagaaaga

SEQ ID NO: 12521 - DNA, 20 bp, Artificial Sequence
  sgRNA
  Ccr5_19
tatagctatgacatcgatta

SEQ ID NO: 12522 - DNA, 20 bp, Artificial Sequence
  sgRNA
  Ccr5_20
agaaacttcatgttctcctg

SEQ ID NO: 12523 - DNA, 20 bp, Artificial Sequence
  sgRNA
  Ccr6_1
actgatgaaaggcacatatg

SEQ ID NO: 12524 - DNA, 20 bp, Artificial Sequence
  sgRNA
  Ccr6_2
tctgagacagacctgtaccg

SEQ ID NO: 12525 - DNA, 20 bp, Artificial Sequence
  sgRNA
  Ccr6_3
agaggtcagaaacttcacca

SEQ ID NO: 12526 - DNA, 20 bp, Artificial Sequence
  sgRNA
  Ccr6_4
agatttggttgcctggacga

SEQ ID NO: 12527 - DNA, 20 bp, Artificial Sequence
  sgRNA
  Ccr6_5
cctcgcctacaccaggaacg

SEQ ID NO: 12528 - DNA, 20 bp, Artificial Sequence
  sgRNA
  Ccr6_6
ccgtgttgaccgcagtcacg

SEQ ID NO: 12529 - DNA, 20 bp, Artificial Sequence
  sgRNA
  Ccr6_7
tgttgaccgcagtcacgagg

SEQ ID NO: 12530 - DNA, 20 bp, Artificial Sequence
  sgRNA
  Ccr6_8
tggcctgtatcagcatggac

SEQ ID NO: 12531 - DNA, 20 bp, Artificial Sequence
  sgRNA
  Ccr6_9
caataaacgcatacaacacg

SEQ ID NO: 12532 - DNA, 20 bp, Artificial Sequence
  sgRNA
  Ccr6_10
tgcaggcccagaactccaag

SEQ ID NO: 12533 - DNA, 20 bp, Artificial Sequence
  sgRNA
  Ccr6_11
ctacaccaggaacgtggccg

SEQ ID NO: 12534 - DNA, 20 bp, Artificial Sequence
  sgRNA
  Ccr6_12
cctggacgatggcaatgtac

SEQ ID NO: 12535 - DNA, 20 bp, Artificial Sequence
  sgRNA
  Ccr6_13
gcatgagtaactgcccagaa

SEQ ID NO: 12536 - DNA, 20 bp, Artificial Sequence
  sgRNA
  Ccr6_14
ggtgtaggcgaggactttct

SEQ ID NO: 12537 - DNA, 20 bp, Artificial Sequence
  sgRNA
  Ccr6_15
gagtaactgcccagaacggt

SEQ ID NO: 12538 - DNA, 20 bp, Artificial Sequence
  sgRNA
  Ccr6_16
tactcatgccaccaacactt

SEQ ID NO: 12539 - DNA, 20 bp, Artificial Sequence
  sgRNA
  Ccr6_17
atcgtgatgtctgtgagcca

SEQ ID NO: 12540 - DNA, 20 bp, Artificial Sequence
  sgRNA
  Ccr6_18
gaagtttctgacctcttcta

SEQ ID NO: 12541 - DNA, 20 bp, Artificial Sequence
  sgRNA
  Ccr6_19
tatgcggtcaactttaactg

SEQ ID NO: 12542 - DNA, 20 bp, Artificial Sequence
  sgRNA
  Ccr6_20
attctattcctccagaccat

SEQ ID NO: 12543 - DNA, 20 bp, Artificial Sequence
  sgRNA
  Ccr7_1
tttggcgtctacctgtgtaa

SEQ ID NO: 12544 - DNA, 20 bp, Artificial Sequence
  sgRNA
  Ccr7_2
tgacgtacatctatttcaag

SEQ ID NO: 12545 - DNA, 20 bp, Artificial Sequence
  sgRNA
  Ccr7_3
taggaacccaaaaaccatct

SEQ ID NO: 12546 - DNA, 20 bp, Artificial Sequence
  sgRNA
  Ccr7_4
agcggtcaatgctgatgcat

SEQ ID NO: 12547 - DNA, 20 bp, Artificial Sequence
  sgRNA
  Ccr7_5
cctggacgatggctacgtag

SEQ ID NO: 12548 - DNA, 20 bp, Artificial Sequence
  sgRNA
  Ccr7_6
ctacatcggcgagaatacca

SEQ ID NO: 12549 - DNA, 20 bp, Artificial Sequence
  sgRNA
  Ccr7_7
gcttcgctgtaggcccagaa

SEQ ID NO: 12550 - DNA, 20 bp, Artificial Sequence
  sgRNA
  Ccr7_8
attctcgccgatgtagtcat

SEQ ID NO: 12551 - DNA, 20 bp, Artificial Sequence
  sgRNA
  Ccr7_9
ctacctgctcaacctggccg

SEQ ID NO: 12552 - DNA, 20 bp, Artificial Sequence
  sgRNA
  Ccr7_10
ccggcatgtacggaacgcgt

SEQ ID NO: 12553 - DNA, 20 bp, Artificial Sequence
  sgRNA
  Ccr7_11
cagatgacagaatacatgag

SEQ ID NO: 12554 - DNA, 20 bp, Artificial Sequence
  sgRNA
  Ccr7_12
gccaggaccaccccattgta

SEQ ID NO: 12555 - DNA, 20 bp, Artificial Sequence
  sgRNA
  Ccr7_13
gcttgctgatgagaagcacg

SEQ ID NO: 12556 - DNA, 20 bp, Artificial Sequence
  sgRNA
  Ccr7_14
cgcgttccgtacatgccggc

SEQ ID NO: 12557 - DNA, 20 bp, Artificial Sequence
  sgRNA
  Ccr7_15
catcggcgagaataccacgg

SEQ ID NO: 12558 - DNA, 20 bp, Artificial Sequence
  sgRNA
  Ccr7_16
tgccaaagatgcccttacac

SEQ ID NO: 12559 - DNA, 20 bp, Artificial Sequence
  sgRNA
  Ccr7_17
ccgacgcgttccgtacatgc

SEQ ID NO: 12560 - DNA, 20 bp, Artificial Sequence
  sgRNA
  Ccr7_18
tgaagcacaccgactcgtac

SEQ ID NO: 12561 - DNA, 20 bp, Artificial Sequence
  sgRNA
  Ccr7_19
gtacagggtgtagtccaccg

SEQ ID NO: 12562 - DNA, 20 bp, Artificial Sequence
  sgRNA
  Ccr7_20
actggtcagtgcccaagtgg

SEQ ID NO: 12563 - DNA, 20 bp, Artificial Sequence
  sgRNA
  Ccr8_1
tgggactgcgatgtgtaagg

SEQ ID NO: 12564 - DNA, 20 bp, Artificial Sequence
  sgRNA
  Ccr8_2
cttggtaaaaaaccatcaag

SEQ ID NO: 12565 - DNA, 20 bp, Artificial Sequence
  sgRNA
  Ccr8_3
cttcatcaccctaatgagtg

SEQ ID NO: 12566 - DNA, 20 bp, Artificial Sequence
  sgRNA
  Ccr8_4
ccaaggcgttgatttcaaag

SEQ ID NO: 12567 - DNA, 20 bp, Artificial Sequence
  sgRNA
  Ccr8_5
ctatgaacgcgtagatgacg

SEQ ID NO: 12568 - DNA, 20 bp, Artificial Sequence
  sgRNA
  Ccr8_6
ggaggaactctgcgtcacag

SEQ ID NO: 12569 - DNA, 20 bp, Artificial Sequence
  sgRNA
  Ccr8_7
gcatttgtctccctaagtag

SEQ ID NO: 12570 - DNA, 20 bp, Artificial Sequence
  sgRNA
  Ccr8_8
cttagggagacaaatgcccg

SEQ ID NO: 12571 - DNA, 20 bp, Artificial Sequence
  sgRNA
  Ccr8_9
tagtcggtcatcgtgacgtt

SEQ ID NO: 12572 - DNA, 20 bp, Artificial Sequence
  sgRNA
  Ccr8_10
tcgcagtcccaaacacccac

SEQ ID NO: 12573 - DNA, 20 bp, Artificial Sequence
  sgRNA
  Ccr8_11
tcgtgggctgcaagaaactg

SEQ ID NO: 12574 - DNA, 20 bp, Artificial Sequence
  sgRNA
  Ccr8_12
atacctgtccacactcatta

SEQ ID NO: 12575 - DNA, 20 bp, Artificial Sequence
  sgRNA
  Ccr8_13
gacgcagagttcctcctcag

SEQ ID NO: 12576 - DNA, 20 bp, Artificial Sequence
  sgRNA
  Ccr8_14
ctgtctatgccatcaaggtg

SEQ ID NO: 12577 - DNA, 20 bp, Artificial Sequence
  sgRNA
  Ccr8_15
atggatgtgccacgaggcag

SEQ ID NO: 12578 - DNA, 20 bp, Artificial Sequence
  sgRNA
  Ccr8_16
cttctgggtcccattcaacg

SEQ ID NO: 12579 - DNA, 20 bp, Artificial Sequence
  sgRNA
  Ccr8_17
gccacatcttcctctactta

SEQ ID NO: 12580 - DNA, 20 bp, Artificial Sequence
  sgRNA
  Ccr8_18
ctatgccatcaaggtgagga

SEQ ID NO: 12581 - DNA, 20 bp, Artificial Sequence
  sgRNA
  Ccr8_19
ctgcctttccaacgccccca

SEQ ID NO: 12582 - DNA, 20 bp, Artificial Sequence
  sgRNA
  Ccr8_20
tcttggatggatgtgccacg

SEQ ID NO: 12583 - DNA, 20 bp, Artificial Sequence
  sgRNA
  Ccr9_1
tggtattgccacatgtacca

SEQ ID NO: 12584 - DNA, 20 bp, Artificial Sequence
  sgRNA
  Ccr9_2
tctcatcatgtgcatcagtg

SEQ ID NO: 12585 - DNA, 20 bp, Artificial Sequence
  sgRNA
  Ccr9_3
ttgtgcaataccagtagaca

SEQ ID NO: 12586 - DNA, 20 bp, Artificial Sequence
  sgRNA
  Ccr9_4
aggccatgaccataaagggg

SEQ ID NO: 12587 - DNA, 20 bp, Artificial Sequence
  sgRNA
  Ccr9_5
tgttggcgagagattccgaa

SEQ ID NO: 12588 - DNA, 20 bp, Artificial Sequence
  sgRNA
  Ccr9_6
gctactggagacaacttcgg

SEQ ID NO: 12589 - DNA, 20 bp, Artificial Sequence
  sgRNA
  Ccr9_7
gggtcttcaccagatccctt

SEQ ID NO: 12590 - DNA, 20 bp, Artificial Sequence
  sgRNA
  Ccr9_8
gcttggcattcttatcctta

SEQ ID NO: 12591 - DNA, 20 bp, Artificial Sequence
  sgRNA
  Ccr9_9
gtttcattcacaaggagaga

SEQ ID NO: 12592 - DNA, 20 bp, Artificial Sequence
  sgRNA
  Ccr9_10
gcagcagcaatggcccagaa

SEQ ID NO: 12593 - DNA, 20 bp, Artificial Sequence
  sgRNA
  Ccr9_11
gtgaagaccctgaagaacct

SEQ ID NO: 12594 - DNA, 20 bp, Artificial Sequence
  sgRNA
  Ccr9_12
gaactgggttcagacaactg

SEQ ID NO: 12595 - DNA, 20 bp, Artificial Sequence
  sgRNA
  Ccr9_13
agccttcatggcctgtacaa

SEQ ID NO: 12596 - DNA, 20 bp, Artificial Sequence
  sgRNA
  Ccr9_14
cttgatcctgaaggtcacct

SEQ ID NO: 12597 - DNA, 20 bp, Artificial Sequence
  sgRNA
  Ccr9_15
cttatccttagggtagacca

SEQ ID NO: 12598 - DNA, 20 bp, Artificial Sequence
  sgRNA
  Ccr9_16
cagaaggccatgaccataaa

SEQ ID NO: 12599 - DNA, 20 bp, Artificial Sequence
  sgRNA
  Ccr9_17
ttgactgtacaggatttctg

SEQ ID NO: 12600 - DNA, 20 bp, Artificial Sequence
  sgRNA
  Ccr9_18
tgatcctgaaggtcaccttg

SEQ ID NO: 12601 - DNA, 20 bp, Artificial Sequence
  sgRNA
  Ccr9_19
cctgtacagtcaagtcagtg

SEQ ID NO: 12602 - DNA, 20 bp, Artificial Sequence
  sgRNA
  Ccr9_20
ttgttggcgagagattccga

SEQ ID NO: 12603 - DNA, 20 bp, Artificial Sequence
  sgRNA
  Ccrl2_1
gtcagaacgtacttccagag

SEQ ID NO: 12604 - DNA, 20 bp, Artificial Sequence
  sgRNA
  Ccrl2_2
acaccctgtatccttgcaca

SEQ ID NO: 12605 - DNA, 20 bp, Artificial Sequence
  sgRNA
  Ccrl2_3
gaacatctacttcctaaacc

SEQ ID NO: 12606 - DNA, 20 bp, Artificial Sequence
  sgRNA
  Ccrl2_4
atcttcacgacagtgtcttg

SEQ ID NO: 12607 - DNA, 20 bp, Artificial Sequence
  sgRNA
  Ccrl2_5
gacatcatattcatcgtccg

SEQ ID NO: 12608 - DNA, 20 bp, Artificial Sequence
  sgRNA
  Ccrl2_6
taggggatatcattgcaccg

SEQ ID NO: 12609 - DNA, 20 bp, Artificial Sequence
  sgRNA
  Ccrl2_7
gtatgggcccagaacggcag

SEQ ID NO: 12610 - DNA, 20 bp, Artificial Sequence
  sgRNA
  Ccrl2_8
acgactacctggacaacagt

SEQ ID NO: 12611 - DNA, 20 bp, Artificial Sequence
  sgRNA
  Ccrl2_9
gggacctgtaaagttcttgt

SEQ ID NO: 12612 - DNA, 20 bp, Artificial Sequence
  sgRNA
  Ccrl2_10
ctatcagcaagcgcctccaa

SEQ ID NO: 12613 - DNA, 20 bp, Artificial Sequence
  sgRNA
  Ccrl2_11
tgtaaggcgcccacatcaaa

SEQ ID NO: 12614 - DNA, 20 bp, Artificial Sequence
  sgRNA
  Ccrl2_12
gcagcgggttgacgcagcag

SEQ ID NO: 12615 - DNA, 20 bp, Artificial Sequence
  sgRNA
  Ccrl2_13
cctgaacacttgcgtccagg

SEQ ID NO: 12616 - DNA, 20 bp, Artificial Sequence
  sgRNA
  Ccrl2_14
tgtttctgtctttccatccg

SEQ ID NO: 12617 - DNA, 20 bp, Artificial Sequence
  sgRNA
  Ccrl2_15
ggtgctgcagttctgctgcg

SEQ ID NO: 12618 - DNA, 20 bp, Artificial Sequence
  sgRNA
  Ccrl2_16
tgacaagagccggcttgtgg

SEQ ID NO: 12619 - DNA, 20 bp, Artificial Sequence
  sgRNA
  Ccrl2_17
gctgcagtatgggcccagaa

SEQ ID NO: 12620 - DNA, 20 bp, Artificial Sequence
  sgRNA
  Ccrl2_18
gctgcgaaggtatctcataa

SEQ ID NO: 12621 - DNA, 20 bp, Artificial Sequence
  sgRNA
  Ccrl2_19
cagattataaaaaccagcag

SEQ ID NO: 12622 - DNA, 20 bp, Artificial Sequence
  sgRNA
  Ccrl2_20
agtgttcctggaaagcagac

SEQ ID NO: 12623 - DNA, 20 bp, Artificial Sequence
  sgRNA
  Cd101_1
gagatgggtgtgttgcacgg

SEQ ID NO: 12624 - DNA, 20 bp, Artificial Sequence
  sgRNA
  Cd101_2
agaccaccggaaatcctgcg

SEQ ID NO: 12625 - DNA, 20 bp, Artificial Sequence
  sgRNA
  Cd101_3
tgccgagcagcgtactgtgt

SEQ ID NO: 12626 - DNA, 20 bp, Artificial Sequence
  sgRNA
  Cd101_4
ggtgtatcggtgtacagtgg

SEQ ID NO: 12627 - DNA, 20 bp, Artificial Sequence
  sgRNA
  Cd101_5
ttacgcagtgtatgcccaga

SEQ ID NO: 12628 - DNA, 20 bp, Artificial Sequence
  sgRNA
  Cd101_6
gggacgaatttcaaacccct

SEQ ID NO: 12629 - DNA, 20 bp, Artificial Sequence
  sgRNA
  Cd101_7
cttacgcagtgtatgcccag

SEQ ID NO: 12630 - DNA, 20 bp, Artificial Sequence
  sgRNA
  Cd101_8
tactctgtgacatggtaccg

SEQ ID NO: 12631 - DNA, 20 bp, Artificial Sequence
  sgRNA
  Cd101_9
tgaaaggctccagagcccgc

SEQ ID NO: 12632 - DNA, 20 bp, Artificial Sequence
  sgRNA
  Cd101_10
agaggcaatctccagccgaa

SEQ ID NO: 12633 - DNA, 20 bp, Artificial Sequence
  sgRNA
  Cd101_11
agctgccgttctcggtaacg

SEQ ID NO: 12634 - DNA, 20 bp, Artificial Sequence
  sgRNA
  Cd101_12
gccacacacccaacacggat

SEQ ID NO: 12635 - DNA, 20 bp, Artificial Sequence
  sgRNA
  Cd101_13
ccagcatttgactccctgcg

SEQ ID NO: 12636 - DNA, 20 bp, Artificial Sequence
  sgRNA
  Cd101_14
tgtagtgagggccaactact

SEQ ID NO: 12637 - DNA, 20 bp, Artificial Sequence
  sgRNA
  Cd101_15
acaatggcaccgttgaatgg

SEQ ID NO: 12638 - DNA, 20 bp, Artificial Sequence
  sgRNA
  Cd101_16
aagtggactgggccaccttt

SEQ ID NO: 12639 - DNA, 20 bp, Artificial Sequence
  sgRNA
  Cd101_17
gtaccatgtcacagagtata

SEQ ID NO: 12640 - DNA, 20 bp, Artificial Sequence
  sgRNA
  Cd101_18
taagttcagcatcggccaga

SEQ ID NO: 12641 - DNA, 20 bp, Artificial Sequence
  sgRNA
  Cd101_19
cagcggtacctatgaatgca

SEQ ID NO: 12642 - DNA, 20 bp, Artificial Sequence
  sgRNA
  Cd101_20
tatgcagacaggtttgtggc

SEQ ID NO: 12643 - DNA, 20 bp, Artificial Sequence
  sgRNA
  Cd109_1
actgtgacggaatcactcac

SEQ ID NO: 12644 - DNA, 20 bp, Artificial Sequence
  sgRNA
  Cd109_2
agtctaatgtgatccaacag

SEQ ID NO: 12645 - DNA, 20 bp, Artificial Sequence
  sgRNA
  Cd109_3
tttggctagacgcctacatg

SEQ ID NO: 12646 - DNA, 20 bp, Artificial Sequence
  sgRNA
  Cd109_4
ctcaatgagtatcacaacct

SEQ ID NO: 12647 - DNA, 20 bp, Artificial Sequence
  sgRNA
  Cd109_5
cttcaaggaacaatacagcg

SEQ ID NO: 12648 - DNA, 20 bp, Artificial Sequence
  sgRNA
  Cd109_6
gaagactgttcaagttccca

SEQ ID NO: 12649 - DNA, 20 bp, Artificial Sequence
  sgRNA
  Cd109_7
atttcgatgtccacggagcg

SEQ ID NO: 12650 - DNA, 20 bp, Artificial Sequence
  sgRNA
  Cd109_8
atatccaactgaccgtcaca

SEQ ID NO: 12651 - DNA, 20 bp, Artificial Sequence
  sgRNA
  Cd109_9
aaggctcgaagaacgtcgaa

SEQ ID NO: 12652 - DNA, 20 bp, Artificial Sequence
  sgRNA
  Cd109_10
acatgaggacagcttcacct

SEQ ID NO: 12653 - DNA, 20 bp, Artificial Sequence
  sgRNA
  Cd109_11
tgaacacctgagcctttaca

SEQ ID NO: 12654 - DNA, 20 bp, Artificial Sequence
  sgRNA
  Cd109_12
agaacgtcgaagggagtccg

SEQ ID NO: 12655 - DNA, 20 bp, Artificial Sequence
  sgRNA
  Cd109_13
ccaccttctctgcttgtgcg

SEQ ID NO: 12656 - DNA, 20 bp, Artificial Sequence
  sgRNA
  Cd109_14
caagccttataggacatccg

SEQ ID NO: 12657 - DNA, 20 bp, Artificial Sequence
  sgRNA
  Cd109_15
tgttggatcacattagactt

SEQ ID NO: 12658 - DNA, 20 bp, Artificial Sequence
  sgRNA
  Cd109_16
agtgcgaagctacaacaccc

SEQ ID NO: 12659 - DNA, 20 bp, Artificial Sequence
  sgRNA
  Cd109_17
gagtggatacaaaacctccc

SEQ ID NO: 12660 - DNA, 20 bp, Artificial Sequence
  sgRNA
  Cd109_18
gtctggactgaggtaacatg

SEQ ID NO: 12661 - DNA, 20 bp, Artificial Sequence
  sgRNA
  Cd109_19
aactgcaagtcacacacgga

SEQ ID NO: 12662 - DNA, 20 bp, Artificial Sequence
  sgRNA
  Cd109_20
ttagttgattgccatcagag

SEQ ID NO: 12663 - DNA, 20 bp, Artificial Sequence
  sgRNA
  Cd14_1
aatccgactaggaatccgcg

SEQ ID NO: 12664 - DNA, 20 bp, Artificial Sequence
  sgRNA
  Cd14_2
gcagatgtggaattgtacgg

SEQ ID NO: 12665 - DNA, 20 bp, Artificial Sequence
  sgRNA
  Cd14_3
ttgcccacgacacgttgcgg

SEQ ID NO: 12666 - DNA, 20 bp, Artificial Sequence
  sgRNA
  Cd14_4
tggagggtcgggaacttgag

SEQ ID NO: 12667 - DNA, 20 bp, Artificial Sequence
  sgRNA
  Cd14_5
gatgtggaattgtacggcgg

SEQ ID NO: 12668 - DNA, 20 bp, Artificial Sequence
  sgRNA
  Cd14_6
agagccctgcgagctagacg

SEQ ID NO: 12669 - DNA, 20 bp, Artificial Sequence
  sgRNA
  Cd14_7
caacgtgtcgtgggcaacaa

SEQ ID NO: 12670 - DNA, 20 bp, Artificial Sequence
  sgRNA
  Cd14_8
accttagtcacaattcactg

SEQ ID NO: 12671 - DNA, 20 bp, Artificial Sequence
  sgRNA
  Cd14_9
ttgttgcccacgacacgttg

SEQ ID NO: 12672 - DNA, 20 bp, Artificial Sequence
  sgRNA
  Cd14_10
gggccgcgcggattcctagt

SEQ ID NO: 12673 - DNA, 20 bp, Artificial Sequence
  sgRNA
  Cd14_11
agctccatcatcccaagcag

SEQ ID NO: 12674 - DNA, 20 bp, Artificial Sequence
  sgRNA
  Cd14_12
ttgcagctgtacccttgctg

SEQ ID NO: 12675 - DNA, 20 bp, Artificial Sequence
  sgRNA
  Cd14_13
acgcagcgctaaaacttgga

SEQ ID NO: 12676 - DNA, 20 bp, Artificial Sequence
  sgRNA
  Cd14_14
tttggactctgaatcccact

SEQ ID NO: 12677 - DNA, 20 bp, Artificial Sequence
  sgRNA
  Cd14_15
tacgcagcgctaaaacttgg

SEQ ID NO: 12678 - DNA, 20 bp, Artificial Sequence
  sgRNA
  Cd14_16
gctccgaatagaatccgact

SEQ ID NO: 12679 - DNA, 20 bp, Artificial Sequence
  sgRNA
  Cd14_17
ggaaatcccgagcacacgca

SEQ ID NO: 12680 - DNA, 20 bp, Artificial Sequence
  sgRNA
  Cd14_18
cgctcaatctgtctttcact

SEQ ID NO: 12681 - DNA, 20 bp, Artificial Sequence
  sgRNA
  Cd14_19
attcctagtcggattctatt

SEQ ID NO: 12682 - DNA, 20 bp, Artificial Sequence
  sgRNA
  Cd14_20
ccttaaagcggcttacggtg

SEQ ID NO: 12683 - DNA, 20 bp, Artificial Sequence
  sgRNA
  Cd151_1
tacctgctgataatagacat

SEQ ID NO: 12684 - DNA, 20 bp, Artificial Sequence
  sgRNA
  Cd151_2
taccaccagtcaggccacga

SEQ ID NO: 12685 - DNA, 20 bp, Artificial Sequence
  sgRNA
  Cd151_3
agccacggcctacatcttag

SEQ ID NO: 12686 - DNA, 20 bp, Artificial Sequence
  sgRNA
  Cd151_4
gactaatgtagtcactcttg

SEQ ID NO: 12687 - DNA, 20 bp, Artificial Sequence
  sgRNA
  Cd151_5
caccactaagatgtaggccg

SEQ ID NO: 12688 - DNA, 20 bp, Artificial Sequence
  sgRNA
  Cd151_6
gtgccactttcaaggagcga

SEQ ID NO: 12689 - DNA, 20 bp, Artificial Sequence
  sgRNA
  Cd151_7
actaatgtagtcactcttga

SEQ ID NO: 12690 - DNA, 20 bp, Artificial Sequence
  sgRNA
  Cd151_8
gctgataatagacataggcc

SEQ ID NO: 12691 - DNA, 20 bp, Artificial Sequence
  sgRNA
  Cd151_9
cacggcctacatcttagtgg

SEQ ID NO: 12692 - DNA, 20 bp, Artificial Sequence
  sgRNA
  Cd151_10
aagactggcaagacagcgag

SEQ ID NO: 12693 - DNA, 20 bp, Artificial Sequence
  sgRNA
  Cd151_11
tgacagctgctgtaagacta

SEQ ID NO: 12694 - DNA, 20 bp, Artificial Sequence
  sgRNA
  Cd151_12
cttgtaccgaagcctcaagc

SEQ ID NO: 12695 - DNA, 20 bp, Artificial Sequence
  sgRNA
  Cd151_13
ataccaccagtcaggccacg

SEQ ID NO: 12696 - DNA, 20 bp, Artificial Sequence
  sgRNA
  Cd151_14
agttgttgctgccacaacag

SEQ ID NO: 12697 - DNA, 20 bp, Artificial Sequence
  sgRNA
  Cd151_15
catgccgaagacctgcacac

SEQ ID NO: 12698 - DNA, 20 bp, Artificial Sequence
  sgRNA
  Cd151_16
gttccgtcgctccttgaaag

SEQ ID NO: 12699 - DNA, 20 bp, Artificial Sequence
  sgRNA
  Cd151_17
tgccagcaatgatctccagg

SEQ ID NO: 12700 - DNA, 20 bp, Artificial Sequence
  sgRNA
  Cd151_18
tggtgaggcagacagccgcg

SEQ ID NO: 12701 - DNA, 20 bp, Artificial Sequence
  sgRNA
  Cd151_19
ggagaatctgaaggacacca

SEQ ID NO: 12702 - DNA, 20 bp, Artificial Sequence
  sgRNA
  Cd151_20
ccaccgccccaatgacccgc

SEQ ID NO: 12703 - DNA, 20 bp, Artificial Sequence
  sgRNA
  Cd160_1
attgtgaacttccaacatgg

SEQ ID NO: 12704 - DNA, 20 bp, Artificial Sequence
  sgRNA
  Cd160_2
aagctacaccatcagacagt

SEQ ID NO: 12705 - DNA, 20 bp, Artificial Sequence
  sgRNA
  Cd160_3
acaagaaagacgaagctgag

SEQ ID NO: 12706 - DNA, 20 bp, Artificial Sequence
  sgRNA
  Cd160_4
tgtgccacaaagtacaggtg

SEQ ID NO: 12707 - DNA, 20 bp, Artificial Sequence
  sgRNA
  Cd160_5
ggaagttcacaattgccagc

SEQ ID NO: 12708 - DNA, 20 bp, Artificial Sequence
  sgRNA
  Cd160_6
gggcacagcagctttggcca

SEQ ID NO: 12709 - DNA, 20 bp, Artificial Sequence
  sgRNA
  Cd160_7
aattgccagcaggatggcca

SEQ ID NO: 12710 - DNA, 20 bp, Artificial Sequence
  sgRNA
  Cd160_8
gcaattgtgaacttccaaca

SEQ ID NO: 12711 - DNA, 20 bp, Artificial Sequence
  sgRNA
  Cd160_9
gcttctggcacagcactggt

SEQ ID NO: 12712 - DNA, 20 bp, Artificial Sequence
  sgRNA
  Cd160_10
tctggtgcaaagacaatcct

SEQ ID NO: 12713 - DNA, 20 bp, Artificial Sequence
  sgRNA
  Cd160_11
gctcagcatcccagaaagga

SEQ ID NO: 12714 - DNA, 20 bp, Artificial Sequence
  sgRNA
  Cd160_12
agctcagcatcccagaaagg

SEQ ID NO: 12715 - DNA, 20 bp, Artificial Sequence
  sgRNA
  Cd160_13
agaacagcttagggttaaaa

SEQ ID NO: 12716 - DNA, 20 bp, Artificial Sequence
  sgRNA
  Cd160_14
gatgttggtcaccagcctgg

SEQ ID NO: 12717 - DNA, 20 bp, Artificial Sequence
  sgRNA
  Cd160_15
tcctgcaagtaaaggcttgg

SEQ ID NO: 12718 - DNA, 20 bp, Artificial Sequence
  sgRNA
  Cd160_16
cctgacttcagccatatcaa

SEQ ID NO: 12719 - DNA, 20 bp, Artificial Sequence
  sgRNA
  Cd160_17
gcacaagaaagacgaagctg

SEQ ID NO: 12720 - DNA, 20 bp, Artificial Sequence
  sgRNA
  Cd160_18
gtctctgtcttatctctgtg

SEQ ID NO: 12721 - DNA, 20 bp, Artificial Sequence
  sgRNA
  Cd160_19
caagctacaccatcagacag

SEQ ID NO: 12722 - DNA, 20 bp, Artificial Sequence
  sgRNA
  Cd160_20
ctgttctaagttggtctcag

SEQ ID NO: 12723 - DNA, 20 bp, Artificial Sequence
  sgRNA
  Cd163_1
acctgtccttcggaacacgt

SEQ ID NO: 12724 - DNA, 20 bp, Artificial Sequence
  sgRNA
  Cd163_2
gtacaagttctgtctagcgg

SEQ ID NO: 12725 - DNA, 20 bp, Artificial Sequence
  sgRNA
  Cd163_3
ctctgggactgcaaacaccg

SEQ ID NO: 12726 - DNA, 20 bp, Artificial Sequence
  sgRNA
  Cd163_4
aaactggggcaacaaatacg

SEQ ID NO: 12727 - DNA, 20 bp, Artificial Sequence
  sgRNA
  Cd163_5
gggattgtcctgccaaaccg

SEQ ID NO: 12728 - DNA, 20 bp, Artificial Sequence
  sgRNA
  Cd163_6
aagagtggaggtctaccacg

SEQ ID NO: 12729 - DNA, 20 bp, Artificial Sequence
  sgRNA
  Cd163_7
agagtggaggtctaccacga

SEQ ID NO: 12730 - DNA, 20 bp, Artificial Sequence
  sgRNA
  Cd163_8
cttccacacgaccagagcat

SEQ ID NO: 12731 - DNA, 20 bp, Artificial Sequence
  sgRNA
  Cd163_9
gctggagttagcccatccaa

SEQ ID NO: 12732 - DNA, 20 bp, Artificial Sequence
  sgRNA
  Cd163_10
gttgcccaatctattccaga

SEQ ID NO: 12733 - DNA, 20 bp, Artificial Sequence
  sgRNA
  Cd163_11
acaaaccaagagtgccgtga

SEQ ID NO: 12734 - DNA, 20 bp, Artificial Sequence
  sgRNA
  Cd163_12
gagcatgaatgaagtgtccg

SEQ ID NO: 12735 - DNA, 20 bp, Artificial Sequence
  sgRNA
  Cd163_13
gtttggcaggacaatcccac

SEQ ID NO: 12736 - DNA, 20 bp, Artificial Sequence
  sgRNA
  Cd163_14
acaaaataagactccaggaa

SEQ ID NO: 12737 - DNA, 20 bp, Artificial Sequence
  sgRNA
  Cd163_15
tctgtggtgtgcaagcaact

SEQ ID NO: 12738 - DNA, 20 bp, Artificial Sequence
  sgRNA
  Cd163_16
tttggcaggacaatcccaca

SEQ ID NO: 12739 - DNA, 20 bp, Artificial Sequence
  sgRNA
  Cd163_17
gggactgcaaacatgatggg

SEQ ID NO: 12740 - DNA, 20 bp, Artificial Sequence
  sgRNA
  Cd163_18
ggtcgtgtggaagtgaaaca

SEQ ID NO: 12741 - DNA, 20 bp, Artificial Sequence
  sgRNA
  Cd163_19
cacaaaccaagagtgccgtg

SEQ ID NO: 12742 - DNA, 20 bp, Artificial Sequence
  sgRNA
  Cd163_20
tcagaatcacatcatggcac

SEQ ID NO: 12743 - DNA, 20 bp, Artificial Sequence
  sgRNA
  Cd163l1_1
ggtgctggttcgacaccaag

SEQ ID NO: 12744 - DNA, 20 bp, Artificial Sequence
  sgRNA
  Cd163l1_2
tgggaaatgagtcttcgttg

SEQ ID NO: 12745 - DNA, 20 bp, Artificial Sequence
  sgRNA
  Cd163l1_3
ctcaacaacaagctacgcgg

SEQ ID NO: 12746 - DNA, 20 bp, Artificial Sequence
  sgRNA
  Cd163l1_4
cagacatatttcattgtgtg

SEQ ID NO: 12747 - DNA, 20 bp, Artificial Sequence
  sgRNA
  Cd163l1_5
agactcaacaacaagctacg

SEQ ID NO: 12748 - DNA, 20 bp, Artificial Sequence
  sgRNA
  Cd163l1_6
gccccaaagtgagcattccg

SEQ ID NO: 12749 - DNA, 20 bp, Artificial Sequence
  sgRNA
  Cd163l1_7
ggacctgcatggcgccagcg

SEQ ID NO: 12750 - DNA, 20 bp, Artificial Sequence
  sgRNA
  Cd163l1_8
gctgctattccactgccccc

SEQ ID NO: 12751 - DNA, 20 bp, Artificial Sequence
  sgRNA
  Cd163l1_9
cccaggcgtcatccaatacg

SEQ ID NO: 12752 - DNA, 20 bp, Artificial Sequence
  sgRNA
  Cd163l1_10
tcaccaaaatgtcctcctgg

SEQ ID NO: 12753 - DNA, 20 bp, Artificial Sequence
  sgRNA
  Cd163l1_11
agaccacttgtgcatcctgt

SEQ ID NO: 12754 - DNA, 20 bp, Artificial Sequence
  sgRNA
  Cd163l1_12
gcgtcacgcaaggtcccagc

SEQ ID NO: 12755 - DNA, 20 bp, Artificial Sequence
  sgRNA
  Cd163l1_13
tcctggttatgattgctcag

SEQ ID NO: 12756 - DNA, 20 bp, Artificial Sequence
  sgRNA
  Cd163l1_14
ggacgcctggaggttcttcg

SEQ ID NO: 12757 - DNA, 20 bp, Artificial Sequence
  sgRNA
  Cd163l1_15
gacacaaccatgggccccca

SEQ ID NO: 12758 - DNA, 20 bp, Artificial Sequence
  sgRNA
  Cd163l1_16
gagttggtgacagagaacca

SEQ ID NO: 12759 - DNA, 20 bp, Artificial Sequence
  sgRNA
  Cd163l1_17
gcggccccatgaaccatcca

SEQ ID NO: 12760 - DNA, 20 bp, Artificial Sequence
  sgRNA
  Cd163l1_18
acatgactgcagacacaagg

SEQ ID NO: 12761 - DNA, 20 bp, Artificial Sequence
  sgRNA
  Cd163l1_19
acacaacctcggcatccacc

SEQ ID NO: 12762 - DNA, 20 bp, Artificial Sequence
  sgRNA
  Cd163l1_20
gacgcccacatcttgacggg

SEQ ID NO: 12763 - DNA, 20 bp, Artificial Sequence
  sgRNA
  Cd164_1
caagtcagtgcggttcacct

SEQ ID NO: 12764 - DNA, 20 bp, Artificial Sequence
  sgRNA
  Cd164_2
ttgcgtcgtcgggaccactt

SEQ ID NO: 12765 - DNA, 20 bp, Artificial Sequence
  sgRNA
  Cd164_3
ggtcggcacctcggtcacgt

SEQ ID NO: 12766 - DNA, 20 bp, Artificial Sequence
  sgRNA
  Cd164_4
ttggcaatgtaaccaaaagc

SEQ ID NO: 12767 - DNA, 20 bp, Artificial Sequence
  sgRNA
  Cd164_5
cagttaggagtaattggacg

SEQ ID NO: 12768 - DNA, 20 bp, Artificial Sequence
  sgRNA
  Cd164_6
ccgagacgcagagcacggcg

SEQ ID NO: 12769 - DNA, 20 bp, Artificial Sequence
  sgRNA
  Cd164_7
acagctgttgaagctcgcac

SEQ ID NO: 12770 - DNA, 20 bp, Artificial Sequence
  sgRNA
  Cd164_8
ggtggtgatgttgggctgcg

SEQ ID NO: 12771 - DNA, 20 bp, Artificial Sequence
  sgRNA
  Cd164_9
attactcctaactgccaccg

SEQ ID NO: 12772 - DNA, 20 bp, Artificial Sequence
  sgRNA
  Cd164_10
cctggctcccaacgtgaccg

SEQ ID NO: 12773 - DNA, 20 bp, Artificial Sequence
  sgRNA
  Cd164_11
tcaaaggtcgacttccgctc

SEQ ID NO: 12774 - DNA, 20 bp, Artificial Sequence
  sgRNA
  Cd164_12
gcagcccaacatcaccaccc

SEQ ID NO: 12775 - DNA, 20 bp, Artificial Sequence
  sgRNA
  Cd164_13
cgacttccgctcaggctggg

SEQ ID NO: 12776 - DNA, 20 bp, Artificial Sequence
  sgRNA
  Cd164_14
ggtggtcgtggtcggcacct

SEQ ID NO: 12777 - DNA, 20 bp, Artificial Sequence
  sgRNA
  Cd164_15
gccgaccacgaccaccaaag

SEQ ID NO: 12778 - DNA, 20 bp, Artificial Sequence
  sgRNA
  Cd164_16
cagcctgcacacccaagaca

SEQ ID NO: 12779 - DNA, 20 bp, Artificial Sequence
  sgRNA
  Cd164_17
gatgcagccagcttcattgg

SEQ ID NO: 12780 - DNA, 20 bp, Artificial Sequence
  sgRNA
  Cd164_18
atgcagccagcttcattgga

SEQ ID NO: 12781 - DNA, 20 bp, Artificial Sequence
  sgRNA
  Cd164_19
gttggcactggagtggtagg

SEQ ID NO: 12782 - DNA, 20 bp, Artificial Sequence
  sgRNA
  Cd164_20
cggtggcagttaggagtaat

SEQ ID NO: 12783 - DNA, 20 bp, Artificial Sequence
  sgRNA
  Cd164l2_1
cgtttggcctactacccaag

SEQ ID NO: 12784 - DNA, 20 bp, Artificial Sequence
  sgRNA
  Cd164l2_2
attaccagctagaaccagct

SEQ ID NO: 12785 - DNA, 20 bp, Artificial Sequence
  sgRNA
  Cd164l2_3
tctcccaccaggacactgtg

SEQ ID NO: 12786 - DNA, 20 bp, Artificial Sequence
  sgRNA
  Cd164l2_4
gggacactgtgaacactgtg

SEQ ID NO: 12787 - DNA, 20 bp, Artificial Sequence
  sgRNA
  Cd164l2_5
tagtaggccaaacgttcagg

SEQ ID NO: 12788 - DNA, 20 bp, Artificial Sequence
  sgRNA
  Cd164l2_6
acgtttggcctactacccaa

SEQ ID NO: 12789 - DNA, 20 bp, Artificial Sequence
  sgRNA
  Cd164l2_7
agctagctccatcaaaacct

SEQ ID NO: 12790 - DNA, 20 bp, Artificial Sequence
  sgRNA
  Cd164l2_8
agagagcagcacgcaaggcg

SEQ ID NO: 12791 - DNA, 20 bp, Artificial Sequence
  sgRNA
  Cd164l2_9
ttcccatcatcattccacag

SEQ ID NO: 12792 - DNA, 20 bp, Artificial Sequence
  sgRNA
  Cd164l2_10
gtttggcctactacccaagg

SEQ ID NO: 12793 - DNA, 20 bp, Artificial Sequence
  sgRNA
  Cd164l2_11
agagcagcacgcaaggcgcg

SEQ ID NO: 12794 - DNA, 20 bp, Artificial Sequence
  sgRNA
  Cd164l2_12
gcttcgcttcctcaaggcca

SEQ ID NO: 12795 - DNA, 20 bp, Artificial Sequence
  sgRNA
  Cd164l2_13
caagggggctgcaaacacct

SEQ ID NO: 12796 - DNA, 20 bp, Artificial Sequence
  sgRNA
  Cd164l2_14
ttgcgtgctgctctctgcgg

SEQ ID NO: 12797 - DNA, 20 bp, Artificial Sequence
  sgRNA
  Cd164l2_15
atccctgaagaccacagccc

SEQ ID NO: 12798 - DNA, 20 bp, Artificial Sequence
  sgRNA
  Cd164l2_16
acattgctgccagacacaaa

SEQ ID NO: 12799 - DNA, 20 bp, Artificial Sequence
  sgRNA
  Cd164l2_17
ccaaacgttcaggcggagca

SEQ ID NO: 12800 - DNA, 20 bp, Artificial Sequence
  sgRNA
  Cd164l2_18
gatggagctagcttcattgg

SEQ ID NO: 12801 - DNA, 20 bp, Artificial Sequence
  sgRNA
  Cd164l2_19
tgatggagctagcttcattg

SEQ ID NO: 12802 - DNA, 20 bp, Artificial Sequence
  sgRNA
  Cd164l2_20
caagctgaagtggtcaagga

SEQ ID NO: 12803 - DNA, 20 bp, Artificial Sequence
  sgRNA
  Cd177_1
atggcgacacacacgggtgt

SEQ ID NO: 12804 - DNA, 20 bp, Artificial Sequence
  sgRNA
  Cd177_2
gtctaagcttacctcccctg

SEQ ID NO: 12805 - DNA, 20 bp, Artificial Sequence
  sgRNA
  Cd177_3
cattacagaagtccctgtcg

SEQ ID NO: 12806 - DNA, 20 bp, Artificial Sequence
  sgRNA
  Cd177_4
gaaaacctgcgaggttagcg

SEQ ID NO: 12807 - DNA, 20 bp, Artificial Sequence
  sgRNA
  Cd177_5
aaaacctgcgaggttagcga

SEQ ID NO: 12808 - DNA, 20 bp, Artificial Sequence
  sgRNA
  Cd177_6
atacaaggtcccaatcgcct

SEQ ID NO: 12809 - DNA, 20 bp, Artificial Sequence
  sgRNA
  Cd177_7
ctgtcaagtggacggcacca

SEQ ID NO: 12810 - DNA, 20 bp, Artificial Sequence
  sgRNA
  Cd177_8
gcagtcctcacgcacatcca

SEQ ID NO: 12811 - DNA, 20 bp, Artificial Sequence
  sgRNA
  Cd177_9
catccaggccgatagccgta

SEQ ID NO: 12812 - DNA, 20 bp, Artificial Sequence
  sgRNA
  Cd177_10
ggaccaagaggccaaagtca

SEQ ID NO: 12813 - DNA, 20 bp, Artificial Sequence
  sgRNA
  Cd177_11
gcagcgctcgctcacatcca

SEQ ID NO: 12814 - DNA, 20 bp, Artificial Sequence
  sgRNA
  Cd177_12
cggagcacagaactggacca

SEQ ID NO: 12815 - DNA, 20 bp, Artificial Sequence
  sgRNA
  Cd177_13
aggaccaatctcaaggtgca

SEQ ID NO: 12816 - DNA, 20 bp, Artificial Sequence
  sgRNA
  Cd177_14
tagccgtaaggtccaggcca

SEQ ID NO: 12817 - DNA, 20 bp, Artificial Sequence
  sgRNA
  Cd177_15
aggacaccacagagagccca

SEQ ID NO: 12818 - DNA, 20 bp, Artificial Sequence
  sgRNA
  Cd177_16
ggttgaggaccaagagccga

SEQ ID NO: 12819 - DNA, 20 bp, Artificial Sequence
  sgRNA
  Cd177_17
gtgatgtttgagcttggcaa

SEQ ID NO: 12820 - DNA, 20 bp, Artificial Sequence
  sgRNA
  Cd177_18
tatcgaagctgcctctccag

SEQ ID NO: 12821 - DNA, 20 bp, Artificial Sequence
  sgRNA
  Cd177_19
gggatatgaacaaaaaggct

SEQ ID NO: 12822 - DNA, 20 bp, Artificial Sequence
  sgRNA
  Cd177_20
caaggccgtgacccccagaa

SEQ ID NO: 12823 - DNA, 20 bp, Artificial Sequence
  sgRNA
  Cd180_1
aacacgaagagacttgagct

SEQ ID NO: 12824 - DNA, 20 bp, Artificial Sequence
  sgRNA
  Cd180_2
gtctctgccataaatatcag

SEQ ID NO: 12825 - DNA, 20 bp, Artificial Sequence
  sgRNA
  Cd180_3
ttcacagagaccctcaaaca

SEQ ID NO: 12826 - DNA, 20 bp, Artificial Sequence
  sgRNA
  Cd180_4
acattgcaggaatagagctg

SEQ ID NO: 12827 - DNA, 20 bp, Artificial Sequence
  sgRNA
  Cd180_5
tgaacccctgagcctcaaga

SEQ ID NO: 12828 - DNA, 20 bp, Artificial Sequence
  sgRNA
  Cd180_6
actacaggatagcgtgacat

SEQ ID NO: 12829 - DNA, 20 bp, Artificial Sequence
  sgRNA
  Cd180_7
gagaagatctacttacctga

SEQ ID NO: 12830 - DNA, 20 bp, Artificial Sequence
  sgRNA
  Cd180_8
aatctaggagttctagctga

SEQ ID NO: 12831 - DNA, 20 bp, Artificial Sequence
  sgRNA
  Cd180_9
gctgacatccagtagcattg

SEQ ID NO: 12832 - DNA, 20 bp, Artificial Sequence
  sgRNA
  Cd180_10
ctacttacctgacggaaaat

SEQ ID NO: 12833 - DNA, 20 bp, Artificial Sequence
  sgRNA
  Cd180_11
gcgaaaatcccccattgctg

SEQ ID NO: 12834 - DNA, 20 bp, Artificial Sequence
  sgRNA
  Cd180_12
tttgagcaagtgcagtcaag

SEQ ID NO: 12835 - DNA, 20 bp, Artificial Sequence
  sgRNA
  Cd180_13
gatgatgctgatgcgattgg

SEQ ID NO: 12836 - DNA, 20 bp, Artificial Sequence
  sgRNA
  Cd180_14
tgtcacgctatcctgtagta

SEQ ID NO: 12837 - DNA, 20 bp, Artificial Sequence
  sgRNA
  Cd180_15
actgcacaatcaaaaaacct

SEQ ID NO: 12838 - DNA, 20 bp, Artificial Sequence
  sgRNA
  Cd180_16
aggctcttagtcatcttaag

SEQ ID NO: 12839 - DNA, 20 bp, Artificial Sequence
  sgRNA
  Cd180_17
tcaccttcctggatttaacc

SEQ ID NO: 12840 - DNA, 20 bp, Artificial Sequence
  sgRNA
  Cd180_18
tcctccattaagctccccaa

SEQ ID NO: 12841 - DNA, 20 bp, Artificial Sequence
  sgRNA
  Cd180_19
cttgatggaaaggtgagtaa

SEQ ID NO: 12842 - DNA, 20 bp, Artificial Sequence
  sgRNA
  Cd180_20
tccgagatagagactttcca

SEQ ID NO: 12843 - DNA, 20 bp, Artificial Sequence
  sgRNA
  Cd19_1
gaatgactgaccccgccagg

SEQ ID NO: 12844 - DNA, 20 bp, Artificial Sequence
  sgRNA
  Cd19_2
aatgtctcagaccatatggg

SEQ ID NO: 12845 - DNA, 20 bp, Artificial Sequence
  sgRNA
  Cd19_3
ggcacctattattgtctccg

SEQ ID NO: 12846 - DNA, 20 bp, Artificial Sequence
  sgRNA
  Cd19_4
tttagcccacacatacagct

SEQ ID NO: 12847 - DNA, 20 bp, Artificial Sequence
  sgRNA
  Cd19_5
tggtggatggatagtcccag

SEQ ID NO: 12848 - DNA, 20 bp, Artificial Sequence
  sgRNA
  Cd19_6
ggagctgaggagctgcatag

SEQ ID NO: 12849 - DNA, 20 bp, Artificial Sequence
  sgRNA
  Cd19_7
gattcaaactgctcccccga

SEQ ID NO: 12850 - DNA, 20 bp, Artificial Sequence
  sgRNA
  Cd19_8
catatactaaagtcaccact

SEQ ID NO: 12851 - DNA, 20 bp, Artificial Sequence
  sgRNA
  Cd19_9
tgattcaaactgctcccccg

SEQ ID NO: 12852 - DNA, 20 bp, Artificial Sequence
  sgRNA
  Cd19_10
gttctgggtcccgtttcccg

SEQ ID NO: 12853 - DNA, 20 bp, Artificial Sequence
  sgRNA
  Cd19_11
tgacgacctagaaccagcat

SEQ ID NO: 12854 - DNA, 20 bp, Artificial Sequence
  sgRNA
  Cd19_12
ttctgggtcccgtttcccga

SEQ ID NO: 12855 - DNA, 20 bp, Artificial Sequence
  sgRNA
  Cd19_13
ccacgtgcaatcccaggcca

SEQ ID NO: 12856 - DNA, 20 bp, Artificial Sequence
  sgRNA
  Cd19_14
aagcctgtatgtgcccctcg

SEQ ID NO: 12857 - DNA, 20 bp, Artificial Sequence
  sgRNA
  Cd19_15
ctactgagcctaagccttgg

SEQ ID NO: 12858 - DNA, 20 bp, Artificial Sequence
  sgRNA
  Cd19_16
agtggacctgtggctcccag

SEQ ID NO: 12859 - DNA, 20 bp, Artificial Sequence
  sgRNA
  Cd19_17
aggtctcctaggatgcacat

SEQ ID NO: 12860 - DNA, 20 bp, Artificial Sequence
  sgRNA
  Cd19_18
attcaaactgctcccccgag

SEQ ID NO: 12861 - DNA, 20 bp, Artificial Sequence
  sgRNA
  Cd19_19
ggcacgtgaaggtcattgca

SEQ ID NO: 12862 - DNA, 20 bp, Artificial Sequence
  sgRNA
  Cd19_20
ggatgagcccatgggtccag

SEQ ID NO: 12863 - DNA, 20 bp, Artificial Sequence
  sgRNA
  Cd1d1_1
ggagaccacggacaaatagg

SEQ ID NO: 12864 - DNA, 20 bp, Artificial Sequence
  sgRNA
  Cd1d1_2
ctggtcccgcacagacagcg

SEQ ID NO: 12865 - DNA, 20 bp, Artificial Sequence
  sgRNA
  Cd1d1_3
aaatatgtcgtgagattctg

SEQ ID NO: 12866 - DNA, 20 bp, Artificial Sequence
  sgRNA
  Cd1d1_4
tggcttcgtgaagctgatgg

SEQ ID NO: 12867 - DNA, 20 bp, Artificial Sequence
  sgRNA
  Cd1d1_5
gtcattcaggagcatctgca

SEQ ID NO: 12868 - DNA, 20 bp, Artificial Sequence
  sgRNA
  Cd1d1_6
aatgcccacagcaacagcca

SEQ ID NO: 12869 - DNA, 20 bp, Artificial Sequence
  sgRNA
  Cd1d1_7
acctgccccctatttgtccg

SEQ ID NO: 12870 - DNA, 20 bp, Artificial Sequence
  sgRNA
  Cd1d1_8
aggaagacatctgcaggcag

SEQ ID NO: 12871 - DNA, 20 bp, Artificial Sequence
  sgRNA
  Cd1d1_9
gcgggctgtgaaatgtaccc

SEQ ID NO: 12872 - DNA, 20 bp, Artificial Sequence
  sgRNA
  Cd1d1_10
gtcctggcagacagtcccag

SEQ ID NO: 12873 - DNA, 20 bp, Artificial Sequence
  sgRNA
  Cd1d1_11
atttgtccgtggtctcctag

SEQ ID NO: 12874 - DNA, 20 bp, Artificial Sequence
  sgRNA
  Cd1d1_12
cgtcctggcagacagtccca

SEQ ID NO: 12875 - DNA, 20 bp, Artificial Sequence
  sgRNA
  Cd1d1_13
tccgtggtctcctagaggca

SEQ ID NO: 12876 - DNA, 20 bp, Artificial Sequence
  sgRNA
  Cd1d1_14
ggaccagcttctgtttgcaa

SEQ ID NO: 12877 - DNA, 20 bp, Artificial Sequence
  sgRNA
  Cd1d1_15
ccagctctgcacatggccat

SEQ ID NO: 12878 - DNA, 20 bp, Artificial Sequence
  sgRNA
  Cd1d1_16
attgagatccagctgtctgc

SEQ ID NO: 12879 - DNA, 20 bp, Artificial Sequence
  sgRNA
  Cd1d1_17
ctaggagaccacggacaaat

SEQ ID NO: 12880 - DNA, 20 bp, Artificial Sequence
  sgRNA
  Cd1d1_18
gcttctacccaaaacctgtg

SEQ ID NO: 12881 - DNA, 20 bp, Artificial Sequence
  sgRNA
  Cd1d1_19
gcagacagctggatctcaat

SEQ ID NO: 12882 - DNA, 20 bp, Artificial Sequence
  sgRNA
  Cd1d1_20
agacatctgcaggcagcgga

SEQ ID NO: 12883 - DNA, 20 bp, Artificial Sequence
  sgRNA
  Cd1d2_1
ggaccagcttatgttagcaa

SEQ ID NO: 12884 - DNA, 20 bp, Artificial Sequence
  sgRNA
  Cd1d2_2
gtaggaatgcccacagcaac

SEQ ID NO: 12885 - DNA, 20 bp, Artificial Sequence
  sgRNA
  Cd1d2_3
aaatatgccgtgagattccg

SEQ ID NO: 12886 - DNA, 20 bp, Artificial Sequence
  sgRNA
  Cd1d2_4
attgagatccagttgtctac

SEQ ID NO: 12887 - DNA, 20 bp, Artificial Sequence
  sgRNA
  Cd1d2_5
atcttggcagagggtcctag

SEQ ID NO: 12888 - DNA, 20 bp, Artificial Sequence
  sgRNA
  Cd1d2_6
agacgctcctgaatgacacc

SEQ ID NO: 12889 - DNA, 20 bp, Artificial Sequence
  sgRNA
  Cd1d2_7
aatgcccacagcaacaggca

SEQ ID NO: 12890 - DNA, 20 bp, Artificial Sequence
  sgRNA
  Cd1d2_8
gtttgcccgtggtctcctag

SEQ ID NO: 12891 - DNA, 20 bp, Artificial Sequence
  sgRNA
  Cd1d2_9
gtcattcaggagcgtctgca

SEQ ID NO: 12892 - DNA, 20 bp, Artificial Sequence
  sgRNA
  Cd1d2_10
agacagcctgatcttgctgg

SEQ ID NO: 12893 - DNA, 20 bp, Artificial Sequence
  sgRNA
  Cd1d2_11
tcatcagcttcacgaagcca

SEQ ID NO: 12894 - DNA, 20 bp, Artificial Sequence
  sgRNA
  Cd1d2_12
gtagacaactggatctcaat

SEQ ID NO: 12895 - DNA, 20 bp, Artificial Sequence
  sgRNA
  Cd1d2_13
agaagtctgcaggcagcgga

SEQ ID NO: 12896 - DNA, 20 bp, Artificial Sequence
  sgRNA
  Cd1d2_14
ggtagacaactggatctcaa

SEQ ID NO: 12897 - DNA, 20 bp, Artificial Sequence
  sgRNA
  Cd1d2_15
cccagggtacatttcacagc

SEQ ID NO: 12898 - DNA, 20 bp, Artificial Sequence
  sgRNA
  Cd1d2_16
acctggccccagtttgcccg

SEQ ID NO: 12899 - DNA, 20 bp, Artificial Sequence
  sgRNA
  Cd1d2_17
tttcacagccggtagacaac

SEQ ID NO: 12900 - DNA, 20 bp, Artificial Sequence
  sgRNA
  Cd1d2_18
accggctgtgaaatgtaccc

SEQ ID NO: 12901 - DNA, 20 bp, Artificial Sequence
  sgRNA
  Cd1d2_19
gcaagatcaggctgtctgtg

SEQ ID NO: 12902 - DNA, 20 bp, Artificial Sequence
  sgRNA
  Cd1d2_20
tggcttcgtgaagctgatga

SEQ ID NO: 12903 - DNA, 20 bp, Artificial Sequence
  sgRNA
  Cd2_1
ccgatgatgagaaacgacag

SEQ ID NO: 12904 - DNA, 20 bp, Artificial Sequence
  sgRNA
  Cd2_2
gaacgcaccattcaagtgtg

SEQ ID NO: 12905 - DNA, 20 bp, Artificial Sequence
  sgRNA
  Cd2_3
tgatattgatgaggtgcgat

SEQ ID NO: 12906 - DNA, 20 bp, Artificial Sequence
  sgRNA
  Cd2_4
agagacaatgagaccatctg

SEQ ID NO: 12907 - DNA, 20 bp, Artificial Sequence
  sgRNA
  Cd2_5
gcgccaccaagagcaccaag

SEQ ID NO: 12908 - DNA, 20 bp, Artificial Sequence
  sgRNA
  Cd2_6
gctggtgctcacgggtacgg

SEQ ID NO: 12909 - DNA, 20 bp, Artificial Sequence
  sgRNA
  Cd2_7
gtccttctatgtcacagtgg

SEQ ID NO: 12910 - DNA, 20 bp, Artificial Sequence
  sgRNA
  Cd2_8
ggtcagcaaggagtctaaga

SEQ ID NO: 12911 - DNA, 20 bp, Artificial Sequence
  sgRNA
  Cd2_9
ctcaaagcccatgatccact

SEQ ID NO: 12912 - DNA, 20 bp, Artificial Sequence
  sgRNA
  Cd2_10
gttcagccaaaacctccctg

SEQ ID NO: 12913 - DNA, 20 bp, Artificial Sequence
  sgRNA
  Cd2_11
agaagaacatgagttaccag

SEQ ID NO: 12914 - DNA, 20 bp, Artificial Sequence
  sgRNA
  Cd2_12
caagtgtgaggcgataaacc

SEQ ID NO: 12915 - DNA, 20 bp, Artificial Sequence
  sgRNA
  Cd2_13
cttcttctgctggtgctcac

SEQ ID NO: 12916 - DNA, 20 bp, Artificial Sequence
  sgRNA
  Cd2_14
gcaagaggagaaaacggaac

SEQ ID NO: 12917 - DNA, 20 bp, Artificial Sequence
  sgRNA
  Cd2_15
gtatctgcaagaggagaaaa

SEQ ID NO: 12918 - DNA, 20 bp, Artificial Sequence
  sgRNA
  Cd2_16
ttctatgtcacagtgggggt

SEQ ID NO: 12919 - DNA, 20 bp, Artificial Sequence
  sgRNA
  Cd2_17
tttatcgcctcacacttgaa

SEQ ID NO: 12920 - DNA, 20 bp, Artificial Sequence
  sgRNA
  Cd2_18
acaccatctccactcccaca

SEQ ID NO: 12921 - DNA, 20 bp, Artificial Sequence
  sgRNA
  Cd2_19
gctgcggctggggttgagtg

SEQ ID NO: 12922 - DNA, 20 bp, Artificial Sequence
  sgRNA
  Cd2_20
gtttctgatatcaaaaaagg

SEQ ID NO: 12923 - DNA, 20 bp, Artificial Sequence
  sgRNA
  Cd200_1
aggaacccttgattgtgaca

SEQ ID NO: 12924 - DNA, 20 bp, Artificial Sequence
  sgRNA
  Cd200_2
cacctacagcaaaacccatg

SEQ ID NO: 12925 - DNA, 20 bp, Artificial Sequence
  sgRNA
  Cd200_3
ttgtagtgaaggtgtactat

SEQ ID NO: 12926 - DNA, 20 bp, Artificial Sequence
  sgRNA
  Cd200_4
gccccaaatcaggctgtagg

SEQ ID NO: 12927 - DNA, 20 bp, Artificial Sequence
  sgRNA
  Cd200_5
tgtagtcaatcacattcccc

SEQ ID NO: 12928 - DNA, 20 bp, Artificial Sequence
  sgRNA
  Cd200_6
gagcggggtgaatcatcaca

SEQ ID NO: 12929 - DNA, 20 bp, Artificial Sequence
  sgRNA
  Cd200_7
aacgtcaccgaaatcaggag

SEQ ID NO: 12930 - DNA, 20 bp, Artificial Sequence
  sgRNA
  Cd200_8
caccttctggaacacaacat

SEQ ID NO: 12931 - DNA, 20 bp, Artificial Sequence
  sgRNA
  Cd200_9
ttctgccatgtcacaatcaa

SEQ ID NO: 12932 - DNA, 20 bp, Artificial Sequence
  sgRNA
  Cd200_10
caggctggattacaacccca

SEQ ID NO: 12933 - DNA, 20 bp, Artificial Sequence
  sgRNA
  Cd200_11
cagatgtagtcccatttgaa

SEQ ID NO: 12934 - DNA, 20 bp, Artificial Sequence
  sgRNA
  Cd200_12
aagaccccaaaactcaagtt

SEQ ID NO: 12935 - DNA, 20 bp, Artificial Sequence
  sgRNA
  Cd200_13
gttgtagtgaaggtgtacta

SEQ ID NO: 12936 - DNA, 20 bp, Artificial Sequence
  sgRNA
  Cd200_14
gtacccttccaggagatggc

SEQ ID NO: 12937 - DNA, 20 bp, Artificial Sequence
  sgRNA
  Cd200_15
gcccctgccatctcctggaa

SEQ ID NO: 12938 - DNA, 20 bp, Artificial Sequence
  sgRNA
  Cd200_16
gaaacaatgcttagcaacag

SEQ ID NO: 12939 - DNA, 20 bp, Artificial Sequence
  sgRNA
  Cd200_17
tcacctacagcaaaacccat

SEQ ID NO: 12940 - DNA, 20 bp, Artificial Sequence
  sgRNA
  Cd200_18
agagtcacttccattcaaat

SEQ ID NO: 12941 - DNA, 20 bp, Artificial Sequence
  sgRNA
  Cd200_19
ctacagcctgatttggggca

SEQ ID NO: 12942 - DNA, 20 bp, Artificial Sequence
  sgRNA
  Cd200_20
atttgaatggaagtgactct

SEQ ID NO: 12943 - DNA, 20 bp, Artificial Sequence
  sgRNA
  Cd200r1_1
acatggataataaagctcag

SEQ ID NO: 12944 - DNA, 20 bp, Artificial Sequence
  sgRNA
  Cd200r1_2
agttcatctcctctgacaca

SEQ ID NO: 12945 - DNA, 20 bp, Artificial Sequence
  sgRNA
  Cd200r1_3
ggttacttcagggggcactg

SEQ ID NO: 12946 - DNA, 20 bp, Artificial Sequence
  sgRNA
  Cd200r1_4
tgtcaggagcacatgccact

SEQ ID NO: 12947 - DNA, 20 bp, Artificial Sequence
  sgRNA
  Cd200r1_5
gtatcacaaggcgaagtcaa

SEQ ID NO: 12948 - DNA, 20 bp, Artificial Sequence
  sgRNA
  Cd200r1_6
ccatattaagagcactgcta

SEQ ID NO: 12949 - DNA, 20 bp, Artificial Sequence
  sgRNA
  Cd200r1_7
agcagtgctcttaatatggg

SEQ ID NO: 12950 - DNA, 20 bp, Artificial Sequence
  sgRNA
  Cd200r1_8
actacagtgtctgtacagat

SEQ ID NO: 12951 - DNA, 20 bp, Artificial Sequence
  sgRNA
  Cd200r1_9
agctacttcagctattgagg

SEQ ID NO: 12952 - DNA, 20 bp, Artificial Sequence
  sgRNA
  Cd200r1_10
ctagcagtgctcttaatatg

SEQ ID NO: 12953 - DNA, 20 bp, Artificial Sequence
  sgRNA
  Cd200r1_11
gcagtgaccctccagcatga

SEQ ID NO: 12954 - DNA, 20 bp, Artificial Sequence
  sgRNA
  Cd200r1_12
ctatgatactgtgactaagg

SEQ ID NO: 12955 - DNA, 20 bp, Artificial Sequence
  sgRNA
  Cd200r1_13
tagcagtgctcttaatatgg

SEQ ID NO: 12956 - DNA, 20 bp, Artificial Sequence
  sgRNA
  Cd200r1_14
tgatactgtgactaaggtgg

SEQ ID NO: 12957 - DNA, 20 bp, Artificial Sequence
  sgRNA
  Cd200r1_15
ttctctgtatagctagcata

SEQ ID NO: 12958 - DNA, 20 bp, Artificial Sequence
  sgRNA
  Cd200r1_16
gtctgtacagataggtacaa

SEQ ID NO: 12959 - DNA, 20 bp, Artificial Sequence
  sgRNA
  Cd200r1_17
ttagtcacagtatcatagag

SEQ ID NO: 12960 - DNA, 20 bp, Artificial Sequence
  sgRNA
  Cd200r1_18
cagatctcttggtctccaga

SEQ ID NO: 12961 - DNA, 20 bp, Artificial Sequence
  sgRNA
  Cd200r1_19
acgagtgaatcacacagcaa

SEQ ID NO: 12962 - DNA, 20 bp, Artificial Sequence
  sgRNA
  Cd200r1_20
gtgagacagtaacacctgaa

SEQ ID NO: 12963 - DNA, 20 bp, Artificial Sequence
  sgRNA
  Cd200r2_1
acagacactatggtgtacac

SEQ ID NO: 12964 - DNA, 20 bp, Artificial Sequence
  sgRNA
  Cd200r2_2
tgaagtaacctactttctcg

SEQ ID NO: 12965 - DNA, 20 bp, Artificial Sequence
  sgRNA
  Cd200r2_3
tcctgaccttcagatcagtg

SEQ ID NO: 12966 - DNA, 20 bp, Artificial Sequence
  sgRNA
  Cd200r2_4
tgtgagataacaacacctga

SEQ ID NO: 12967 - DNA, 20 bp, Artificial Sequence
  sgRNA
  Cd200r2_5
aagatcagcaaagtcaaagc

SEQ ID NO: 12968 - DNA, 20 bp, Artificial Sequence
  sgRNA
  Cd200r2_6
gtgagataacaacacctgaa

SEQ ID NO: 12969 - DNA, 20 bp, Artificial Sequence
  sgRNA
  Cd200r2_7
tgaccttcagatcagtgcgg

SEQ ID NO: 12970 - DNA, 20 bp, Artificial Sequence
  sgRNA
  Cd200r2_8
tgcattgtctctcattcgac

SEQ ID NO: 12971 - DNA, 20 bp, Artificial Sequence
  sgRNA
  Cd200r2_9
tactttgtaggccattatgc

SEQ ID NO: 12972 - DNA, 20 bp, Artificial Sequence
  sgRNA
  Cd200r2_10
ttgtaggccattatgcagga

SEQ ID NO: 12973 - DNA, 20 bp, Artificial Sequence
  sgRNA
  Cd200r2_11
gagaccaatgaaacctgctt

SEQ ID NO: 12974 - DNA, 20 bp, Artificial Sequence
  sgRNA
  Cd200r2_12
tgtcaggagcacttgccact

SEQ ID NO: 12975 - DNA, 20 bp, Artificial Sequence
  sgRNA
  Cd200r2_13
aggccagccttcctgcataa

SEQ ID NO: 12976 - DNA, 20 bp, Artificial Sequence
  sgRNA
  Cd200r2_14
acatggataataaagcccag

SEQ ID NO: 12977 - DNA, 20 bp, Artificial Sequence
  sgRNA
  Cd200r2_15
gagaaagtaggttacttcag

SEQ ID NO: 12978 - DNA, 20 bp, Artificial Sequence
  sgRNA
  Cd200r2_16
gagaatggtcagcaaggaag

SEQ ID NO: 12979 - DNA, 20 bp, Artificial Sequence
  sgRNA
  Cd200r2_17
aatggtcagcaaggaagggg

SEQ ID NO: 12980 - DNA, 20 bp, Artificial Sequence
  sgRNA
  Cd200r2_18
gcggtggccctccagcatga

SEQ ID NO: 12981 - DNA, 20 bp, Artificial Sequence
  sgRNA
  Cd200r2_19
cgagaaagtaggttacttca

SEQ ID NO: 12982 - DNA, 20 bp, Artificial Sequence
  sgRNA
  Cd200r2_20
ggagaccaatgaaacctgct

SEQ ID NO: 12983 - DNA, 20 bp, Artificial Sequence
  sgRNA
  Cd200r3_1
gtgatgtgcagggaccctag

SEQ ID NO: 12984 - DNA, 20 bp, Artificial Sequence
  sgRNA
  Cd200r3_2
aaaggaaatgaatcatccgg

SEQ ID NO: 12985 - DNA, 20 bp, Artificial Sequence
  sgRNA
  Cd200r3_3
gtcggatagaaacaacagat

SEQ ID NO: 12986 - DNA, 20 bp, Artificial Sequence
  sgRNA
  Cd200r3_4
ctgtagggtagtctgcagga

SEQ ID NO: 12987 - DNA, 20 bp, Artificial Sequence
  sgRNA
  Cd200r3_5
aggacgggaggagatcccac

SEQ ID NO: 12988 - DNA, 20 bp, Artificial Sequence
  sgRNA
  Cd200r3_6
tgatggagtgggcgtcacca

SEQ ID NO: 12989 - DNA, 20 bp, Artificial Sequence
  sgRNA
  Cd200r3_7
aaggaaatgaatcatccggt

SEQ ID NO: 12990 - DNA, 20 bp, Artificial Sequence
  sgRNA
  Cd200r3_8
ctctccatggaacagaatcg

SEQ ID NO: 12991 - DNA, 20 bp, Artificial Sequence
  sgRNA
  Cd200r3_9
gctgtaactgttctcatcgt

SEQ ID NO: 12992 - DNA, 20 bp, Artificial Sequence
  sgRNA
  Cd200r3_10
gtaatgcccatcatgcttga

SEQ ID NO: 12993 - DNA, 20 bp, Artificial Sequence
  sgRNA
  Cd200r3_11
tgtcggatagaaacaacaga

SEQ ID NO: 12994 - DNA, 20 bp, Artificial Sequence
  sgRNA
  Cd200r3_12
tactgagagaggaaccacta

SEQ ID NO: 12995 - DNA, 20 bp, Artificial Sequence
  sgRNA
  Cd200r3_13
tgaccttcccatcaaatcaa

SEQ ID NO: 12996 - DNA, 20 bp, Artificial Sequence
  sgRNA
  Cd200r3_14
ttgttcagtgaaaggacggg

SEQ ID NO: 12997 - DNA, 20 bp, Artificial Sequence
  sgRNA
  Cd200r3_15
tgctgcaactctgctctgta

SEQ ID NO: 12998 - DNA, 20 bp, Artificial Sequence
  sgRNA
  Cd200r3_16
agataaagcagaacacactg

SEQ ID NO: 12999 - DNA, 20 bp, Artificial Sequence
  sgRNA
  Cd200r3_17
ttgagggccattgatttgat

SEQ ID NO: 13000 - DNA, 20 bp, Artificial Sequence
  sgRNA
  Cd200r3_18
tgtcaggagcaagtgccaca

SEQ ID NO: 13001 - DNA, 20 bp, Artificial Sequence
  sgRNA
  Cd200r3_19
gtactgagagaggaaccact

SEQ ID NO: 13002 - DNA, 20 bp, Artificial Sequence
  sgRNA
  Cd200r3_20
gatcttgtggactccagatg

SEQ ID NO: 13003 - DNA, 20 bp, Artificial Sequence
  sgRNA
  Cd200r4_1
taaatgcagtattaatcaca

SEQ ID NO: 13004 - DNA, 20 bp, Artificial Sequence
  sgRNA
  Cd200r4_2
tgaacttcagatcagtgcag

SEQ ID NO: 13005 - DNA, 20 bp, Artificial Sequence
  sgRNA
  Cd200r4_3
agttcatcttctctgacaca

SEQ ID NO: 13006 - DNA, 20 bp, Artificial Sequence
  sgRNA
  Cd200r4_4
ctgaggtaacctactttcca

SEQ ID NO: 13007 - DNA, 20 bp, Artificial Sequence
  sgRNA
  Cd200r4_5
aatggtcagcaaggaacggg

SEQ ID NO: 13008 - DNA, 20 bp, Artificial Sequence
  sgRNA
  Cd200r4_6
ctgtccatagaactgagtca

SEQ ID NO: 13009 - DNA, 20 bp, Artificial Sequence
  sgRNA
  Cd200r4_7
gaatggtcagcaaggaacgg

SEQ ID NO: 13010 - DNA, 20 bp, Artificial Sequence
  sgRNA
  Cd200r4_8
agaatggtcagcaaggaacg

SEQ ID NO: 13011 - DNA, 20 bp, Artificial Sequence
  sgRNA
  Cd200r4_9
tgcttagtctctcattcgac

SEQ ID NO: 13012 - DNA, 20 bp, Artificial Sequence
  sgRNA
  Cd200r4_10
gtgagatagtaacacctgaa

SEQ ID NO: 13013 - DNA, 20 bp, Artificial Sequence
  sgRNA
  Cd200r4_11
gtgattattcttcttaacgt

SEQ ID NO: 13014 - DNA, 20 bp, Artificial Sequence
  sgRNA
  Cd200r4_12
aagatcagcaaagtcaaagt

SEQ ID NO: 13015 - DNA, 20 bp, Artificial Sequence
  sgRNA
  Cd200r4_13
agtcgaatgagagactaagc

SEQ ID NO: 13016 - DNA, 20 bp, Artificial Sequence
  sgRNA
  Cd200r4_14
tgtgagatagtaacacctga

SEQ ID NO: 13017 - DNA, 20 bp, Artificial Sequence
  sgRNA
  Cd200r4_15
ctggaaagtaggttacctca

SEQ ID NO: 13018 - DNA, 20 bp, Artificial Sequence
  sgRNA
  Cd200r4_16
tggaaagtaggttacctcag

SEQ ID NO: 13019 - DNA, 20 bp, Artificial Sequence
  sgRNA
  Cd200r4_17
ggaaagtaggttacctcagg

SEQ ID NO: 13020 - DNA, 20 bp, Artificial Sequence
  sgRNA
  Cd200r4_18
attaatactgcatttatcag

SEQ ID NO: 13021 - DNA, 20 bp, Artificial Sequence
  sgRNA
  Cd200r4_19
gtctgtacagatggataaaa

SEQ ID NO: 13022 - DNA, 20 bp, Artificial Sequence
  sgRNA
  Cd200r4_20
taggttgtatgctattgtgc

SEQ ID NO: 13023 - DNA, 20 bp, Artificial Sequence
  sgRNA
  Cd209f_1
agctgcaaatgagaccctcg

SEQ ID NO: 13024 - DNA, 20 bp, Artificial Sequence
  sgRNA
  Cd209f_2
tcagtcaaagaatcatggtg

SEQ ID NO: 13025 - DNA, 20 bp, Artificial Sequence
  sgRNA
  Cd209f_3
tgagaagcagcagaagccag

SEQ ID NO: 13026 - DNA, 20 bp, Artificial Sequence
  sgRNA
  Cd209f_4
ggccccgagatcctcgcagg

SEQ ID NO: 13027 - DNA, 20 bp, Artificial Sequence
  sgRNA
  Cd209f_5
tgacggagatgaggactgcg

SEQ ID NO: 13028 - DNA, 20 bp, Artificial Sequence
  sgRNA
  Cd209f_6
tgaggccgatccaggagcgt

SEQ ID NO: 13029 - DNA, 20 bp, Artificial Sequence
  sgRNA
  Cd209f_7
tgaaggttcctggcagtggg

SEQ ID NO: 13030 - DNA, 20 bp, Artificial Sequence
  sgRNA
  Cd209f_8
gagggggaacctaacaatga

SEQ ID NO: 13031 - DNA, 20 bp, Artificial Sequence
  sgRNA
  Cd209f_9
cttcatgtatatggtcactg

SEQ ID NO: 13032 - DNA, 20 bp, Artificial Sequence
  sgRNA
  Cd209f_10
tcctcatctccgtcattgtt

SEQ ID NO: 13033 - DNA, 20 bp, Artificial Sequence
  sgRNA
  Cd209f_11
gctgccgtccacccactgcc

SEQ ID NO: 13034 - DNA, 20 bp, Artificial Sequence
  sgRNA
  Cd209f_12
ggagctgcaaatgagaccct

SEQ ID NO: 13035 - DNA, 20 bp, Artificial Sequence
  sgRNA
  Cd209f_13
ggactgcgtggagctgttca

SEQ ID NO: 13036 - DNA, 20 bp, Artificial Sequence
  sgRNA
  Cd209f_14
tggagctgttcatggatgat

SEQ ID NO: 13037 - DNA, 20 bp, Artificial Sequence
  sgRNA
  Cd209f_15
gccaggaaccttcatgtata

SEQ ID NO: 13038 - DNA, 20 bp, Artificial Sequence
  sgRNA
  Cd209f_16
aaaaaccaacgctcctggat

SEQ ID NO: 13039 - DNA, 20 bp, Artificial Sequence
  sgRNA
  Cd209f_17
tacatgaaggttcctggcag

SEQ ID NO: 13040 - DNA, 20 bp, Artificial Sequence
  sgRNA
  Cd209f_18
acctaacaatgacggagatg

SEQ ID NO: 13041 - DNA, 20 bp, Artificial Sequence
  sgRNA
  Cd209f_19
agtgcactgaacagaacttt

SEQ ID NO: 13042 - DNA, 20 bp, Artificial Sequence
  sgRNA
  Cd209f_20
gagctgcaaatgagaccctc

SEQ ID NO: 13043 - DNA, 20 bp, Artificial Sequence
  sgRNA
  Cd209g_1
aggattcgtgcatactcaca

SEQ ID NO: 13044 - DNA, 20 bp, Artificial Sequence
  sgRNA
  Cd209g_2
tcagaaagaatcagctcacc

SEQ ID NO: 13045 - DNA, 20 bp, Artificial Sequence
  sgRNA
  Cd209g_3
cctcgggagcagacacactc

SEQ ID NO: 13046 - DNA, 20 bp, Artificial Sequence
  sgRNA
  Cd209g_4
cactgttgacaatcaccagg

SEQ ID NO: 13047 - DNA, 20 bp, Artificial Sequence
  sgRNA
  Cd209g_5
agaagttgtttgcagtacaa

SEQ ID NO: 13048 - DNA, 20 bp, Artificial Sequence
  sgRNA
  Cd209g_6
ggacgaggactgcgtggtaa

SEQ ID NO: 13049 - DNA, 20 bp, Artificial Sequence
  sgRNA
  Cd209g_7
ggtgtcatctacccactgcc

SEQ ID NO: 13050 - DNA, 20 bp, Artificial Sequence
  sgRNA
  Cd209g_8
tgaaggggacgaggactgcg

SEQ ID NO: 13051 - DNA, 20 bp, Artificial Sequence
  sgRNA
  Cd209g_9
aggggagcccaataatgaag

SEQ ID NO: 13052 - DNA, 20 bp, Artificial Sequence
  sgRNA
  Cd209g_10
ctgggtctgtgagcagccct

SEQ ID NO: 13053 - DNA, 20 bp, Artificial Sequence
  sgRNA
  Cd209g_11
aaggggagcccaataatgaa

SEQ ID NO: 13054 - DNA, 20 bp, Artificial Sequence
  sgRNA
  Cd209g_12
cttcacttctgtgatcgctg

SEQ ID NO: 13055 - DNA, 20 bp, Artificial Sequence
  sgRNA
  Cd209g_13
aagaatcagctcacctggat

SEQ ID NO: 13056 - DNA, 20 bp, Artificial Sequence
  sgRNA
  Cd209g_14
ttgtactgcaaacaacttct

SEQ ID NO: 13057 - DNA, 20 bp, Artificial Sequence
  sgRNA
  Cd209g_15
gcccaataatgaaggggacg

SEQ ID NO: 13058 - DNA, 20 bp, Artificial Sequence
  sgRNA
  Cd209g_16
gaaggggagcccaataatga

SEQ ID NO: 13059 - DNA, 20 bp, Artificial Sequence
  sgRNA
  Cd209g_17
tcctcgtccccttcattatt

SEQ ID NO: 13060 - DNA, 20 bp, Artificial Sequence
  sgRNA
  Cd209g_18
aagtgaaggttcctggcagt

SEQ ID NO: 13061 - DNA, 20 bp, Artificial Sequence
  sgRNA
  Cd209g_19
gaagtgaaggttcctggcag

SEQ ID NO: 13062 - DNA, 20 bp, Artificial Sequence
  sgRNA
  Cd209g_20
tggtaatggcagaagataaa

SEQ ID NO: 13063 - DNA, 20 bp, Artificial Sequence
  sgRNA
  Cd22_1
gtaattcccagcatgccacg

SEQ ID NO: 13064 - DNA, 20 bp, Artificial Sequence
  sgRNA
  Cd22_2
cgatacgtgccaatgacagt

SEQ ID NO: 13065 - DNA, 20 bp, Artificial Sequence
  sgRNA
  Cd22_3
cagcgcggatctctgatgcg

SEQ ID NO: 13066 - DNA, 20 bp, Artificial Sequence
  sgRNA
  Cd22_4
gtacaaaactccactaccca

SEQ ID NO: 13067 - DNA, 20 bp, Artificial Sequence
  sgRNA
  Cd22_5
gggatgctacaatccggcaa

SEQ ID NO: 13068 - DNA, 20 bp, Artificial Sequence
  sgRNA
  Cd22_6
tgtgaatccgagctgcccgg

SEQ ID NO: 13069 - DNA, 20 bp, Artificial Sequence
  sgRNA
  Cd22_7
gcatccctaaagtctccccg

SEQ ID NO: 13070 - DNA, 20 bp, Artificial Sequence
  sgRNA
  Cd22_8
gcttccaacgacataggccc

SEQ ID NO: 13071 - DNA, 20 bp, Artificial Sequence
  sgRNA
  Cd22_9
gcgcaagatggcataactaa

SEQ ID NO: 13072 - DNA, 20 bp, Artificial Sequence
  sgRNA
  Cd22_10
ggcacttcacactctttccg

SEQ ID NO: 13073 - DNA, 20 bp, Artificial Sequence
  sgRNA
  Cd22_11
tgaccgcagggactgaacga

SEQ ID NO: 13074 - DNA, 20 bp, Artificial Sequence
  sgRNA
  Cd22_12
gggcttcaggaaaattccag

SEQ ID NO: 13075 - DNA, 20 bp, Artificial Sequence
  sgRNA
  Cd22_13
tgactgtccctcttcagcgg

SEQ ID NO: 13076 - DNA, 20 bp, Artificial Sequence
  sgRNA
  Cd22_14
ggagtctcgtgcaggaaggg

SEQ ID NO: 13077 - DNA, 20 bp, Artificial Sequence
  sgRNA
  Cd22_15
ggtacagctcagcaaatgat

SEQ ID NO: 13078 - DNA, 20 bp, Artificial Sequence
  sgRNA
  Cd22_16
ccactgtcattggcacgtat

SEQ ID NO: 13079 - DNA, 20 bp, Artificial Sequence
  sgRNA
  Cd22_17
cttgaaccaagacaccgcca

SEQ ID NO: 13080 - DNA, 20 bp, Artificial Sequence
  sgRNA
  Cd22_18
gcttccatctaaggatcaag

SEQ ID NO: 13081 - DNA, 20 bp, Artificial Sequence
  sgRNA
  Cd22_19
tcagtaccttcacgtctctg

SEQ ID NO: 13082 - DNA, 20 bp, Artificial Sequence
  sgRNA
  Cd22_20
agttcctgtgaatttcttgg

SEQ ID NO: 13083 - DNA, 20 bp, Artificial Sequence
  sgRNA
  Cd226_1
attgacgcataacttaaccc

SEQ ID NO: 13084 - DNA, 20 bp, Artificial Sequence
  sgRNA
  Cd226_2
acttcctaaactcaacagtg

SEQ ID NO: 13085 - DNA, 20 bp, Artificial Sequence
  sgRNA
  Cd226_3
gctaagatgtctacctgatg

SEQ ID NO: 13086 - DNA, 20 bp, Artificial Sequence
  sgRNA
  Cd226_4
tgcagacaggtagctatccg

SEQ ID NO: 13087 - DNA, 20 bp, Artificial Sequence
  sgRNA
  Cd226_5
gcagacaggtagctatccga

SEQ ID NO: 13088 - DNA, 20 bp, Artificial Sequence
  sgRNA
  Cd226_6
ttaggaagtgtactctatgg

SEQ ID NO: 13089 - DNA, 20 bp, Artificial Sequence
  sgRNA
  Cd226_7
gctttctgagactatgactc

SEQ ID NO: 13090 - DNA, 20 bp, Artificial Sequence
  sgRNA
  Cd226_8
gacgcataacttaacccagg

SEQ ID NO: 13091 - DNA, 20 bp, Artificial Sequence
  sgRNA
  Cd226_9
acacttcctaaactcaacag

SEQ ID NO: 13092 - DNA, 20 bp, Artificial Sequence
  sgRNA
  Cd226_10
ggaaaaagtccagccccatc

SEQ ID NO: 13093 - DNA, 20 bp, Artificial Sequence
  sgRNA
  Cd226_11
ttatccttcccatcgttgga

SEQ ID NO: 13094 - DNA, 20 bp, Artificial Sequence
  sgRNA
  Cd226_12
ggaaccccactgttgagttt

SEQ ID NO: 13095 - DNA, 20 bp, Artificial Sequence
  sgRNA
  Cd226_13
acaaggagcaactgtagcca

SEQ ID NO: 13096 - DNA, 20 bp, Artificial Sequence
  sgRNA
  Cd226_14
gaaactaaccctccaacgat

SEQ ID NO: 13097 - DNA, 20 bp, Artificial Sequence
  sgRNA
  Cd226_15
gttcttggtccactccacct

SEQ ID NO: 13098 - DNA, 20 bp, Artificial Sequence
  sgRNA
  Cd226_16
actttacagatgtcgctcag

SEQ ID NO: 13099 - DNA, 20 bp, Artificial Sequence
  sgRNA
  Cd226_17
ctaaccctccaacgatggga

SEQ ID NO: 13100 - DNA, 20 bp, Artificial Sequence
  sgRNA
  Cd226_18
tgttgcactggccaagtcct

SEQ ID NO: 13101 - DNA, 20 bp, Artificial Sequence
  sgRNA
  Cd226_19
cctcatcattccaaatgcca

SEQ ID NO: 13102 - DNA, 20 bp, Artificial Sequence
  sgRNA
  Cd226_20
aattccacttaaagagccca

SEQ ID NO: 13103 - DNA, 20 bp, Artificial Sequence
  sgRNA
  Cd244a_1
tgacaagtcccattagtcca

SEQ ID NO: 13104 - DNA, 20 bp, Artificial Sequence
  sgRNA
  Cd244a_2
attagtccagggcttccact

SEQ ID NO: 13105 - DNA, 20 bp, Artificial Sequence
  sgRNA
  Cd244a_3
acatggtgcctctatctcca

SEQ ID NO: 13106 - DNA, 20 bp, Artificial Sequence
  sgRNA
  Cd244a_4
ccatcttcctggacagccga

SEQ ID NO: 13107 - DNA, 20 bp, Artificial Sequence
  sgRNA
  Cd244a_5
cttaagttgtaccgtgtacg

SEQ ID NO: 13108 - DNA, 20 bp, Artificial Sequence
  sgRNA
  Cd244a_6
cgagccagcagggatcaaca

SEQ ID NO: 13109 - DNA, 20 bp, Artificial Sequence
  sgRNA
  Cd244a_7
ggatcaacaaggatgctcta

SEQ ID NO: 13110 - DNA, 20 bp, Artificial Sequence
  sgRNA
  Cd244a_8
gattcttctgaagaagtggt

SEQ ID NO: 13111 - DNA, 20 bp, Artificial Sequence
  sgRNA
  Cd244a_9
atattgtcaaaggttcctta

SEQ ID NO: 13112 - DNA, 20 bp, Artificial Sequence
  sgRNA
  Cd244a_10
gtcaatctggttctcccagt

SEQ ID NO: 13113 - DNA, 20 bp, Artificial Sequence
  sgRNA
  Cd244a_11
gtgagctacgctttgtacag

SEQ ID NO: 13114 - DNA, 20 bp, Artificial Sequence
  sgRNA
  Cd244a_12
caaggactcacgagccagca

SEQ ID NO: 13115 - DNA, 20 bp, Artificial Sequence
  sgRNA
  Cd244a_13
tcaaggactcacgagccagc

SEQ ID NO: 13116 - DNA, 20 bp, Artificial Sequence
  sgRNA
  Cd244a_14
tcaaagctcacaaccctgcc

SEQ ID NO: 13117 - DNA, 20 bp, Artificial Sequence
  sgRNA
  Cd244a_15
tgagctacgctttgtacaga

SEQ ID NO: 13118 - DNA, 20 bp, Artificial Sequence
  sgRNA
  Cd244a_16
cgtcaatctggttctcccag

SEQ ID NO: 13119 - DNA, 20 bp, Artificial Sequence
  sgRNA
  Cd244a_17
tcaaaggaatagtacccact

SEQ ID NO: 13120 - DNA, 20 bp, Artificial Sequence
  sgRNA
  Cd244a_18
gcactgtatcatagagtaca

SEQ ID NO: 13121 - DNA, 20 bp, Artificial Sequence
  sgRNA
  Cd244a_19
gctgtccaggaagatgggag

SEQ ID NO: 13122 - DNA, 20 bp, Artificial Sequence
  sgRNA
  Cd244a_20
cccctaacctgaaggcccag

SEQ ID NO: 13123 - DNA, 20 bp, Artificial Sequence
  sgRNA
  Cd248_1
gcttccgtctagcagcagat

SEQ ID NO: 13124 - DNA, 20 bp, Artificial Sequence
  sgRNA
  Cd248_2
ggggcaacctggccacaccg

SEQ ID NO: 13125 - DNA, 20 bp, Artificial Sequence
  sgRNA
  Cd248_3
actcatccgtgtccacgcag

SEQ ID NO: 13126 - DNA, 20 bp, Artificial Sequence
  sgRNA
  Cd248_4
ctataggcccaacttcccac

SEQ ID NO: 13127 - DNA, 20 bp, Artificial Sequence
  sgRNA
  Cd248_5
gcgtgtagctgaaataacag

SEQ ID NO: 13128 - DNA, 20 bp, Artificial Sequence
  sgRNA
  Cd248_6
ggatgatccacaccgctgcg

SEQ ID NO: 13129 - DNA, 20 bp, Artificial Sequence
  sgRNA
  Cd248_7
gctcccacgcacccaacaag

SEQ ID NO: 13130 - DNA, 20 bp, Artificial Sequence
  sgRNA
  Cd248_8
gcagccagcggtcatccctt

SEQ ID NO: 13131 - DNA, 20 bp, Artificial Sequence
  sgRNA
  Cd248_9
agtgcagtacacaatgccca

SEQ ID NO: 13132 - DNA, 20 bp, Artificial Sequence
  sgRNA
  Cd248_10
gctgctgtggagggcaccga

SEQ ID NO: 13133 - DNA, 20 bp, Artificial Sequence
  sgRNA
  Cd248_11
tccaggaatgtgcggcgccg

SEQ ID NO: 13134 - DNA, 20 bp, Artificial Sequence
  sgRNA
  Cd248_12
cgagtggcagagatcaccat

SEQ ID NO: 13135 - DNA, 20 bp, Artificial Sequence
  sgRNA
  Cd248_13
agagcctcagagattgcacc

SEQ ID NO: 13136 - DNA, 20 bp, Artificial Sequence
  sgRNA
  Cd248_14
cagagcccctctagtcccaa

SEQ ID NO: 13137 - DNA, 20 bp, Artificial Sequence
  sgRNA
  Cd248_15
tagttggttgagataatggg

SEQ ID NO: 13138 - DNA, 20 bp, Artificial Sequence
  sgRNA
  Cd248_16
gctttagaagtggtatcccc

SEQ ID NO: 13139 - DNA, 20 bp, Artificial Sequence
  sgRNA
  Cd248_17
tgcaagacctgactctgcca

SEQ ID NO: 13140 - DNA, 20 bp, Artificial Sequence
  sgRNA
  Cd248_18
tggtttccagcgagttcgaa

SEQ ID NO: 13141 - DNA, 20 bp, Artificial Sequence
  sgRNA
  Cd248_19
cccaatccatagcagcccgt

SEQ ID NO: 13142 - DNA, 20 bp, Artificial Sequence
  sgRNA
  Cd248_20
gatcacggactgctatcgct

SEQ ID NO: 13143 - DNA, 20 bp, Artificial Sequence
  sgRNA
  Cd27_1
tctctccagactaccacacc

SEQ ID NO: 13144 - DNA, 20 bp, Artificial Sequence
  sgRNA
  Cd27_2
tgctgcatacctgtgccatg

SEQ ID NO: 13145 - DNA, 20 bp, Artificial Sequence
  sgRNA
  Cd27_3
agacaaacactactggactg

SEQ ID NO: 13146 - DNA, 20 bp, Artificial Sequence
  sgRNA
  Cd27_4
ctcaggtacattctttgtga

SEQ ID NO: 13147 - DNA, 20 bp, Artificial Sequence
  sgRNA
  Cd27_5
ggaagaacaagattgcaccc

SEQ ID NO: 13148 - DNA, 20 bp, Artificial Sequence
  sgRNA
  Cd27_6
ggaacagctgcactcagcat

SEQ ID NO: 13149 - DNA, 20 bp, Artificial Sequence
  sgRNA
  Cd27_7
actcgactgtctatagccag

SEQ ID NO: 13150 - DNA, 20 bp, Artificial Sequence
  sgRNA
  Cd27_8
gatgcagtccgagctgcaca

SEQ ID NO: 13151 - DNA, 20 bp, Artificial Sequence
  sgRNA
  Cd27_9
atggctgtctggtcagtgca

SEQ ID NO: 13152 - DNA, 20 bp, Artificial Sequence
  sgRNA
  Cd27_10
ggtagctgagagtcctacca

SEQ ID NO: 13153 - DNA, 20 bp, Artificial Sequence
  sgRNA
  Cd27_11
atgcagtccgagctgcacag

SEQ ID NO: 13154 - DNA, 20 bp, Artificial Sequence
  sgRNA
  Cd27_12
cagtgctatccctatccagg

SEQ ID NO: 13155 - DNA, 20 bp, Artificial Sequence
  sgRNA
  Cd27_13
ctggctatagacagtcgagt

SEQ ID NO: 13156 - DNA, 20 bp, Artificial Sequence
  sgRNA
  Cd27_14
gctgtccagacaaacactac

SEQ ID NO: 13157 - DNA, 20 bp, Artificial Sequence
  sgRNA
  Cd27_15
gtgccatgaggtaagtgggt

SEQ ID NO: 13158 - DNA, 20 bp, Artificial Sequence
  sgRNA
  Cd27_16
ttacagctgccccagggaag

SEQ ID NO: 13159 - DNA, 20 bp, Artificial Sequence
  sgRNA
  Cd27_17
tccatcaaagaagaaaccac

SEQ ID NO: 13160 - DNA, 20 bp, Artificial Sequence
  sgRNA
  Cd27_18
gtggtagtctggagagaagg

SEQ ID NO: 13161 - DNA, 20 bp, Artificial Sequence
  sgRNA
  Cd27_19
gtcagtgcagggtttagagg

SEQ ID NO: 13162 - DNA, 20 bp, Artificial Sequence
  sgRNA
  Cd27_20
tcagtgcagggtttagagga

SEQ ID NO: 13163 - DNA, 20 bp, Artificial Sequence
  sgRNA
  Cd274_1
tgctgcataatcagctacgg

SEQ ID NO: 13164 - DNA, 20 bp, Artificial Sequence
  sgRNA
  Cd274_2
tccaaaggacttgtacgtgg

SEQ ID NO: 13165 - DNA, 20 bp, Artificial Sequence
  sgRNA
  Cd274_3
ctcagcacagcaacttcagg

SEQ ID NO: 13166 - DNA, 20 bp, Artificial Sequence
  sgRNA
  Cd274_4
gcttgcgttagtggtgtact

SEQ ID NO: 13167 - DNA, 20 bp, Artificial Sequence
  sgRNA
  Cd274_5
gtatggcagcaacgtcacga

SEQ ID NO: 13168 - DNA, 20 bp, Artificial Sequence
  sgRNA
  Cd274_6
ggtccagctcccgttctaca

SEQ ID NO: 13169 - DNA, 20 bp, Artificial Sequence
  sgRNA
  Cd274_7
gaactaatatgtcaggccga

SEQ ID NO: 13170 - DNA, 20 bp, Artificial Sequence
  sgRNA
  Cd274_8
aatcaaccagagaatttccg

SEQ ID NO: 13171 - DNA, 20 bp, Artificial Sequence
  sgRNA
  Cd274_9
agtacaccactaacgcaagc

SEQ ID NO: 13172 - DNA, 20 bp, Artificial Sequence
  sgRNA
  Cd274_10
tattagttcatgctcagaag

SEQ ID NO: 13173 - DNA, 20 bp, Artificial Sequence
  sgRNA
  Cd274_11
gtagaaaacatcattcgctg

SEQ ID NO: 13174 - DNA, 20 bp, Artificial Sequence
  sgRNA
  Cd274_12
tgaactaatatgtcaggccg

SEQ ID NO: 13175 - DNA, 20 bp, Artificial Sequence
  sgRNA
  Cd274_13
ggctccaaaggacttgtacg

SEQ ID NO: 13176 - DNA, 20 bp, Artificial Sequence
  sgRNA
  Cd274_14
gccagggcaaaaccacacag

SEQ ID NO: 13177 - DNA, 20 bp, Artificial Sequence
  sgRNA
  Cd274_15
agtgcagattccctgtagaa

SEQ ID NO: 13178 - DNA, 20 bp, Artificial Sequence
  sgRNA
  Cd274_16
cgagggttatccagaagctg

SEQ ID NO: 13179 - DNA, 20 bp, Artificial Sequence
  sgRNA
  Cd274_17
cagtgagtcctgttctgtgg

SEQ ID NO: 13180 - DNA, 20 bp, Artificial Sequence
  sgRNA
  Cd274_18
agttcatgctcagaagtggc

SEQ ID NO: 13181 - DNA, 20 bp, Artificial Sequence
  sgRNA
  Cd274_19
cttgacgtctgtgatctgaa

SEQ ID NO: 13182 - DNA, 20 bp, Artificial Sequence
  sgRNA
  Cd274_20
ggaccgtggacactacaatg

SEQ ID NO: 13183 - DNA, 20 bp, Artificial Sequence
  sgRNA
  Cd276_1
cgcgtccgagtaaccgacga

SEQ ID NO: 13184 - DNA, 20 bp, Artificial Sequence
  sgRNA
  Cd276_2
atcacgtgctctagctacca

SEQ ID NO: 13185 - DNA, 20 bp, Artificial Sequence
  sgRNA
  Cd276_3
atcgaacaagccccgctcgt

SEQ ID NO: 13186 - DNA, 20 bp, Artificial Sequence
  sgRNA
  Cd276_4
agctgtgccagactgaagcc

SEQ ID NO: 13187 - DNA, 20 bp, Artificial Sequence
  sgRNA
  Cd276_5
tctccagcacacgaaagcca

SEQ ID NO: 13188 - DNA, 20 bp, Artificial Sequence
  sgRNA
  Cd276_6
tgaggctctgtgggtaaccg

SEQ ID NO: 13189 - DNA, 20 bp, Artificial Sequence
  sgRNA
  Cd276_7
gctggtgcacagcttcacgg

SEQ ID NO: 13190 - DNA, 20 bp, Artificial Sequence
  sgRNA
  Cd276_8
tgtccaccagggccaccacg

SEQ ID NO: 13191 - DNA, 20 bp, Artificial Sequence
  sgRNA
  Cd276_9
ggaaaaggagcagcgtaggg

SEQ ID NO: 13192 - DNA, 20 bp, Artificial Sequence
  sgRNA
  Cd276_10
gcgcgtccgagtaaccgacg

SEQ ID NO: 13193 - DNA, 20 bp, Artificial Sequence
  sgRNA
  Cd276_11
tgcaaggcaatgcgtccttg

SEQ ID NO: 13194 - DNA, 20 bp, Artificial Sequence
  sgRNA
  Cd276_12
gtggtcacattgccagtcaa

SEQ ID NO: 13195 - DNA, 20 bp, Artificial Sequence
  sgRNA
  Cd276_13
tagctaccagggctatccgg

SEQ ID NO: 13196 - DNA, 20 bp, Artificial Sequence
  sgRNA
  Cd276_14
gctgacagacaccaaacagc

SEQ ID NO: 13197 - DNA, 20 bp, Artificial Sequence
  sgRNA
  Cd276_15
gcaggtgtagctgccctcgt

SEQ ID NO: 13198 - DNA, 20 bp, Artificial Sequence
  sgRNA
  Cd276_16
tcgatgttcacagcgtgctg

SEQ ID NO: 13199 - DNA, 20 bp, Artificial Sequence
  sgRNA
  Cd276_17
aggctctgtgggtaaccgtg

SEQ ID NO: 13200 - DNA, 20 bp, Artificial Sequence
  sgRNA
  Cd276_18
gatcaagcagagctgcgagg

SEQ ID NO: 13201 - DNA, 20 bp, Artificial Sequence
  sgRNA
  Cd276_19
acgcattgccttgcaccaac

SEQ ID NO: 13202 - DNA, 20 bp, Artificial Sequence
  sgRNA
  Cd276_20
tcccagatggccaacgagcg

SEQ ID NO: 13203 - DNA, 20 bp, Artificial Sequence
  sgRNA
  Cd28_1
tcggcattcgagcgaaactg

SEQ ID NO: 13204 - DNA, 20 bp, Artificial Sequence
  sgRNA
  Cd28_2
gcttgtggtagatagcaacg

SEQ ID NO: 13205 - DNA, 20 bp, Artificial Sequence
  sgRNA
  Cd28_3
caagggcgtgaacagcgacg

SEQ ID NO: 13206 - DNA, 20 bp, Artificial Sequence
  sgRNA
  Cd28_4
ttcctacaaccttctcgcaa

SEQ ID NO: 13207 - DNA, 20 bp, Artificial Sequence
  sgRNA
  Cd28_5
cgttgtctaggtaaggcgga

SEQ ID NO: 13208 - DNA, 20 bp, Artificial Sequence
  sgRNA
  Cd28_6
acatgaacatgactccccgg

SEQ ID NO: 13209 - DNA, 20 bp, Artificial Sequence
  sgRNA
  Cd28_7
aatgccgagttcaactgcga

SEQ ID NO: 13210 - DNA, 20 bp, Artificial Sequence
  sgRNA
  Cd28_8
ttccgggcatccctgtacaa

SEQ ID NO: 13211 - DNA, 20 bp, Artificial Sequence
  sgRNA
  Cd28_9
ctctcgttgtctaggtaagg

SEQ ID NO: 13212 - DNA, 20 bp, Artificial Sequence
  sgRNA
  Cd28_10
tgccgagttcaactgcgacg

SEQ ID NO: 13213 - DNA, 20 bp, Artificial Sequence
  sgRNA
  Cd28_11
gttgctatctaccacaagca

SEQ ID NO: 13214 - DNA, 20 bp, Artificial Sequence
  sgRNA
  Cd28_12
atgccgagttcaactgcgac

SEQ ID NO: 13215 - DNA, 20 bp, Artificial Sequence
  sgRNA
  Cd28_13
cgccttacctagacaacgag

SEQ ID NO: 13216 - DNA, 20 bp, Artificial Sequence
  sgRNA
  Cd28_14
ttgctatctaccacaagcag

SEQ ID NO: 13217 - DNA, 20 bp, Artificial Sequence
  sgRNA
  Cd28_15
cgttgctatctaccacaagc

SEQ ID NO: 13218 - DNA, 20 bp, Artificial Sequence
  sgRNA
  Cd28_16
ctagacaacgagaggagcaa

SEQ ID NO: 13219 - DNA, 20 bp, Artificial Sequence
  sgRNA
  Cd28_17
ttatggcttgctagtgacag

SEQ ID NO: 13220 - DNA, 20 bp, Artificial Sequence
  sgRNA
  Cd28_18
tgacgtgcagattccagaga

SEQ ID NO: 13221 - DNA, 20 bp, Artificial Sequence
  sgRNA
  Cd28_19
tcgttgtctaggtaaggcgg

SEQ ID NO: 13222 - DNA, 20 bp, Artificial Sequence
  sgRNA
  Cd28_20
cgagcgaaactggggctgat

SEQ ID NO: 13223 - DNA, 20 bp, Artificial Sequence
  sgRNA
  Cd300a_1
gggaatagtcatgttcacgg

SEQ ID NO: 13224 - DNA, 20 bp, Artificial Sequence
  sgRNA
  Cd300a_2
atatcgacatgacacactca

SEQ ID NO: 13225 - DNA, 20 bp, Artificial Sequence
  sgRNA
  Cd300a_3
accaacactagagacacctg

SEQ ID NO: 13226 - DNA, 20 bp, Artificial Sequence
  sgRNA
  Cd300a_4
catcctccaggccagcagag

SEQ ID NO: 13227 - DNA, 20 bp, Artificial Sequence
  sgRNA
  Cd300a_5
agagcttcactattcatccg

SEQ ID NO: 13228 - DNA, 20 bp, Artificial Sequence
  sgRNA
  Cd300a_6
cataggtcactgtaaaggtg

SEQ ID NO: 13229 - DNA, 20 bp, Artificial Sequence
  sgRNA
  Cd300a_7
gccctaggatccaacacaga

SEQ ID NO: 13230 - DNA, 20 bp, Artificial Sequence
  sgRNA
  Cd300a_8
gctgtcccagaacctcagac

SEQ ID NO: 13231 - DNA, 20 bp, Artificial Sequence
  sgRNA
  Cd300a_9
cgtgaacatgactattccca

SEQ ID NO: 13232 - DNA, 20 bp, Artificial Sequence
  sgRNA
  Cd300a_10
gctaacacagacaacagcgc

SEQ ID NO: 13233 - DNA, 20 bp, Artificial Sequence
  sgRNA
  Cd300a_11
gctgcacacgtggtctctga

SEQ ID NO: 13234 - DNA, 20 bp, Artificial Sequence
  sgRNA
  Cd300a_12
ctaacacagacaacagcgct

SEQ ID NO: 13235 - DNA, 20 bp, Artificial Sequence
  sgRNA
  Cd300a_13
gagtgtgtcatgtcgatatg

SEQ ID NO: 13236 - DNA, 20 bp, Artificial Sequence
  sgRNA
  Cd300a_14
agtggtggaatatagcacat

SEQ ID NO: 13237 - DNA, 20 bp, Artificial Sequence
  sgRNA
  Cd300a_15
cctctgggagttgaatgcca

SEQ ID NO: 13238 - DNA, 20 bp, Artificial Sequence
  sgRNA
  Cd300a_16
tggtgctgggaccatgcaga

SEQ ID NO: 13239 - DNA, 20 bp, Artificial Sequence
  sgRNA
  Cd300a_17
ccgtggcattcaactcccag

SEQ ID NO: 13240 - DNA, 20 bp, Artificial Sequence
  sgRNA
  Cd300a_18
agcaccatgtcaggaagtgt

SEQ ID NO: 13241 - DNA, 20 bp, Artificial Sequence
  sgRNA
  Cd300a_19
tctgtgttggatcctagggc

SEQ ID NO: 13242 - DNA, 20 bp, Artificial Sequence
  sgRNA
  Cd300a_20
tccaccagtctgcctaccaa

SEQ ID NO: 13243 - DNA, 20 bp, Artificial Sequence
  sgRNA
  Cd300c_1
ggacttatcgatctgtaagt

SEQ ID NO: 13244 - DNA, 20 bp, Artificial Sequence
  sgRNA
  Cd300c_2
gaatgttgataccgttccca

SEQ ID NO: 13245 - DNA, 20 bp, Artificial Sequence
  sgRNA
  Cd300c_3
gaccttggagaacctcaccc

SEQ ID NO: 13246 - DNA, 20 bp, Artificial Sequence
  sgRNA
  Cd300c_4
gcctcagaagaagctaggaa

SEQ ID NO: 13247 - DNA, 20 bp, Artificial Sequence
  sgRNA
  Cd300c_5
ccagggcgtgaacctttgac

SEQ ID NO: 13248 - DNA, 20 bp, Artificial Sequence
  sgRNA
  Cd300c_6
ccaagcatgctcaggaacag

SEQ ID NO: 13249 - DNA, 20 bp, Artificial Sequence
  sgRNA
  Cd300c_7
gtgtcgtctgtggtcacgtt

SEQ ID NO: 13250 - DNA, 20 bp, Artificial Sequence
  sgRNA
  Cd300c_8
gtgcaccgctgaggatgtgg

SEQ ID NO: 13251 - DNA, 20 bp, Artificial Sequence
  sgRNA
  Cd300c_9
gcactgtcacaggcactgtg

SEQ ID NO: 13252 - DNA, 20 bp, Artificial Sequence
  sgRNA
  Cd300c_10
gccattcctagcttcttctg

SEQ ID NO: 13253 - DNA, 20 bp, Artificial Sequence
  sgRNA
  Cd300c_11
ggcttcccccacatcctcag

SEQ ID NO: 13254 - DNA, 20 bp, Artificial Sequence
  sgRNA
  Cd300c_12
aggcacctacatgtgtatgg

SEQ ID NO: 13255 - DNA, 20 bp, Artificial Sequence
  sgRNA
  Cd300c_13
cttggagaacctcaccctgg

SEQ ID NO: 13256 - DNA, 20 bp, Artificial Sequence
  sgRNA
  Cd300c_14
gtaggtgcctgcatcctcca

SEQ ID NO: 13257 - DNA, 20 bp, Artificial Sequence
  sgRNA
  Cd300c_15
gggctgagtgtgcaccgctg

SEQ ID NO: 13258 - DNA, 20 bp, Artificial Sequence
  sgRNA
  Cd300c_16
acaccaggatccagaagtgg

SEQ ID NO: 13259 - DNA, 20 bp, Artificial Sequence
  sgRNA
  Cd300c_17
ctccagggtgaggttctcca

SEQ ID NO: 13260 - DNA, 20 bp, Artificial Sequence
  sgRNA
  Cd300c_18
gatggtccctgatggacact

SEQ ID NO: 13261 - DNA, 20 bp, Artificial Sequence
  sgRNA
  Cd300c_19
gcaaggcaccaagcatgctc

SEQ ID NO: 13262 - DNA, 20 bp, Artificial Sequence
  sgRNA
  Cd300c_20
tatatccaccatacacatgt

SEQ ID NO: 13263 - DNA, 20 bp, Artificial Sequence
  sgRNA
  Cd300c2_1
cagtgtgtcatgtcaatacg

SEQ ID NO: 13264 - DNA, 20 bp, Artificial Sequence
  sgRNA
  Cd300c2_2
acaggttcgagccttgagag

SEQ ID NO: 13265 - DNA, 20 bp, Artificial Sequence
  sgRNA
  Cd300c2_3
ccagcagctcagaagaagtt

SEQ ID NO: 13266 - DNA, 20 bp, Artificial Sequence
  sgRNA
  Cd300c2_4
tctgcaccctgacagctgga

SEQ ID NO: 13267 - DNA, 20 bp, Artificial Sequence
  sgRNA
  Cd300c2_5
agctcagaagaagttaggaa

SEQ ID NO: 13268 - DNA, 20 bp, Artificial Sequence
  sgRNA
  Cd300c2_6
atgggagtaagtcctccctt

SEQ ID NO: 13269 - DNA, 20 bp, Artificial Sequence
  sgRNA
  Cd300c2_7
cagcgcctgtgatagtgctg

SEQ ID NO: 13270 - DNA, 20 bp, Artificial Sequence
  sgRNA
  Cd300c2_8
gtgcccaactgaggatgtgg

SEQ ID NO: 13271 - DNA, 20 bp, Artificial Sequence
  sgRNA
  Cd300c2_9
gtgtcatctgtggtcacact

SEQ ID NO: 13272 - DNA, 20 bp, Artificial Sequence
  sgRNA
  Cd300c2_10
aggacaaattctggtgcaga

SEQ ID NO: 13273 - DNA, 20 bp, Artificial Sequence
  sgRNA
  Cd300c2_11
gcactatcacaggcgctgtt

SEQ ID NO: 13274 - DNA, 20 bp, Artificial Sequence
  sgRNA
  Cd300c2_12
atagtgctggggccatgcag

SEQ ID NO: 13275 - DNA, 20 bp, Artificial Sequence
  sgRNA
  Cd300c2_13
tcaaggctcgaacctgtgac

SEQ ID NO: 13276 - DNA, 20 bp, Artificial Sequence
  sgRNA
  Cd300c2_14
acaccaggacccagaagtag

SEQ ID NO: 13277 - DNA, 20 bp, Artificial Sequence
  sgRNA
  Cd300c2_15
aatcccccacatcctcagtt

SEQ ID NO: 13278 - DNA, 20 bp, Artificial Sequence
  sgRNA
  Cd300c2_16
ggaacaacttcagagacacc

SEQ ID NO: 13279 - DNA, 20 bp, Artificial Sequence
  sgRNA
  Cd300c2_17
ttactcccatccagctgtca

SEQ ID NO: 13280 - DNA, 20 bp, Artificial Sequence
  sgRNA
  Cd300c2_18
gtcagttcttaaaaaccctc

SEQ ID NO: 13281 - DNA, 20 bp, Artificial Sequence
  sgRNA
  Cd300c2_19
tctgaggcctgttcacccag

SEQ ID NO: 13282 - DNA, 20 bp, Artificial Sequence
  sgRNA
  Cd300c2_20
gctctcataggtcactgtga

SEQ ID NO: 13283 - DNA, 20 bp, Artificial Sequence
  sgRNA
  Cd300e_1
tctgtgtctggctacgtagg

SEQ ID NO: 13284 - DNA, 20 bp, Artificial Sequence
  sgRNA
  Cd300e_2
tgatccatcggtcagtgtaa

SEQ ID NO: 13285 - DNA, 20 bp, Artificial Sequence
  sgRNA
  Cd300e_3
tgatggtggagttcgaagca

SEQ ID NO: 13286 - DNA, 20 bp, Artificial Sequence
  sgRNA
  Cd300e_4
caatatagtccatcatataa

SEQ ID NO: 13287 - DNA, 20 bp, Artificial Sequence
  sgRNA
  Cd300e_5
gcccagaattcactagtggg

SEQ ID NO: 13288 - DNA, 20 bp, Artificial Sequence
  sgRNA
  Cd300e_6
tgaccacgaatcccagataa

SEQ ID NO: 13289 - DNA, 20 bp, Artificial Sequence
  sgRNA
  Cd300e_7
aaaactattgtagaaaccga

SEQ ID NO: 13290 - DNA, 20 bp, Artificial Sequence
  sgRNA
  Cd300e_8
ttcgtggtcacgtgatccat

SEQ ID NO: 13291 - DNA, 20 bp, Artificial Sequence
  sgRNA
  Cd300e_9
acctcagcgaagacaatgct

SEQ ID NO: 13292 - DNA, 20 bp, Artificial Sequence
  sgRNA
  Cd300e_10
cgtagccagacacagagcca

SEQ ID NO: 13293 - DNA, 20 bp, Artificial Sequence
  sgRNA
  Cd300e_11
cagagcatgctcagaaacag

SEQ ID NO: 13294 - DNA, 20 bp, Artificial Sequence
  sgRNA
  Cd300e_12
ttctgcccagaattcactag

SEQ ID NO: 13295 - DNA, 20 bp, Artificial Sequence
  sgRNA
  Cd300e_13
gcatggtctctgatggacac

SEQ ID NO: 13296 - DNA, 20 bp, Artificial Sequence
  sgRNA
  Cd300e_14
acggaagtgagaaagaaaag

SEQ ID NO: 13297 - DNA, 20 bp, Artificial Sequence
  sgRNA
  Cd300e_15
acccagcattgtcttcgctg

SEQ ID NO: 13298 - DNA, 20 bp, Artificial Sequence
  sgRNA
  Cd300e_16
tcacattagtactaatcctc

SEQ ID NO: 13299 - DNA, 20 bp, Artificial Sequence
  sgRNA
  Cd300e_17
ttcacccttacactgaccga

SEQ ID NO: 13300 - DNA, 20 bp, Artificial Sequence
  sgRNA
  Cd300e_18
tctgcccagaattcactagt

SEQ ID NO: 13301 - DNA, 20 bp, Artificial Sequence
  sgRNA
  Cd300e_19
gactatattgacactgcaca

SEQ ID NO: 13302 - DNA, 20 bp, Artificial Sequence
  sgRNA
  Cd300e_20
tatatgaaatactggtgccg

SEQ ID NO: 13303 - DNA, 20 bp, Artificial Sequence
  sgRNA
  Cd300ld_1
gttaatgtgaacattgacca

SEQ ID NO: 13304 - DNA, 20 bp, Artificial Sequence
  sgRNA
  Cd300ld_2
agatattcctcatactggaa

SEQ ID NO: 13305 - DNA, 20 bp, Artificial Sequence
  sgRNA
  Cd300ld_3
agaatatcacatgatctctg

SEQ ID NO: 13306 - DNA, 20 bp, Artificial Sequence
  sgRNA
  Cd300ld_4
ttgtatggatttcagaactg

SEQ ID NO: 13307 - DNA, 20 bp, Artificial Sequence
  sgRNA
  Cd300ld_5
tctgaggcctggtcacccag

SEQ ID NO: 13308 - DNA, 20 bp, Artificial Sequence
  sgRNA
  Cd300ld_6
cctcagagatgctttgggag

SEQ ID NO: 13309 - DNA, 20 bp, Artificial Sequence
  sgRNA
  Cd300ld_7
ctactcctattcttcctccc

SEQ ID NO: 13310 - DNA, 20 bp, Artificial Sequence
  sgRNA
  Cd300ld_8
cctctcccaaagcatctctg

SEQ ID NO: 13311 - DNA, 20 bp, Artificial Sequence
  sgRNA
  Cd300ld_9
ttgccagtgttctcagcgct

SEQ ID NO: 13312 - DNA, 20 bp, Artificial Sequence
  sgRNA
  Cd300ld_10
ctgagcatgctcaggagcag

SEQ ID NO: 13313 - DNA, 20 bp, Artificial Sequence
  sgRNA
  Cd300ld_11
actccacaaagaccatcagc

SEQ ID NO: 13314 - DNA, 20 bp, Artificial Sequence
  sgRNA
  Cd300ld_12
ggattcagtcacaggtccag

SEQ ID NO: 13315 - DNA, 20 bp, Artificial Sequence
  sgRNA
  Cd300ld_13
aagcgctgagaacactggca

SEQ ID NO: 13316 - DNA, 20 bp, Artificial Sequence
  sgRNA
  Cd300ld_14
ttaactttaaacatgggatc

SEQ ID NO: 13317 - DNA, 20 bp, Artificial Sequence
  sgRNA
  Cd300ld_15
gcaaagaagtgactcagagc

SEQ ID NO: 13318 - DNA, 20 bp, Artificial Sequence
  sgRNA
  Cd300ld_16
cttgtaacccttccagtatg

SEQ ID NO: 13319 - DNA, 20 bp, Artificial Sequence
  sgRNA
  Cd300ld_17
agtgcagatattcctcatac

SEQ ID NO: 13320 - DNA, 20 bp, Artificial Sequence
  sgRNA
  Cd300ld_18
cagcatctacttcctgctga

SEQ ID NO: 13321 - DNA, 20 bp, Artificial Sequence
  sgRNA
  Cd300ld_19
caccagctgctctgatttat

SEQ ID NO: 13322 - DNA, 20 bp, Artificial Sequence
  sgRNA
  Cd300ld_20
cagatattcctcatactgga

SEQ ID NO: 13323 - DNA, 20 bp, Artificial Sequence
  sgRNA
  Cd300ld2_1
tgttgtggatgtccgaactg

SEQ ID NO: 13324 - DNA, 20 bp, Artificial Sequence
  sgRNA
  Cd300ld2_2
gtggatggcacaactgtgca

SEQ ID NO: 13325 - DNA, 20 bp, Artificial Sequence
  sgRNA
  Cd300ld2_3
gtgcatggcagaactgtgga

SEQ ID NO: 13326 - DNA, 20 bp, Artificial Sequence
  sgRNA
  Cd300ld2_4
acaccaaccatggagagcat

SEQ ID NO: 13327 - DNA, 20 bp, Artificial Sequence
  sgRNA
  Cd300ld2_5
gtggatggcagaactgtgga

SEQ ID NO: 13328 - DNA, 20 bp, Artificial Sequence
  sgRNA
  Cd300ld2_6
caggcctcagagacattatg

SEQ ID NO: 13329 - DNA, 20 bp, Artificial Sequence
  sgRNA
  Cd300ld2_7
aactgtgcatggcagaactg

SEQ ID NO: 13330 - DNA, 20 bp, Artificial Sequence
  sgRNA
  Cd300ld2_8
gcaggctctgtgctgtacac

SEQ ID NO: 13331 - DNA, 20 bp, Artificial Sequence
  sgRNA
  Cd300ld2_9
gtgccaatgctctccatggt

SEQ ID NO: 13332 - DNA, 20 bp, Artificial Sequence
  sgRNA
  Cd300ld2_10
aactgtggatggcacaactg

SEQ ID NO: 13333 - DNA, 20 bp, Artificial Sequence
  sgRNA
  Cd300ld2_11
gtggatggcacaactgtgga

SEQ ID NO: 13334 - DNA, 20 bp, Artificial Sequence
  sgRNA
  Cd300ld2_12
acttccccataatgtctctg

SEQ ID NO: 13335 - DNA, 20 bp, Artificial Sequence
  sgRNA
  Cd300ld2_13
cagttcggacatccacagtt

SEQ ID NO: 13336 - DNA, 20 bp, Artificial Sequence
  sgRNA
  Cd300ld2_14
gatgaagagaaacacttccc

SEQ ID NO: 13337 - DNA, 20 bp, Artificial Sequence
  sgRNA
  Cd300ld2_15
ggaagttgaaattggcctgg

SEQ ID NO: 13338 - DNA, 20 bp, Artificial Sequence
  sgRNA
  Cd300ld2_16
acaggcctcagagacattat

SEQ ID NO: 13339 - DNA, 20 bp, Artificial Sequence
  sgRNA
  Cd300ld2_17
gtgcagtgtagatatgactc

SEQ ID NO: 13340 - DNA, 20 bp, Artificial Sequence
  sgRNA
  Cd300ld2_18
tgtggatggcagaactgtgg

SEQ ID NO: 13341 - DNA, 20 bp, Artificial Sequence
  sgRNA
  Cd300ld2_19
cagagcctgctcaggaggag

SEQ ID NO: 13342 - DNA, 20 bp, Artificial Sequence
  sgRNA
  Cd300ld2_20
gacatccacaacaccaacca

SEQ ID NO: 13343 - DNA, 20 bp, Artificial Sequence
  sgRNA
  Cd300ld3_1
ggaaaaggaagagcagagct

SEQ ID NO: 13344 - DNA, 20 bp, Artificial Sequence
  sgRNA
  Cd300ld4_1
aactgtggatgtcagaaccg

SEQ ID NO: 13345 - DNA, 20 bp, Artificial Sequence
  sgRNA
  Cd300ld4_2
aaccgtggatgtcagaactg

SEQ ID NO: 13346 - DNA, 20 bp, Artificial Sequence
  sgRNA
  Cd300ld4_3
atccacagttctgacatcca

SEQ ID NO: 13347 - DNA, 20 bp, Artificial Sequence
  sgRNA
  Cd300lf_1
catcctccaagcaaagagcg

SEQ ID NO: 13348 - DNA, 20 bp, Artificial Sequence
  sgRNA
  Cd300lf_2
agtgccgatatacctcaggc

SEQ ID NO: 13349 - DNA, 20 bp, Artificial Sequence
  sgRNA
  Cd300lf_3
gagtagtagctagtcagcgt

SEQ ID NO: 13350 - DNA, 20 bp, Artificial Sequence
  sgRNA
  Cd300lf_4
gttactgtgaacattggccc

SEQ ID NO: 13351 - DNA, 20 bp, Artificial Sequence
  sgRNA
  Cd300lf_5
tatgccgctctgactttggc

SEQ ID NO: 13352 - DNA, 20 bp, Artificial Sequence
  sgRNA
  Cd300lf_6
agtaggctcctgacccaagc

SEQ ID NO: 13353 - DNA, 20 bp, Artificial Sequence
  sgRNA
  Cd300lf_7
cctggctcctcttggaaaaa

SEQ ID NO: 13354 - DNA, 20 bp, Artificial Sequence
  sgRNA
  Cd300lf_8
ttcacagtaactttaaacat

SEQ ID NO: 13355 - DNA, 20 bp, Artificial Sequence
  sgRNA
  Cd300lf_9
ctagctactactctgataac

SEQ ID NO: 13356 - DNA, 20 bp, Artificial Sequence
  sgRNA
  Cd300lf_10
gtgcagtgccgatatacctc

SEQ ID NO: 13357 - DNA, 20 bp, Artificial Sequence
  sgRNA
  Cd300lf_11
ggaagtggaatatgtcacca

SEQ ID NO: 13358 - DNA, 20 bp, Artificial Sequence
  sgRNA
  Cd300lf_12
ggcggtggtgaagatggcgt

SEQ ID NO: 13359 - DNA, 20 bp, Artificial Sequence
  sgRNA
  Cd300lf_13
caagccggccaaagtcagag

SEQ ID NO: 13360 - DNA, 20 bp, Artificial Sequence
  sgRNA
  Cd300lf_14
tgtcactgtgaagatggtgg

SEQ ID NO: 13361 - DNA, 20 bp, Artificial Sequence
  sgRNA
  Cd300lf_15
ccttccagcctgaggtatat

SEQ ID NO: 13362 - DNA, 20 bp, Artificial Sequence
  sgRNA
  Cd300lf_16
gctctgactttggccggctt

SEQ ID NO: 13363 - DNA, 20 bp, Artificial Sequence
  sgRNA
  Cd300lf_17
tggcctcgctctttgcttgg

SEQ ID NO: 13364 - DNA, 20 bp, Artificial Sequence
  sgRNA
  Cd300lf_18
ggaggttctgggctgcttca

SEQ ID NO: 13365 - DNA, 20 bp, Artificial Sequence
  sgRNA
  Cd300lf_19
ggttgtcactgtgaagatgg

SEQ ID NO: 13366 - DNA, 20 bp, Artificial Sequence
  sgRNA
  Cd300lf_20
cagagtacagcagcatcagg

SEQ ID NO: 13367 - DNA, 20 bp, Artificial Sequence
  sgRNA
  Cd300lg_1
ctccacgtaggtacaccgca

SEQ ID NO: 13368 - DNA, 20 bp, Artificial Sequence
  sgRNA
  Cd300lg_2
caggaccaggaggtgactcg

SEQ ID NO: 13369 - DNA, 20 bp, Artificial Sequence
  sgRNA
  Cd300lg_3
taacctcaaaagactcatcg

SEQ ID NO: 13370 - DNA, 20 bp, Artificial Sequence
  sgRNA
  Cd300lg_4
ggtaaggtccctcatgatca

SEQ ID NO: 13371 - DNA, 20 bp, Artificial Sequence
  sgRNA
  Cd300lg_5
acagtcgtcacggccaaaca

SEQ ID NO: 13372 - DNA, 20 bp, Artificial Sequence
  sgRNA
  Cd300lg_6
tctccacccgacagtcgtca

SEQ ID NO: 13373 - DNA, 20 bp, Artificial Sequence
  sgRNA
  Cd300lg_7
gctgcaggactaattgcctt

SEQ ID NO: 13374 - DNA, 20 bp, Artificial Sequence
  sgRNA
  Cd300lg_8
catcatgcggaccatcggga

SEQ ID NO: 13375 - DNA, 20 bp, Artificial Sequence
  sgRNA
  Cd300lg_9
ggagctccctgcatgaggag

SEQ ID NO: 13376 - DNA, 20 bp, Artificial Sequence
  sgRNA
  Cd300lg_10
ggaacctcccaggttccccc

SEQ ID NO: 13377 - DNA, 20 bp, Artificial Sequence
  sgRNA
  Cd300lg_11
taccacgccacaggactcca

SEQ ID NO: 13378 - DNA, 20 bp, Artificial Sequence
  sgRNA
  Cd300lg_12
gtccctgcggtgtacctacg

SEQ ID NO: 13379 - DNA, 20 bp, Artificial Sequence
  sgRNA
  Cd300lg_13
ctacgcaaatcaggaccagg

SEQ ID NO: 13380 - DNA, 20 bp, Artificial Sequence
  sgRNA
  Cd300lg_14
tagtcctgcagccaacagca

SEQ ID NO: 13381 - DNA, 20 bp, Artificial Sequence
  sgRNA
  Cd300lg_15
caggaagtattggtgccggc

SEQ ID NO: 13382 - DNA, 20 bp, Artificial Sequence
  sgRNA
  Cd300lg_16
tcccttgcagatgtctgcgg

SEQ ID NO: 13383 - DNA, 20 bp, Artificial Sequence
  sgRNA
  Cd300lg_17
ggccacctcggtgaatacag

SEQ ID NO: 13384 - DNA, 20 bp, Artificial Sequence
  sgRNA
  Cd300lg_18
tcagtggtccagccgttccc

SEQ ID NO: 13385 - DNA, 20 bp, Artificial Sequence
  sgRNA
  Cd300lg_19
ggggccatcatgcggaccat

SEQ ID NO: 13386 - DNA, 20 bp, Artificial Sequence
  sgRNA
  Cd300lg_20
gtaggtacaccgcagggaca

SEQ ID NO: 13387 - DNA, 20 bp, Artificial Sequence
  sgRNA
  Cd302_1
gaggacctagttgatacctg

SEQ ID NO: 13388 - DNA, 20 bp, Artificial Sequence
  sgRNA
  Cd302_2
aaatatgacattcgacaagt

SEQ ID NO: 13389 - DNA, 20 bp, Artificial Sequence
  sgRNA
  Cd302_3
acagtgcactgaccacggta

SEQ ID NO: 13390 - DNA, 20 bp, Artificial Sequence
  sgRNA
  Cd302_4
actttgcaaaagcgatggaa

SEQ ID NO: 13391 - DNA, 20 bp, Artificial Sequence
  sgRNA
  Cd302_5
ccatcactgtaaggtgacag

SEQ ID NO: 13392 - DNA, 20 bp, Artificial Sequence
  sgRNA
  Cd302_6
ccagagtcgatattaaaatg

SEQ ID NO: 13393 - DNA, 20 bp, Artificial Sequence
  sgRNA
  Cd302_7
gctgccttggaactggaccc

SEQ ID NO: 13394 - DNA, 20 bp, Artificial Sequence
  sgRNA
  Cd302_8
tgtgaaatctcttctgtgga

SEQ ID NO: 13395 - DNA, 20 bp, Artificial Sequence
  sgRNA
  Cd302_9
cggcgacgatggcagtggcg

SEQ ID NO: 13396 - DNA, 20 bp, Artificial Sequence
  sgRNA
  Cd302_10
atcttcttctgcaactacca

SEQ ID NO: 13397 - DNA, 20 bp, Artificial Sequence
  sgRNA
  Cd302_11
ttacagtgatggctgtgccc

SEQ ID NO: 13398 - DNA, 20 bp, Artificial Sequence
  sgRNA
  Cd302_12
tcttcaagtaaccatcaatg

SEQ ID NO: 13399 - DNA, 20 bp, Artificial Sequence
  sgRNA
  Cd302_13
cttggtgtacagaaaaccac

SEQ ID NO: 13400 - DNA, 20 bp, Artificial Sequence
  sgRNA
  Cd302_14
catcaatgtggaaaacatag

SEQ ID NO: 13401 - DNA, 20 bp, Artificial Sequence
  sgRNA
  Cd302_15
tggacactttgcaaaagcga

SEQ ID NO: 13402 - DNA, 20 bp, Artificial Sequence
  sgRNA
  Cd302_16
gaggctcagcagcacgagcg

SEQ ID NO: 13403 - DNA, 20 bp, Artificial Sequence
  sgRNA
  Cd302_17
agcgcgcgtttcttctatag

SEQ ID NO: 13404 - DNA, 20 bp, Artificial Sequence
  sgRNA
  Cd302_18
gacaggtgaatggagaaaag

SEQ ID NO: 13405 - DNA, 20 bp, Artificial Sequence
  sgRNA
  Cd302_19
ccactgtcaccttacagtga

SEQ ID NO: 13406 - DNA, 20 bp, Artificial Sequence
  sgRNA
  Cd302_20
ggtccagatgatctcctgct

SEQ ID NO: 13407 - DNA, 20 bp, Artificial Sequence
  sgRNA
  Cd320_1
tggtctcagaacaggcctag

SEQ ID NO: 13408 - DNA, 20 bp, Artificial Sequence
  sgRNA
  Cd320_2
gcaaccactgatgttgtcac

SEQ ID NO: 13409 - DNA, 20 bp, Artificial Sequence
  sgRNA
  Cd320_3
ccatcacagcgccacgtgtg

SEQ ID NO: 13410 - DNA, 20 bp, Artificial Sequence
  sgRNA
  Cd320_4
accttccagtgtcttaccag

SEQ ID NO: 13411 - DNA, 20 bp, Artificial Sequence
  sgRNA
  Cd320_5
ctcatattgctacgcctccg

SEQ ID NO: 13412 - DNA, 20 bp, Artificial Sequence
  sgRNA
  Cd320_6
gccactggtaagacactgga

SEQ ID NO: 13413 - DNA, 20 bp, Artificial Sequence
  sgRNA
  Cd320_7
atgtctgtattccacacacg

SEQ ID NO: 13414 - DNA, 20 bp, Artificial Sequence
  sgRNA
  Cd320_8
gcagataaccctgacctcgg

SEQ ID NO: 13415 - DNA, 20 bp, Artificial Sequence
  sgRNA
  Cd320_9
tgctcctgtgacaacatcag

SEQ ID NO: 13416 - DNA, 20 bp, Artificial Sequence
  sgRNA
  Cd320_10
gaggcgtagcaatatgagaa

SEQ ID NO: 13417 - DNA, 20 bp, Artificial Sequence
  sgRNA
  Cd320_11
agcagctgcaataaccccat

SEQ ID NO: 13418 - DNA, 20 bp, Artificial Sequence
  sgRNA
  Cd320_12
ggagacttggacccgggtat

SEQ ID NO: 13419 - DNA, 20 bp, Artificial Sequence
  sgRNA
  Cd320_13
tggagtcaagacagtctggg

SEQ ID NO: 13420 - DNA, 20 bp, Artificial Sequence
  sgRNA
  Cd320_14
gcgtagcaatatgagaaggg

SEQ ID NO: 13421 - DNA, 20 bp, Artificial Sequence
  sgRNA
  Cd320_15
gccaccaacagccctggtgg

SEQ ID NO: 13422 - DNA, 20 bp, Artificial Sequence
  sgRNA
  Cd320_16
accgggtgaccagccctgcg

SEQ ID NO: 13423 - DNA, 20 bp, Artificial Sequence
  sgRNA
  Cd320_17
aattgataagatattccagg

SEQ ID NO: 13424 - DNA, 20 bp, Artificial Sequence
  sgRNA
  Cd320_18
ctgatgttgtcacaggagca

SEQ ID NO: 13425 - DNA, 20 bp, Artificial Sequence
  sgRNA
  Cd320_19
gttgagtgccatcctggttt

SEQ ID NO: 13426 - DNA, 20 bp, Artificial Sequence
  sgRNA
  Cd320_20
gagtgagctgcattgcatac

SEQ ID NO: 13427 - DNA, 20 bp, Artificial Sequence
  sgRNA
  Cd33_1
ctcctgacattataatcccg

SEQ ID NO: 13428 - DNA, 20 bp, Artificial Sequence
  sgRNA
  Cd33_2
aggtgtgaacgtcagcacgg

SEQ ID NO: 13429 - DNA, 20 bp, Artificial Sequence
  sgRNA
  Cd33_3
gcccgagtcagtgacagtcg

SEQ ID NO: 13430 - DNA, 20 bp, Artificial Sequence
  sgRNA
  Cd33_4
ctagtgcagaaggcaacaca

SEQ ID NO: 13431 - DNA, 20 bp, Artificial Sequence
  sgRNA
  Cd33_5
gctaggatagccagcctcca

SEQ ID NO: 13432 - DNA, 20 bp, Artificial Sequence
  sgRNA
  Cd33_6
ctgaggtgtgaacgtcagca

SEQ ID NO: 13433 - DNA, 20 bp, Artificial Sequence
  sgRNA
  Cd33_7
gggatgcaggaattatccac

SEQ ID NO: 13434 - DNA, 20 bp, Artificial Sequence
  sgRNA
  Cd33_8
gcatccctctgatcccagag

SEQ ID NO: 13435 - DNA, 20 bp, Artificial Sequence
  sgRNA
  Cd33_9
tctccatgaagactctccag

SEQ ID NO: 13436 - DNA, 20 bp, Artificial Sequence
  sgRNA
  Cd33_10
tgtggttcgggaactcaagg

SEQ ID NO: 13437 - DNA, 20 bp, Artificial Sequence
  sgRNA
  Cd33_11
tgacatccaggagaaagtag

SEQ ID NO: 13438 - DNA, 20 bp, Artificial Sequence
  sgRNA
  Cd33_12
cctaaagtgagcttaatgga

SEQ ID NO: 13439 - DNA, 20 bp, Artificial Sequence
  sgRNA
  Cd33_13
gtcccctgctcacaagccca

SEQ ID NO: 13440 - DNA, 20 bp, Artificial Sequence
  sgRNA
  Cd33_14
cttccctcccatgaaatcca

SEQ ID NO: 13441 - DNA, 20 bp, Artificial Sequence
  sgRNA
  Cd33_15
ttatccacaggaagccatag

SEQ ID NO: 13442 - DNA, 20 bp, Artificial Sequence
  sgRNA
  Cd33_16
catgtttctgtgggtcccca

SEQ ID NO: 13443 - DNA, 20 bp, Artificial Sequence
  sgRNA
  Cd33_17
tcctaaagtgagcttaatgg

SEQ ID NO: 13444 - DNA, 20 bp, Artificial Sequence
  sgRNA
  Cd33_18
ataacccactctgggatcag

SEQ ID NO: 13445 - DNA, 20 bp, Artificial Sequence
  sgRNA
  Cd33_19
gatgcacagaaaaatgacac

SEQ ID NO: 13446 - DNA, 20 bp, Artificial Sequence
  sgRNA
  Cd33_20
tagatctctgagtactcctg

SEQ ID NO: 13447 - DNA, 20 bp, Artificial Sequence
  sgRNA
  Cd34_1
tgatgtgtaagcatatggct

SEQ ID NO: 13448 - DNA, 20 bp, Artificial Sequence
  sgRNA
  Cd34_2
gctctggaatccgagaagtg

SEQ ID NO: 13449 - DNA, 20 bp, Artificial Sequence
  sgRNA
  Cd34_3
tgtcctgatagatcaagtag

SEQ ID NO: 13450 - DNA, 20 bp, Artificial Sequence
  sgRNA
  Cd34_4
ctcattggtaggaactgatg

SEQ ID NO: 13451 - DNA, 20 bp, Artificial Sequence
  sgRNA
  Cd34_5
gttcatcaggaaataaccag

SEQ ID NO: 13452 - DNA, 20 bp, Artificial Sequence
  sgRNA
  Cd34_6
tattacacggagaatggtgg

SEQ ID NO: 13453 - DNA, 20 bp, Artificial Sequence
  sgRNA
  Cd34_7
gggtgaagacccttattaca

SEQ ID NO: 13454 - DNA, 20 bp, Artificial Sequence
  sgRNA
  Cd34_8
ctgtagggctccaactgcga

SEQ ID NO: 13455 - DNA, 20 bp, Artificial Sequence
  sgRNA
  Cd34_9
agtagtggctggtacttcca

SEQ ID NO: 13456 - DNA, 20 bp, Artificial Sequence
  sgRNA
  Cd34_10
tcctcaacagactcattggt

SEQ ID NO: 13457 - DNA, 20 bp, Artificial Sequence
  sgRNA
  Cd34_11
aatactgtgtgaaaaggagg

SEQ ID NO: 13458 - DNA, 20 bp, Artificial Sequence
  sgRNA
  Cd34_12
aaaggccaatgtgacccgag

SEQ ID NO: 13459 - DNA, 20 bp, Artificial Sequence
  sgRNA
  Cd34_13
gatggccagcagaactccag

SEQ ID NO: 13460 - DNA, 20 bp, Artificial Sequence
  sgRNA
  Cd34_14
ggaaaggccaatgtgacccg

SEQ ID NO: 13461 - DNA, 20 bp, Artificial Sequence
  sgRNA
  Cd34_15
tccttgtgtagaagtctccg

SEQ ID NO: 13462 - DNA, 20 bp, Artificial Sequence
  sgRNA
  Cd34_16
gaaaggccaatgtgacccga

SEQ ID NO: 13463 - DNA, 20 bp, Artificial Sequence
  sgRNA
  Cd34_17
gtagtaggcagtatgccagt

SEQ ID NO: 13464 - DNA, 20 bp, Artificial Sequence
  sgRNA
  Cd34_18
tcaactttacagttacctct

SEQ ID NO: 13465 - DNA, 20 bp, Artificial Sequence
  sgRNA
  Cd34_19
gagtctttcgggaatagctc

SEQ ID NO: 13466 - DNA, 20 bp, Artificial Sequence
  sgRNA
  Cd34_20
ttagttccaggcagataccc

SEQ ID NO: 13467 - DNA, 20 bp, Artificial Sequence
  sgRNA
  Cd36_1
aaatataactcaggaccccg

SEQ ID NO: 13468 - DNA, 20 bp, Artificial Sequence
  sgRNA
  Cd36_2
ccaaaactgtctgtacacag

SEQ ID NO: 13469 - DNA, 20 bp, Artificial Sequence
  sgRNA
  Cd36_3
taggatatggaaccaaactg

SEQ ID NO: 13470 - DNA, 20 bp, Artificial Sequence
  sgRNA
  Cd36_4
ttaatcatgtcgcaatagct

SEQ ID NO: 13471 - DNA, 20 bp, Artificial Sequence
  sgRNA
  Cd36_5
tcaataagcatgtctccgac

SEQ ID NO: 13472 - DNA, 20 bp, Artificial Sequence
  sgRNA
  Cd36_6
ggaggcattctcatgccagt

SEQ ID NO: 13473 - DNA, 20 bp, Artificial Sequence
  sgRNA
  Cd36_7
gctgtacaaaagacacagtg

SEQ ID NO: 13474 - DNA, 20 bp, Artificial Sequence
  sgRNA
  Cd36_8
ccataattgagtcctataaa

SEQ ID NO: 13475 - DNA, 20 bp, Artificial Sequence
  sgRNA
  Cd36_9
tgtggaagcgaaatatacac

SEQ ID NO: 13476 - DNA, 20 bp, Artificial Sequence
  sgRNA
  Cd36_10
tgtgcaaaacccagatgacg

SEQ ID NO: 13477 - DNA, 20 bp, Artificial Sequence
  sgRNA
  Cd36_11
gaggggtgatgcaaaggcat

SEQ ID NO: 13478 - DNA, 20 bp, Artificial Sequence
  sgRNA
  Cd36_12
tattgagaagacaatcaaaa

SEQ ID NO: 13479 - DNA, 20 bp, Artificial Sequence
  sgRNA
  Cd36_13
gatgtttcagaacctattga

SEQ ID NO: 13480 - DNA, 20 bp, Artificial Sequence
  sgRNA
  Cd36_14
acaccaactgtggtacttat

SEQ ID NO: 13481 - DNA, 20 bp, Artificial Sequence
  sgRNA
  Cd36_15
cagagttcgttatctagcca

SEQ ID NO: 13482 - DNA, 20 bp, Artificial Sequence
  sgRNA
  Cd36_16
tctttgaaagaactcttgtg

SEQ ID NO: 13483 - DNA, 20 bp, Artificial Sequence
  sgRNA
  Cd36_17
gaagaacaaatctgtacacg

SEQ ID NO: 13484 - DNA, 20 bp, Artificial Sequence
  sgRNA
  Cd36_18
tatggaaccaaactgaggaa

SEQ ID NO: 13485 - DNA, 20 bp, Artificial Sequence
  sgRNA
  Cd36_19
agctattgcgacatgattaa

SEQ ID NO: 13486 - DNA, 20 bp, Artificial Sequence
  sgRNA
  Cd36_20
tgtgcttgcaaatccaagaa

SEQ ID NO: 13487 - DNA, 20 bp, Artificial Sequence
  sgRNA
  Cd37_1
ccaagtctgcagtggcacga

SEQ ID NO: 13488 - DNA, 20 bp, Artificial Sequence
  sgRNA
  Cd37_2
atctccgcgggactggaaca

SEQ ID NO: 13489 - DNA, 20 bp, Artificial Sequence
  sgRNA
  Cd37_3
ctgtctcatccggattcgtg

SEQ ID NO: 13490 - DNA, 20 bp, Artificial Sequence
  sgRNA
  Cd37_4
tttgccacacagattaccct

SEQ ID NO: 13491 - DNA, 20 bp, Artificial Sequence
  sgRNA
  Cd37_5
gctgcggctggcaatctccg

SEQ ID NO: 13492 - DNA, 20 bp, Artificial Sequence
  sgRNA
  Cd37_6
gcatcctcatttccactcag

SEQ ID NO: 13493 - DNA, 20 bp, Artificial Sequence
  sgRNA
  Cd37_7
tgcatagtcccaactctcct

SEQ ID NO: 13494 - DNA, 20 bp, Artificial Sequence
  sgRNA
  Cd37_8
tccggatgagacagcagccg

SEQ ID NO: 13495 - DNA, 20 bp, Artificial Sequence
  sgRNA
  Cd37_9
cgtgatccagatttctacac

SEQ ID NO: 13496 - DNA, 20 bp, Artificial Sequence
  sgRNA
  Cd37_10
gctcacatctaccgtgaggt

SEQ ID NO: 13497 - DNA, 20 bp, Artificial Sequence
  sgRNA
  Cd37_11
ggatcacgtctatgaccggc

SEQ ID NO: 13498 - DNA, 20 bp, Artificial Sequence
  sgRNA
  Cd37_12
tgggccttgttccagtcccg

SEQ ID NO: 13499 - DNA, 20 bp, Artificial Sequence
  sgRNA
  Cd37_13
gctgaggcaactctcttggg

SEQ ID NO: 13500 - DNA, 20 bp, Artificial Sequence
  sgRNA
  Cd37_14
ctaccgctagtcccacctca

SEQ ID NO: 13501 - DNA, 20 bp, Artificial Sequence
  sgRNA
  Cd37_15
gtttgccacacagattaccc

SEQ ID NO: 13502 - DNA, 20 bp, Artificial Sequence
  sgRNA
  Cd37_16
gtctgcctcagcttcgcccg

SEQ ID NO: 13503 - DNA, 20 bp, Artificial Sequence
  sgRNA
  Cd37_17
ctgctcctgctacaactcca

SEQ ID NO: 13504 - DNA, 20 bp, Artificial Sequence
  sgRNA
  Cd37_18
tttctcccagctaagccggt

SEQ ID NO: 13505 - DNA, 20 bp, Artificial Sequence
  sgRNA
  Cd37_19
ggtggagtcattggtcgccg

SEQ ID NO: 13506 - DNA, 20 bp, Artificial Sequence
  sgRNA
  Cd37_20
atctggatcacgtctatgac

SEQ ID NO: 13507 - DNA, 20 bp, Artificial Sequence
  sgRNA
  Cd38_1
agcccagatcggtctcggag

SEQ ID NO: 13508 - DNA, 20 bp, Artificial Sequence
  sgRNA
  Cd38_2
tcaaaccataccatgtaaca

SEQ ID NO: 13509 - DNA, 20 bp, Artificial Sequence
  sgRNA
  Cd38_3
ggaggatctgagtgtagatg

SEQ ID NO: 13510 - DNA, 20 bp, Artificial Sequence
  sgRNA
  Cd38_4
catcaatatacttggatcca

SEQ ID NO: 13511 - DNA, 20 bp, Artificial Sequence
  sgRNA
  Cd38_5
ttcgatgtcgtgcatcaccc

SEQ ID NO: 13512 - DNA, 20 bp, Artificial Sequence
  sgRNA
  Cd38_6
ctttccagaacacagtaata

SEQ ID NO: 13513 - DNA, 20 bp, Artificial Sequence
  sgRNA
  Cd38_7
gtccacaccaggagtgagcg

SEQ ID NO: 13514 - DNA, 20 bp, Artificial Sequence
  sgRNA
  Cd38_8
tttgtaaaatggctcacgga

SEQ ID NO: 13515 - DNA, 20 bp, Artificial Sequence
  sgRNA
  Cd38_9
gctacattgctgatgatctc

SEQ ID NO: 13516 - DNA, 20 bp, Artificial Sequence
  sgRNA
  Cd38_10
acaaccctattactgtgttc

SEQ ID NO: 13517 - DNA, 20 bp, Artificial Sequence
  sgRNA
  Cd38_11
tctcctggtcctgatcgcct

SEQ ID NO: 13518 - DNA, 20 bp, Artificial Sequence
  sgRNA
  Cd38_12
acattgctgatgatctcagg

SEQ ID NO: 13519 - DNA, 20 bp, Artificial Sequence
  sgRNA
  Cd38_13
catcacttggaccacaccac

SEQ ID NO: 13520 - DNA, 20 bp, Artificial Sequence
  sgRNA
  Cd38_14
catcttcagctcatttaagg

SEQ ID NO: 13521 - DNA, 20 bp, Artificial Sequence
  sgRNA
  Cd38_15
ggttcataaactacaggcct

SEQ ID NO: 13522 - DNA, 20 bp, Artificial Sequence
  sgRNA
  Cd38_16
cttctcttgtgatgttgcaa

SEQ ID NO: 13523 - DNA, 20 bp, Artificial Sequence
  sgRNA
  Cd38_17
tctgggctttcctagagagg

SEQ ID NO: 13524 - DNA, 20 bp, Artificial Sequence
  sgRNA
  Cd38_18
aagtttgcagaagatgcctg

SEQ ID NO: 13525 - DNA, 20 bp, Artificial Sequence
  sgRNA
  Cd38_19
ctggatccaagtatattgat

SEQ ID NO: 13526 - DNA, 20 bp, Artificial Sequence
  sgRNA
  Cd38_20
gagtgaccaatttaacaagt

SEQ ID NO: 13527 - DNA, 20 bp, Artificial Sequence
  sgRNA
  Cd3d_1
ttacacagatatatccctcg

SEQ ID NO: 13528 - DNA, 20 bp, Artificial Sequence
  sgRNA
  Cd3d_2
tccatctagatgcatgacgc

SEQ ID NO: 13529 - DNA, 20 bp, Artificial Sequence
  sgRNA
  Cd3d_3
aagaataaaacactcaactt

SEQ ID NO: 13530 - DNA, 20 bp, Artificial Sequence
  sgRNA
  Cd3d_4
gatacaagtgaccgaatatg

SEQ ID NO: 13531 - DNA, 20 bp, Artificial Sequence
  sgRNA
  Cd3d_5
catgcatctagatggaacgg

SEQ ID NO: 13532 - DNA, 20 bp, Artificial Sequence
  sgRNA
  Cd3d_6
gtatcttcacgatctcgaag

SEQ ID NO: 13533 - DNA, 20 bp, Artificial Sequence
  sgRNA
  Cd3d_7
gtttctctgataatgtctta

SEQ ID NO: 13534 - DNA, 20 bp, Artificial Sequence
  sgRNA
  Cd3d_8
aaggcgttctggacccacga

SEQ ID NO: 13535 - DNA, 20 bp, Artificial Sequence
  sgRNA
  Cd3d_9
cgagggatatatctgtgtaa

SEQ ID NO: 13536 - DNA, 20 bp, Artificial Sequence
  sgRNA
  Cd3d_10
tgctttgcaggacatgagac

SEQ ID NO: 13537 - DNA, 20 bp, Artificial Sequence
  sgRNA
  Cd3d_11
ccaggagcagagttgcgatg

SEQ ID NO: 13538 - DNA, 20 bp, Artificial Sequence
  sgRNA
  Cd3d_12
aatgaagatgacaccagcca

SEQ ID NO: 13539 - DNA, 20 bp, Artificial Sequence
  sgRNA
  Cd3d_13
gaactgtgtggagctagact

SEQ ID NO: 13540 - DNA, 20 bp, Artificial Sequence
  sgRNA
  Cd3d_14
ggggccagttccctccaaga

SEQ ID NO: 13541 - DNA, 20 bp, Artificial Sequence
  sgRNA
  Cd3d_15
ttgcaggacatgagaccgga

SEQ ID NO: 13542 - DNA, 20 bp, Artificial Sequence
  sgRNA
  Cd3d_16
aaaggcgttctggacccacg

SEQ ID NO: 13543 - DNA, 20 bp, Artificial Sequence
  sgRNA
  Cd3d_17
accagcgtcatgcatctaga

SEQ ID NO: 13544 - DNA, 20 bp, Artificial Sequence
  sgRNA
  Cd3d_18
ggagctagactcgggcacca

SEQ ID NO: 13545 - DNA, 20 bp, Artificial Sequence
  sgRNA
  Cd3d_19
tacacagatatatccctcgt

SEQ ID NO: 13546 - DNA, 20 bp, Artificial Sequence
  sgRNA
  Cd3d_20
cggtcacttgtatcttgaag

SEQ ID NO: 13547 - DNA, 20 bp, Artificial Sequence
  sgRNA
  Cd3g_1
tgacactgatacgtgcctcg

SEQ ID NO: 13548 - DNA, 20 bp, Artificial Sequence
  sgRNA
  Cd3g_2
ttctgtaatacacttgcagg

SEQ ID NO: 13549 - DNA, 20 bp, Artificial Sequence
  sgRNA
  Cd3g_3
aactgcattgagctaaacat

SEQ ID NO: 13550 - DNA, 20 bp, Artificial Sequence
  sgRNA
  Cd3g_4
gtacaagtggatggcagccg

SEQ ID NO: 13551 - DNA, 20 bp, Artificial Sequence
  sgRNA
  Cd3g_5
tgactgacaagactatcaag

SEQ ID NO: 13552 - DNA, 20 bp, Artificial Sequence
  sgRNA
  Cd3g_6
gtatcagtgtcaaggagcaa

SEQ ID NO: 13553 - DNA, 20 bp, Artificial Sequence
  sgRNA
  Cd3g_7
actatcaagtggcttaaaga

SEQ ID NO: 13554 - DNA, 20 bp, Artificial Sequence
  sgRNA
  Cd3g_8
ctatcaagtggcttaaagac

SEQ ID NO: 13555 - DNA, 20 bp, Artificial Sequence
  sgRNA
  Cd3g_9
gacctcagcgaagataaagc

SEQ ID NO: 13556 - DNA, 20 bp, Artificial Sequence
  sgRNA
  Cd3g_10
tgagatatacaccaagagca

SEQ ID NO: 13557 - DNA, 20 bp, Artificial Sequence
  sgRNA
  Cd3g_11
gaagtacagaaccgtctcct

SEQ ID NO: 13558 - DNA, 20 bp, Artificial Sequence
  sgRNA
  Cd3g_12
tcatattcccggtccttgag

SEQ ID NO: 13559 - DNA, 20 bp, Artificial Sequence
  sgRNA
  Cd3g_13
gtcatattcccggtccttga

SEQ ID NO: 13560 - DNA, 20 bp, Artificial Sequence
  sgRNA
  Cd3g_14
atctccaaggaaaccaactg

SEQ ID NO: 13561 - DNA, 20 bp, Artificial Sequence
  sgRNA
  Cd3g_15
tcagttggtttccttggaga

SEQ ID NO: 13562 - DNA, 20 bp, Artificial Sequence
  sgRNA
  Cd3g_16
atccggctttatcttcgctg

SEQ ID NO: 13563 - DNA, 20 bp, Artificial Sequence
  sgRNA
  Cd3g_17
cttgaagaagagagatcacc

SEQ ID NO: 13564 - DNA, 20 bp, Artificial Sequence
  sgRNA
  Cd3g_18
gacactgatacgtgcctcga

SEQ ID NO: 13565 - DNA, 20 bp, Artificial Sequence
  sgRNA
  Cd3g_19
ggtcatattcccggtccttg

SEQ ID NO: 13566 - DNA, 20 bp, Artificial Sequence
  sgRNA
  Cd3g_20
ggttctgtacttctgacttg

SEQ ID NO: 13567 - DNA, 20 bp, Artificial Sequence
  sgRNA
  Cd4_1
tcaaaacgatcaaactgcga

SEQ ID NO: 13568 - DNA, 20 bp, Artificial Sequence
  sgRNA
  Cd4_2
tatcacggcctataagagtg

SEQ ID NO: 13569 - DNA, 20 bp, Artificial Sequence
  sgRNA
  Cd4_3
actcaccctcaagatacccc

SEQ ID NO: 13570 - DNA, 20 bp, Artificial Sequence
  sgRNA
  Cd4_4
ttcttctgggaactctcgca

SEQ ID NO: 13571 - DNA, 20 bp, Artificial Sequence
  sgRNA
  Cd4_5
ttaagtttattgatgatgag

SEQ ID NO: 13572 - DNA, 20 bp, Artificial Sequence
  sgRNA
  Cd4_6
gcagagcctgaccctgacct

SEQ ID NO: 13573 - DNA, 20 bp, Artificial Sequence
  sgRNA
  Cd4_7
cgagacctggggtatcttga

SEQ ID NO: 13574 - DNA, 20 bp, Artificial Sequence
  sgRNA
  Cd4_8
aactcctagctgtcactcaa

SEQ ID NO: 13575 - DNA, 20 bp, Artificial Sequence
  sgRNA
  Cd4_9
cctggaagttctctgaccag

SEQ ID NO: 13576 - DNA, 20 bp, Artificial Sequence
  sgRNA
  Cd4_10
gctctgcccttgcaacaggc

SEQ ID NO: 13577 - DNA, 20 bp, Artificial Sequence
  sgRNA
  Cd4_11
gctgccccagaatcttcctc

SEQ ID NO: 13578 - DNA, 20 bp, Artificial Sequence
  sgRNA
  Cd4_12
tgtgtttgcactctgtcaag

SEQ ID NO: 13579 - DNA, 20 bp, Artificial Sequence
  sgRNA
  Cd4_13
tgactctccctcactcttat

SEQ ID NO: 13580 - DNA, 20 bp, Artificial Sequence
  sgRNA
  Cd4_14
agtcgctgtcctgaaccctt

SEQ ID NO: 13581 - DNA, 20 bp, Artificial Sequence
  sgRNA
  Cd4_15
cctgaagcaggagaaccagg

SEQ ID NO: 13582 - DNA, 20 bp, Artificial Sequence
  sgRNA
  Cd4_16
cttcccactcaactttgcag

SEQ ID NO: 13583 - DNA, 20 bp, Artificial Sequence
  sgRNA
  Cd4_17
ctttgtccagagtcagagtc

SEQ ID NO: 13584 - DNA, 20 bp, Artificial Sequence
  sgRNA
  Cd4_18
ggtcagtctcatcttgggag

SEQ ID NO: 13585 - DNA, 20 bp, Artificial Sequence
  sgRNA
  Cd4_19
tgtcactcaagggaagacgc

SEQ ID NO: 13586 - DNA, 20 bp, Artificial Sequence
  sgRNA
  Cd4_20
aaggaaacccagaaagccga

SEQ ID NO: 13587 - DNA, 20 bp, Artificial Sequence
  sgRNA
  Cd40_1
attcgcctgagtcacatggg

SEQ ID NO: 13588 - DNA, 20 bp, Artificial Sequence
  sgRNA
  Cd40_2
gggatgacagacggtatcag

SEQ ID NO: 13589 - DNA, 20 bp, Artificial Sequence
  sgRNA
  Cd40_3
agtcagactaatgtcatctg

SEQ ID NO: 13590 - DNA, 20 bp, Artificial Sequence
  sgRNA
  Cd40_4
ctgcaccagcaaggattgcg

SEQ ID NO: 13591 - DNA, 20 bp, Artificial Sequence
  sgRNA
  Cd40_5
gcgaatctccctgttccact

SEQ ID NO: 13592 - DNA, 20 bp, Artificial Sequence
  sgRNA
  Cd40_6
gatcttgccgtcgagccgca

SEQ ID NO: 13593 - DNA, 20 bp, Artificial Sequence
  sgRNA
  Cd40_7
tctccataactccaaagcca

SEQ ID NO: 13594 - DNA, 20 bp, Artificial Sequence
  sgRNA
  Cd40_8
tcttaccccctgcggctcga

SEQ ID NO: 13595 - DNA, 20 bp, Artificial Sequence
  sgRNA
  Cd40_9
ggataatcttccatctcctg

SEQ ID NO: 13596 - DNA, 20 bp, Artificial Sequence
  sgRNA
  Cd40_10
agaattcgcctgagtcacat

SEQ ID NO: 13597 - DNA, 20 bp, Artificial Sequence
  sgRNA
  Cd40_11
gggataatcttccatctcct

SEQ ID NO: 13598 - DNA, 20 bp, Artificial Sequence
  sgRNA
  Cd40_12
gctggcacaaatcacagcac

SEQ ID NO: 13599 - DNA, 20 bp, Artificial Sequence
  sgRNA
  Cd40_13
ccagtgcaggagacgctgca

SEQ ID NO: 13600 - DNA, 20 bp, Artificial Sequence
  sgRNA
  Cd40_14
tcttgccgtcgagccgcagg

SEQ ID NO: 13601 - DNA, 20 bp, Artificial Sequence
  sgRNA
  Cd40_15
gctaactttcaacatgccgg

SEQ ID NO: 13602 - DNA, 20 bp, Artificial Sequence
  sgRNA
  Cd40_16
gagaagaagccgactgggca

SEQ ID NO: 13603 - DNA, 20 bp, Artificial Sequence
  sgRNA
  Cd40_17
gacaaacagtacctccacga

SEQ ID NO: 13604 - DNA, 20 bp, Artificial Sequence
  sgRNA
  Cd40_18
actccaaagccagggataca

SEQ ID NO: 13605 - DNA, 20 bp, Artificial Sequence
  sgRNA
  Cd40_19
gattggagaagaagccgact

SEQ ID NO: 13606 - DNA, 20 bp, Artificial Sequence
  sgRNA
  Cd40_20
ccccatagcgcgcacagccg

SEQ ID NO: 13607 - DNA, 20 bp, Artificial Sequence
  sgRNA
  Cd40lg_1
tatttcaaaacaggtcgaag

SEQ ID NO: 13608 - DNA, 20 bp, Artificial Sequence
  sgRNA
  Cd40lg_2
aagctaaagagatgcaacaa

SEQ ID NO: 13609 - DNA, 20 bp, Artificial Sequence
  sgRNA
  Cd40lg_3
ttataccatgaaaagcaact

SEQ ID NO: 13610 - DNA, 20 bp, Artificial Sequence
  sgRNA
  Cd40lg_4
tgaactgtgaggagatgaga

SEQ ID NO: 13611 - DNA, 20 bp, Artificial Sequence
  sgRNA
  Cd40lg_5
agtcaacgcccattcatcgt

SEQ ID NO: 13612 - DNA, 20 bp, Artificial Sequence
  sgRNA
  Cd40lg_6
catctcctcacagttcagca

SEQ ID NO: 13613 - DNA, 20 bp, Artificial Sequence
  sgRNA
  Cd40lg_7
cagcagtctgttcacttggg

SEQ ID NO: 13614 - DNA, 20 bp, Artificial Sequence
  sgRNA
  Cd40lg_8
tgaaaatgggaaacagctga

SEQ ID NO: 13615 - DNA, 20 bp, Artificial Sequence
  sgRNA
  Cd40lg_9
aagtcaccttctgctctaat

SEQ ID NO: 13616 - DNA, 20 bp, Artificial Sequence
  sgRNA
  Cd40lg_10
gagcagcagtctgttcactt

SEQ ID NO: 13617 - DNA, 20 bp, Artificial Sequence
  sgRNA
  Cd40lg_11
gttctacagtgggccaagaa

SEQ ID NO: 13618 - DNA, 20 bp, Artificial Sequence
  sgRNA
  Cd40lg_12
tgtgtatcttcatagaagat

SEQ ID NO: 13619 - DNA, 20 bp, Artificial Sequence
  sgRNA
  Cd40lg_13
ctgctgctcgcaaagctggg

SEQ ID NO: 13620 - DNA, 20 bp, Artificial Sequence
  sgRNA
  Cd40lg_14
attctctcagatccactgct

SEQ ID NO: 13621 - DNA, 20 bp, Artificial Sequence
  sgRNA
  Cd40lg_15
gttgccacggatctggggga

SEQ ID NO: 13622 - DNA, 20 bp, Artificial Sequence
  sgRNA
  Cd40lg_16
gcaaagctgggaggaactgt

SEQ ID NO: 13623 - DNA, 20 bp, Artificial Sequence
  sgRNA
  Cd40lg_17
ataaaaatcttcatgctcgc

SEQ ID NO: 13624 - DNA, 20 bp, Artificial Sequence
  sgRNA
  Cd40lg_18
aggctcccgattagagcaga

SEQ ID NO: 13625 - DNA, 20 bp, Artificial Sequence
  sgRNA
  Cd40lg_19
ccaaccttcccccagatccg

SEQ ID NO: 13626 - DNA, 20 bp, Artificial Sequence
  sgRNA
  Cd40lg_20
ggagtgtttgaattacaagc

SEQ ID NO: 13627 - DNA, 20 bp, Artificial Sequence
  sgRNA
  Cd44_1
gcaatatgtgtcatagtggg

SEQ ID NO: 13628 - DNA, 20 bp, Artificial Sequence
  sgRNA
  Cd44_2
tcatggagaaaattggaccc

SEQ ID NO: 13629 - DNA, 20 bp, Artificial Sequence
  sgRNA
  Cd44_3
tctgtgcgggcagaaacccg

SEQ ID NO: 13630 - DNA, 20 bp, Artificial Sequence
  sgRNA
  Cd44_4
cagtccgggagatactgtag

SEQ ID NO: 13631 - DNA, 20 bp, Artificial Sequence
  sgRNA
  Cd44_5
ggagccatcaacattaacgt

SEQ ID NO: 13632 - DNA, 20 bp, Artificial Sequence
  sgRNA
  Cd44_6
gattcttgccgtctgcatcg

SEQ ID NO: 13633 - DNA, 20 bp, Artificial Sequence
  sgRNA
  Cd44_7
catggaatacacctgcgtag

SEQ ID NO: 13634 - DNA, 20 bp, Artificial Sequence
  sgRNA
  Cd44_8
gacccaatctcacatccaat

SEQ ID NO: 13635 - DNA, 20 bp, Artificial Sequence
  sgRNA
  Cd44_9
gagtcatcctgatctccagt

SEQ ID NO: 13636 - DNA, 20 bp, Artificial Sequence
  sgRNA
  Cd44_10
gaaacccagtgagctcaacg

SEQ ID NO: 13637 - DNA, 20 bp, Artificial Sequence
  sgRNA
  Cd44_11
agacgtggtttcagaacgga

SEQ ID NO: 13638 - DNA, 20 bp, Artificial Sequence
  sgRNA
  Cd44_12
tgctgtagcgagtaccatca

SEQ ID NO: 13639 - DNA, 20 bp, Artificial Sequence
  sgRNA
  Cd44_13
tactactccagacaaccacc

SEQ ID NO: 13640 - DNA, 20 bp, Artificial Sequence
  sgRNA
  Cd44_14
aaggaaatgtggtaattccg

SEQ ID NO: 13641 - DNA, 20 bp, Artificial Sequence
  sgRNA
  Cd44_15
ggtactcgctacagcaagaa

SEQ ID NO: 13642 - DNA, 20 bp, Artificial Sequence
  sgRNA
  Cd44_16
agtgacccctgctaaaactg

SEQ ID NO: 13643 - DNA, 20 bp, Artificial Sequence
  sgRNA
  Cd44_17
gagtcaaataccaacccaac

SEQ ID NO: 13644 - DNA, 20 bp, Artificial Sequence
  sgRNA
  Cd44_18
cttcctactgaacagcctac

SEQ ID NO: 13645 - DNA, 20 bp, Artificial Sequence
  sgRNA
  Cd44_19
tctgcatcgcggtcaatagt

SEQ ID NO: 13646 - DNA, 20 bp, Artificial Sequence
  sgRNA
  Cd44_20
ggcgctaaagatgcaagaag

SEQ ID NO: 13647 - DNA, 20 bp, Artificial Sequence
  sgRNA
  Cd46_1
ctgtgagccaaatcatacat

SEQ ID NO: 13648 - DNA, 20 bp, Artificial Sequence
  sgRNA
  Cd46_2
tccatagcttcaaatggccg

SEQ ID NO: 13649 - DNA, 20 bp, Artificial Sequence
  sgRNA
  Cd46_3
ggcctcagcatagacgccca

SEQ ID NO: 13650 - DNA, 20 bp, Artificial Sequence
  sgRNA
  Cd46_4
acagttgtgatcctacccca

SEQ ID NO: 13651 - DNA, 20 bp, Artificial Sequence
  sgRNA
  Cd46_5
ggcaaagtatactacataga

SEQ ID NO: 13652 - DNA, 20 bp, Artificial Sequence
  sgRNA
  Cd46_6
cctgtgagccaaatcataca

SEQ ID NO: 13653 - DNA, 20 bp, Artificial Sequence
  sgRNA
  Cd46_7
ccaaatccagtactacaaaa

SEQ ID NO: 13654 - DNA, 20 bp, Artificial Sequence
  sgRNA
  Cd46_8
aaatggccgtggtagttcac

SEQ ID NO: 13655 - DNA, 20 bp, Artificial Sequence
  sgRNA
  Cd46_9
ccaacggcataaaagagttt

SEQ ID NO: 13656 - DNA, 20 bp, Artificial Sequence
  sgRNA
  Cd46_10
ggatatcctagtccccgtga

SEQ ID NO: 13657 - DNA, 20 bp, Artificial Sequence
  sgRNA
  Cd46_11
ggaaaacttatctggccctg

SEQ ID NO: 13658 - DNA, 20 bp, Artificial Sequence
  sgRNA
  Cd46_12
gttctacactgtgtgcttaa

SEQ ID NO: 13659 - DNA, 20 bp, Artificial Sequence
  sgRNA
  Cd46_13
cctgtataattataaactgg

SEQ ID NO: 13660 - DNA, 20 bp, Artificial Sequence
  sgRNA
  Cd46_14
tttgaagctatggaactcaa

SEQ ID NO: 13661 - DNA, 20 bp, Artificial Sequence
  sgRNA
  Cd46_15
gctcacaggtagcaatcatc

SEQ ID NO: 13662 - DNA, 20 bp, Artificial Sequence
  sgRNA
  Cd46_16
tggctaaatattccttcacg

SEQ ID NO: 13663 - DNA, 20 bp, Artificial Sequence
  sgRNA
  Cd46_17
ccacctccaaaaataaaaaa

SEQ ID NO: 13664 - DNA, 20 bp, Artificial Sequence
  sgRNA
  Cd46_18
tctgtgctggccataacacc

SEQ ID NO: 13665 - DNA, 20 bp, Artificial Sequence
  sgRNA
  Cd46_19
ttacatggaaggcagtagca

SEQ ID NO: 13666 - DNA, 20 bp, Artificial Sequence
  sgRNA
  Cd46_20
atgagacagcagaaacagaa

SEQ ID NO: 13667 - DNA, 20 bp, Artificial Sequence
  sgRNA
  Cd47_1
atcagcctgttcttacgagg

SEQ ID NO: 13668 - DNA, 20 bp, Artificial Sequence
  sgRNA
  Cd47_2
ggataagcgcgatgccatgg

SEQ ID NO: 13669 - DNA, 20 bp, Artificial Sequence
  sgRNA
  Cd47_3
cacttcatgcaatgaaactg

SEQ ID NO: 13670 - DNA, 20 bp, Artificial Sequence
  sgRNA
  Cd47_4
gaatgattctcttattcgta

SEQ ID NO: 13671 - DNA, 20 bp, Artificial Sequence
  sgRNA
  Cd47_5
ccacattacggacgatgcaa

SEQ ID NO: 13672 - DNA, 20 bp, Artificial Sequence
  sgRNA
  Cd47_6
gcctcattgtaatctctacg

SEQ ID NO: 13673 - DNA, 20 bp, Artificial Sequence
  sgRNA
  Cd47_7
tatagagctgaaaaaccgca

SEQ ID NO: 13674 - DNA, 20 bp, Artificial Sequence
  sgRNA
  Cd47_8
tcagtctcagacttaatcaa

SEQ ID NO: 13675 - DNA, 20 bp, Artificial Sequence
  sgRNA
  Cd47_9
gataagcgcgatgccatggt

SEQ ID NO: 13676 - DNA, 20 bp, Artificial Sequence
  sgRNA
  Cd47_10
aggatcagcctgttcttacg

SEQ ID NO: 13677 - DNA, 20 bp, Artificial Sequence
  sgRNA
  Cd47_11
gctgtagaggaaccccttaa

SEQ ID NO: 13678 - DNA, 20 bp, Artificial Sequence
  sgRNA
  Cd47_12
gatgactgtgagcaccagcc

SEQ ID NO: 13679 - DNA, 20 bp, Artificial Sequence
  sgRNA
  Cd47_13
acaggagtatagccaaaatt

SEQ ID NO: 13680 - DNA, 20 bp, Artificial Sequence
  sgRNA
  Cd47_14
gctggtgctcacagtcatcg

SEQ ID NO: 13681 - DNA, 20 bp, Artificial Sequence
  sgRNA
  Cd47_15
gacacagcccgaccaaagca

SEQ ID NO: 13682 - DNA, 20 bp, Artificial Sequence
  sgRNA
  Cd47_16
gcaagtgtagtttcccacca

SEQ ID NO: 13683 - DNA, 20 bp, Artificial Sequence
  sgRNA
  Cd47_17
tcttacgaggaggagaaagg

SEQ ID NO: 13684 - DNA, 20 bp, Artificial Sequence
  sgRNA
  Cd47_18
ttgcatcgtccgtaatgtgg

SEQ ID NO: 13685 - DNA, 20 bp, Artificial Sequence
  sgRNA
  Cd47_19
ccaaacctgaaatcaaaagg

SEQ ID NO: 13686 - DNA, 20 bp, Artificial Sequence
  sgRNA
  Cd47_20
gctgggctacgtccttgctt

SEQ ID NO: 13687 - DNA, 20 bp, Artificial Sequence
  sgRNA
  Cd48_1
atacgtttatatggtccaag

SEQ ID NO: 13688 - DNA, 20 bp, Artificial Sequence
  sgRNA
  Cd48_2
tcacctgaggctatcgtgtg

SEQ ID NO: 13689 - DNA, 20 bp, Artificial Sequence
  sgRNA
  Cd48_3
gaacgagttgaagataaccc

SEQ ID NO: 13690 - DNA, 20 bp, Artificial Sequence
  sgRNA
  Cd48_4
ccttgaaatccagttcccaa

SEQ ID NO: 13691 - DNA, 20 bp, Artificial Sequence
  sgRNA
  Cd48_5
gtgtcgttcttgctgcttac

SEQ ID NO: 13692 - DNA, 20 bp, Artificial Sequence
  sgRNA
  Cd48_6
gagtatgttggactgcaact

SEQ ID NO: 13693 - DNA, 20 bp, Artificial Sequence
  sgRNA
  Cd48_7
ttacctcacacgatagcctc

SEQ ID NO: 13694 - DNA, 20 bp, Artificial Sequence
  sgRNA
  Cd48_8
cgagtctgaatttaaaggca

SEQ ID NO: 13695 - DNA, 20 bp, Artificial Sequence
  sgRNA
  Cd48_9
gaactgctactgctgccctt

SEQ ID NO: 13696 - DNA, 20 bp, Artificial Sequence
  sgRNA
  Cd48_10
ccagatataaatgccaccac

SEQ ID NO: 13697 - DNA, 20 bp, Artificial Sequence
  sgRNA
  Cd48_11
gtttatcttgaagaaaacaa

SEQ ID NO: 13698 - DNA, 20 bp, Artificial Sequence
  sgRNA
  Cd48_12
tgtaaccctgaaaatccata

SEQ ID NO: 13699 - DNA, 20 bp, Artificial Sequence
  sgRNA
  Cd48_13
tcacaacactcatcattcac

SEQ ID NO: 13700 - DNA, 20 bp, Artificial Sequence
  sgRNA
  Cd48_14
acgcagcactctcatgtagt

SEQ ID NO: 13701 - DNA, 20 bp, Artificial Sequence
  sgRNA
  Cd48_15
cctttccccaaaaagagtcc

SEQ ID NO: 13702 - DNA, 20 bp, Artificial Sequence
  sgRNA
  Cd48_16
gaccatataaacgtatcacc

SEQ ID NO: 13703 - DNA, 20 bp, Artificial Sequence
  sgRNA
  Cd48_17
taaaatgtagacttgttctg

SEQ ID NO: 13704 - DNA, 20 bp, Artificial Sequence
  sgRNA
  Cd48_18
ctatacttggtatgagagct

SEQ ID NO: 13705 - DNA, 20 bp, Artificial Sequence
  sgRNA
  Cd48_19
accagcatgttgactatact

SEQ ID NO: 13706 - DNA, 20 bp, Artificial Sequence
  sgRNA
  Cd48_20
ttggactgcaacttggctag

SEQ ID NO: 13707 - DNA, 20 bp, Artificial Sequence
  sgRNA
  Cd5_1
actgcagagacttacagatg

SEQ ID NO: 13708 - DNA, 20 bp, Artificial Sequence
  sgRNA
  Cd5_2
cactgctgcccccgaccagg

SEQ ID NO: 13709 - DNA, 20 bp, Artificial Sequence
  sgRNA
  Cd5_3
gtgtgcaaacagctgagatg

SEQ ID NO: 13710 - DNA, 20 bp, Artificial Sequence
  sgRNA
  Cd5_4
tgagacacagctcccgttcg

SEQ ID NO: 13711 - DNA, 20 bp, Artificial Sequence
  sgRNA
  Cd5_5
ttgcagttggatatagacca

SEQ ID NO: 13712 - DNA, 20 bp, Artificial Sequence
  sgRNA
  Cd5_6
gcctcccatcgaattggcaa

SEQ ID NO: 13713 - DNA, 20 bp, Artificial Sequence
  sgRNA
  Cd5_7
gggtcaagtggagatccaga

SEQ ID NO: 13714 - DNA, 20 bp, Artificial Sequence
  sgRNA
  Cd5_8
agtgcgccagagatcacagt

SEQ ID NO: 13715 - DNA, 20 bp, Artificial Sequence
  sgRNA
  Cd5_9
cagtgactatgacctgcaag

SEQ ID NO: 13716 - DNA, 20 bp, Artificial Sequence
  sgRNA
  Cd5_10
caccccttccagactgtccg

SEQ ID NO: 13717 - DNA, 20 bp, Artificial Sequence
  sgRNA
  Cd5_11
gatatccaggtgatgctaag

SEQ ID NO: 13718 - DNA, 20 bp, Artificial Sequence
  sgRNA
  Cd5_12
tgtcaggttgtgtagaagat

SEQ ID NO: 13719 - DNA, 20 bp, Artificial Sequence
  sgRNA
  Cd5_13
agtgagacacagctcccgtt

SEQ ID NO: 13720 - DNA, 20 bp, Artificial Sequence
  sgRNA
  Cd5_14
gcccaaggttcagagccgcc

SEQ ID NO: 13721 - DNA, 20 bp, Artificial Sequence
  sgRNA
  Cd5_15
cctcatctccttccacacgg

SEQ ID NO: 13722 - DNA, 20 bp, Artificial Sequence
  sgRNA
  Cd5_16
gcagtgcttccagaaaacaa

SEQ ID NO: 13723 - DNA, 20 bp, Artificial Sequence
  sgRNA
  Cd5_17
ccaggcccttgccaattcga

SEQ ID NO: 13724 - DNA, 20 bp, Artificial Sequence
  sgRNA
  Cd5_18
atgctgacaaaacctccccc

SEQ ID NO: 13725 - DNA, 20 bp, Artificial Sequence
  sgRNA
  Cd5_19
agatccagatggaaaacaag

SEQ ID NO: 13726 - DNA, 20 bp, Artificial Sequence
  sgRNA
  Cd5_20
gacaggtgagagttcctggg

SEQ ID NO: 13727 - DNA, 20 bp, Artificial Sequence
  sgRNA
  Cd52_1
agtaccagaagcggccgtag

SEQ ID NO: 13728 - DNA, 20 bp, Artificial Sequence
  sgRNA
  Cd52_2
aaaaaacccccttaaagagt

SEQ ID NO: 13729 - DNA, 20 bp, Artificial Sequence
  sgRNA
  Cd52_3
cagatacaaacaggatcctt

SEQ ID NO: 13730 - DNA, 20 bp, Artificial Sequence
  sgRNA
  Cd52_4
caaccagaagaatgatagtg

SEQ ID NO: 13731 - DNA, 20 bp, Artificial Sequence
  sgRNA
  Cd52_5
ttaaggtattggcaaagaag

SEQ ID NO: 13732 - DNA, 20 bp, Artificial Sequence
  sgRNA
  Cd52_6
gatgaggccccactctttaa

SEQ ID NO: 13733 - DNA, 20 bp, Artificial Sequence
  sgRNA
  Cd52_7
tgaggccccactctttaagg

SEQ ID NO: 13734 - DNA, 20 bp, Artificial Sequence
  sgRNA
  Cd52_8
gcaggcacccgcatcgatga

SEQ ID NO: 13735 - DNA, 20 bp, Artificial Sequence
  sgRNA
  Cd52_9
atgaggccccactctttaag

SEQ ID NO: 13736 - DNA, 20 bp, Artificial Sequence
  sgRNA
  Cd52_10
gcctcatccatcatcgatgc

SEQ ID NO: 13737 - DNA, 20 bp, Artificial Sequence
  sgRNA
  Cd52_11
ggcctcatccatcatcgatg

SEQ ID NO: 13738 - DNA, 20 bp, Artificial Sequence
  sgRNA
  Cd52_12
ggcaaagaagaggaaactgc

SEQ ID NO: 13739 - DNA, 20 bp, Artificial Sequence
  sgRNA
  Cd52_13
ggccgtagtggcttgtccca

SEQ ID NO: 13740 - DNA, 20 bp, Artificial Sequence
  sgRNA
  Cd52_14
acccgcatcgatgatggatg

SEQ ID NO: 13741 - DNA, 20 bp, Artificial Sequence
  sgRNA
  Cd52_15
atccttgggacaagccacta

SEQ ID NO: 13742 - DNA, 20 bp, Artificial Sequence
  sgRNA
  Cd52_16
gaatgatagtgaggaagagg

SEQ ID NO: 13743 - DNA, 20 bp, Artificial Sequence
  sgRNA
  Cd52_17
gaggtagaagaggcacatta

SEQ ID NO: 13744 - DNA, 20 bp, Artificial Sequence
  sgRNA
  Cd52_18
caagccactacggccgcttc

SEQ ID NO: 13745 - DNA, 20 bp, Artificial Sequence
  sgRNA
  Cd52_19
cttcctcactatcattcttc

SEQ ID NO: 13746 - DNA, 20 bp, Artificial Sequence
  sgRNA
  Cd52_20
gaagaggcacattaaggtat

SEQ ID NO: 13747 - DNA, 20 bp, Artificial Sequence
  sgRNA
  Cd53_1
gttacggaagagtactccat

SEQ ID NO: 13748 - DNA, 20 bp, Artificial Sequence
  sgRNA
  Cd53_2
cattgtgggatccattatca

SEQ ID NO: 13749 - DNA, 20 bp, Artificial Sequence
  sgRNA
  Cd53_3
gctgattattctccttgctg

SEQ ID NO: 13750 - DNA, 20 bp, Artificial Sequence
  sgRNA
  Cd53_4
aatgactcaccgacataagc

SEQ ID NO: 13751 - DNA, 20 bp, Artificial Sequence
  sgRNA
  Cd53_5
gttgccttcttgggttgcat

SEQ ID NO: 13752 - DNA, 20 bp, Artificial Sequence
  sgRNA
  Cd53_6
atgttgccaagtgtcaggaa

SEQ ID NO: 13753 - DNA, 20 bp, Artificial Sequence
  sgRNA
  Cd53_7
ggctcaagtgattggaccag

SEQ ID NO: 13754 - DNA, 20 bp, Artificial Sequence
  sgRNA
  Cd53_8
gctataataaggcaaaatcg

SEQ ID NO: 13755 - DNA, 20 bp, Artificial Sequence
  sgRNA
  Cd53_9
gattccaatatacaagaaat

SEQ ID NO: 13756 - DNA, 20 bp, Artificial Sequence
  sgRNA
  Cd53_10
aaccttcccttcctgacact

SEQ ID NO: 13757 - DNA, 20 bp, Artificial Sequence
  sgRNA
  Cd53_11
atcatggtagttgccttctt

SEQ ID NO: 13758 - DNA, 20 bp, Artificial Sequence
  sgRNA
  Cd53_12
ttcctggtccaaaataccta

SEQ ID NO: 13759 - DNA, 20 bp, Artificial Sequence
  sgRNA
  Cd53_13
ctgtatcacacatacacaga

SEQ ID NO: 13760 - DNA, 20 bp, Artificial Sequence
  sgRNA
  Cd53_14
cctgaacatctgcacctgat

SEQ ID NO: 13761 - DNA, 20 bp, Artificial Sequence
  sgRNA
  Cd53_15
gcagttgagtgtcagtgcaa

SEQ ID NO: 13762 - DNA, 20 bp, Artificial Sequence
  sgRNA
  Cd53_16
gtgtcaggaagggaaggtta

SEQ ID NO: 13763 - DNA, 20 bp, Artificial Sequence
  sgRNA
  Cd53_17
ccagattgacaaaacaagcc

SEQ ID NO: 13764 - DNA, 20 bp, Artificial Sequence
  sgRNA
  Cd53_18
acaaaacaagccaggcttta

SEQ ID NO: 13765 - DNA, 20 bp, Artificial Sequence
  sgRNA
  Cd53_19
ccagaatgttgccaagtgtc

SEQ ID NO: 13766 - DNA, 20 bp, Artificial Sequence
  sgRNA
  Cd53_20
ttcatacacaaagagcagga

SEQ ID NO: 13767 - DNA, 20 bp, Artificial Sequence
  sgRNA
  Cd55_1
ctcttatacgtatagccagg

SEQ ID NO: 13768 - DNA, 20 bp, Artificial Sequence
  sgRNA
  Cd55_2
ctgctgtccccaactgtacg

SEQ ID NO: 13769 - DNA, 20 bp, Artificial Sequence
  sgRNA
  Cd55_3
tgtgacagaacagaaagtag

SEQ ID NO: 13770 - DNA, 20 bp, Artificial Sequence
  sgRNA
  Cd55_4
cgaaaacaacctccactccc

SEQ ID NO: 13771 - DNA, 20 bp, Artificial Sequence
  sgRNA
  Cd55_5
gacaaaggagagcctaacac

SEQ ID NO: 13772 - DNA, 20 bp, Artificial Sequence
  sgRNA
  Cd55_6
aatggtgtccacaaaacaag

SEQ ID NO: 13773 - DNA, 20 bp, Artificial Sequence
  sgRNA
  Cd55_7
gagccaccaaaaatcaacaa

SEQ ID NO: 13774 - DNA, 20 bp, Artificial Sequence
  sgRNA
  Cd55_8
aatggagcagtccaccaccc

SEQ ID NO: 13775 - DNA, 20 bp, Artificial Sequence
  sgRNA
  Cd55_9
ttgtctgtagatgttcttat

SEQ ID NO: 13776 - DNA, 20 bp, Artificial Sequence
  sgRNA
  Cd55_10
gtacttggaacattaattgt

SEQ ID NO: 13777 - DNA, 20 bp, Artificial Sequence
  sgRNA
  Cd55_11
gggtttctgaggcgttgagg

SEQ ID NO: 13778 - DNA, 20 bp, Artificial Sequence
  sgRNA
  Cd55_12
ggtcatttggccaatcagtc

SEQ ID NO: 13779 - DNA, 20 bp, Artificial Sequence
  sgRNA
  Cd55_13
aggaaaagcaacttgccttg

SEQ ID NO: 13780 - DNA, 20 bp, Artificial Sequence
  sgRNA
  Cd55_14
tatggtaagtttgactcaca

SEQ ID NO: 13781 - DNA, 20 bp, Artificial Sequence
  sgRNA
  Cd55_15
catgtgatgctatcactcat

SEQ ID NO: 13782 - DNA, 20 bp, Artificial Sequence
  sgRNA
  Cd55_16
tgactcttatacgtatagcc

SEQ ID NO: 13783 - DNA, 20 bp, Artificial Sequence
  sgRNA
  Cd55_17
cttggtaacaggtacatgct

SEQ ID NO: 13784 - DNA, 20 bp, Artificial Sequence
  sgRNA
  Cd55_18
ggatttacccatcttccctt

SEQ ID NO: 13785 - DNA, 20 bp, Artificial Sequence
  sgRNA
  Cd55_19
ggagcatactggacgcctaa

SEQ ID NO: 13786 - DNA, 20 bp, Artificial Sequence
  sgRNA
  Cd55_20
ataagaacatctacagacaa

SEQ ID NO: 13787 - DNA, 20 bp, Artificial Sequence
  sgRNA
  Cd55b_1
ggtggtgatgaccaagtccc

SEQ ID NO: 13788 - DNA, 20 bp, Artificial Sequence
  sgRNA
  Cd55b_2
gtacttggaacattaactac

SEQ ID NO: 13789 - DNA, 20 bp, Artificial Sequence
  sgRNA
  Cd55b_3
gacccaccaaaaatcaacaa

SEQ ID NO: 13790 - DNA, 20 bp, Artificial Sequence
  sgRNA
  Cd55b_4
cgattcttataaatatagcc

SEQ ID NO: 13791 - DNA, 20 bp, Artificial Sequence
  sgRNA
  Cd55b_5
gacaaaggagagtctaactc

SEQ ID NO: 13792 - DNA, 20 bp, Artificial Sequence
  sgRNA
  Cd55b_6
ctgactttcaaggaaaggag

SEQ ID NO: 13793 - DNA, 20 bp, Artificial Sequence
  sgRNA
  Cd55b_7
tgaaagtcagaccttctgtt

SEQ ID NO: 13794 - DNA, 20 bp, Artificial Sequence
  sgRNA
  Cd55b_8
ttcttataaatatagccagg

SEQ ID NO: 13795 - DNA, 20 bp, Artificial Sequence
  sgRNA
  Cd55b_9
aggaaaatcaacttgccttg

SEQ ID NO: 13796 - DNA, 20 bp, Artificial Sequence
  sgRNA
  Cd55b_10
cgtggtatcaggttcatgct

SEQ ID NO: 13797 - DNA, 20 bp, Artificial Sequence
  sgRNA
  Cd55b_11
gtctgtagatgttcttgtcg

SEQ ID NO: 13798 - DNA, 20 bp, Artificial Sequence
  sgRNA
  Cd55b_12
ctgttgttccaaactgtgtg

SEQ ID NO: 13799 - DNA, 20 bp, Artificial Sequence
  sgRNA
  Cd55b_13
gctggtgctgtcactatcgc

SEQ ID NO: 13800 - DNA, 20 bp, Artificial Sequence
  sgRNA
  Cd55b_14
atatggtagaatttccaaac

SEQ ID NO: 13801 - DNA, 20 bp, Artificial Sequence
  sgRNA
  Cd55b_15
gtagttaatgttccaagtac

SEQ ID NO: 13802 - DNA, 20 bp, Artificial Sequence
  sgRNA
  Cd55b_16
ttaactactggtttcttaat

SEQ ID NO: 13803 - DNA, 20 bp, Artificial Sequence
  sgRNA
  Cd55b_17
acaagaacatctacagacaa

SEQ ID NO: 13804 - DNA, 20 bp, Artificial Sequence
  sgRNA
  Cd55b_18
ttataggaaatactgttgat

SEQ ID NO: 13805 - DNA, 20 bp, Artificial Sequence
  sgRNA
  Cd55b_19
cttgctcacagtacaatata

SEQ ID NO: 13806 - DNA, 20 bp, Artificial Sequence
  sgRNA
  Cd55b_20
agtgacagcaccagcagcag

SEQ ID NO: 13807 - DNA, 20 bp, Artificial Sequence
  sgRNA
  Cd59a_1
tggaaacaatcagattgtca

SEQ ID NO: 13808 - DNA, 20 bp, Artificial Sequence
  sgRNA
  Cd59a_2
aaaccaccggttggaaacag

SEQ ID NO: 13809 - DNA, 20 bp, Artificial Sequence
  sgRNA
  Cd59a_3
caggaatgcaagtgtatcaa

SEQ ID NO: 13810 - DNA, 20 bp, Artificial Sequence
  sgRNA
  Cd59a_4
tagagacaggaatcctggtc

SEQ ID NO: 13811 - DNA, 20 bp, Artificial Sequence
  sgRNA
  Cd59a_5
atattgcatgaagaaaccac

SEQ ID NO: 13812 - DNA, 20 bp, Artificial Sequence
  sgRNA
  Cd59a_6
caaaatggccaccagaaccg

SEQ ID NO: 13813 - DNA, 20 bp, Artificial Sequence
  sgRNA
  Cd59a_7
ctaccactgtttccaaccgg

SEQ ID NO: 13814 - DNA, 20 bp, Artificial Sequence
  sgRNA
  Cd59a_8
tgcatgaagaaaccaccggt

SEQ ID NO: 13815 - DNA, 20 bp, Artificial Sequence
  sgRNA
  Cd59a_9
atgctaccactgtttccaac

SEQ ID NO: 13816 - DNA, 20 bp, Artificial Sequence
  sgRNA
  Cd59a_10
acaaaagtgacggatccttg

SEQ ID NO: 13817 - DNA, 20 bp, Artificial Sequence
  sgRNA
  Cd59a_11
ttggggaagacaccattgct

SEQ ID NO: 13818 - DNA, 20 bp, Artificial Sequence
  sgRNA
  Cd59a_12
aacttgtgtaacaaaagtga

SEQ ID NO: 13819 - DNA, 20 bp, Artificial Sequence
  sgRNA
  Cd59a_13
tggggaagacaccattgctg

SEQ ID NO: 13820 - DNA, 20 bp, Artificial Sequence
  sgRNA
  Cd59a_14
agaacacagccagaagcagc

SEQ ID NO: 13821 - DNA, 20 bp, Artificial Sequence
  sgRNA
  Cd59a_15
agaaccgaggtccccagcaa

SEQ ID NO: 13822 - DNA, 20 bp, Artificial Sequence
  sgRNA
  Cd59a_16
cagcaatggtgtcttcccca

SEQ ID NO: 13823 - DNA, 20 bp, Artificial Sequence
  sgRNA
  Cd59a_17
taagaaacaaagattcaaaa

SEQ ID NO: 13824 - DNA, 20 bp, Artificial Sequence
  sgRNA
  Cd59a_18
tgcaagtgtatcaaaggtgt

SEQ ID NO: 13825 - DNA, 20 bp, Artificial Sequence
  sgRNA
  Cd59a_19
aacaaaagtgacggatcctt

SEQ ID NO: 13826 - DNA, 20 bp, Artificial Sequence
  sgRNA
  Cd59a_20
gctggggacctcggttctgg

SEQ ID NO: 13827 - DNA, 20 bp, Artificial Sequence
  sgRNA
  Cd59b_1
tattatgagccgattagacg

SEQ ID NO: 13828 - DNA, 20 bp, Artificial Sequence
  sgRNA
  Cd59b_2
atgctacaactgtttagacc

SEQ ID NO: 13829 - DNA, 20 bp, Artificial Sequence
  sgRNA
  Cd59b_3
ggcaagtgtatcaacagtgt

SEQ ID NO: 13830 - DNA, 20 bp, Artificial Sequence
  sgRNA
  Cd59b_4
ttgatacacttgccttcctg

SEQ ID NO: 13831 - DNA, 20 bp, Artificial Sequence
  sgRNA
  Cd59b_5
gtatgcctgccacgtctaat

SEQ ID NO: 13832 - DNA, 20 bp, Artificial Sequence
  sgRNA
  Cd59b_6
caaaatggccaccagaactg

SEQ ID NO: 13833 - DNA, 20 bp, Artificial Sequence
  sgRNA
  Cd59b_7
acaaagcaaatgctgtcagt

SEQ ID NO: 13834 - DNA, 20 bp, Artificial Sequence
  sgRNA
  Cd59b_8
tgaggaagacagcattgctg

SEQ ID NO: 13835 - DNA, 20 bp, Artificial Sequence
  sgRNA
  Cd59b_9
caatgctgtcttcctcaatg

SEQ ID NO: 13836 - DNA, 20 bp, Artificial Sequence
  sgRNA
  Cd59b_10
ttgtgtaacaaaaatcttga

SEQ ID NO: 13837 - DNA, 20 bp, Artificial Sequence
  sgRNA
  Cd59b_11
atgagccgattagacgtggc

SEQ ID NO: 13838 - DNA, 20 bp, Artificial Sequence
  sgRNA
  Cd59b_12
acgcagaaacttcctcattg

SEQ ID NO: 13839 - DNA, 20 bp, Artificial Sequence
  sgRNA
  Cd59b_13
gctggggacctcagttctgg

SEQ ID NO: 13840 - DNA, 20 bp, Artificial Sequence
  sgRNA
  Cd59b_14
ttgaggaagacagcattgct

SEQ ID NO: 13841 - DNA, 20 bp, Artificial Sequence
  sgRNA
  Cd59b_15
ctaaacagttgtagcatttg

SEQ ID NO: 13842 - DNA, 20 bp, Artificial Sequence
  sgRNA
  Cd59b_16
tagagacaggaatccaggtt

SEQ ID NO: 13843 - DNA, 20 bp, Artificial Sequence
  sgRNA
  Cd59b_17
agaagacagccagaagcagc

SEQ ID NO: 13844 - DNA, 20 bp, Artificial Sequence
  sgRNA
  Cd59b_18
cactacttgctctcctaacc

SEQ ID NO: 13845 - DNA, 20 bp, Artificial Sequence
  sgRNA
  Cd59b_19
tcaacagtgttggaaacttt

SEQ ID NO: 13846 - DNA, 20 bp, Artificial Sequence
  sgRNA
  Cd59b_20
taatcggctcataatatagt

SEQ ID NO: 13847 - DNA, 20 bp, Artificial Sequence
  sgRNA
  Cd6_1
gcagcgccgggaatacgacg

SEQ ID NO: 13848 - DNA, 20 bp, Artificial Sequence
  sgRNA
  Cd6_2
gagccaaaggacaatacggt

SEQ ID NO: 13849 - DNA, 20 bp, Artificial Sequence
  sgRNA
  Cd6_3
agcagttcacctgatcgcgg

SEQ ID NO: 13850 - DNA, 20 bp, Artificial Sequence
  sgRNA
  Cd6_4
aatacctgagcagacaaccc

SEQ ID NO: 13851 - DNA, 20 bp, Artificial Sequence
  sgRNA
  Cd6_5
gcctggggtgaagtgcaagc

SEQ ID NO: 13852 - DNA, 20 bp, Artificial Sequence
  sgRNA
  Cd6_6
gaggcattgactcctgcgaa

SEQ ID NO: 13853 - DNA, 20 bp, Artificial Sequence
  sgRNA
  Cd6_7
aggagtgtagcagcgacagg

SEQ ID NO: 13854 - DNA, 20 bp, Artificial Sequence
  sgRNA
  Cd6_8
ccagcgacaccgggtcacag

SEQ ID NO: 13855 - DNA, 20 bp, Artificial Sequence
  sgRNA
  Cd6_9
tctccactcggccagcacag

SEQ ID NO: 13856 - DNA, 20 bp, Artificial Sequence
  sgRNA
  Cd6_10
ctatgaagatggtggagacg

SEQ ID NO: 13857 - DNA, 20 bp, Artificial Sequence
  sgRNA
  Cd6_11
gttggagttgttgaaccgcc

SEQ ID NO: 13858 - DNA, 20 bp, Artificial Sequence
  sgRNA
  Cd6_12
caccttgcagaactgccaat

SEQ ID NO: 13859 - DNA, 20 bp, Artificial Sequence
  sgRNA
  Cd6_13
gggctgccacactccctgga

SEQ ID NO: 13860 - DNA, 20 bp, Artificial Sequence
  sgRNA
  Cd6_14
ccgggaatacgacgtgggcg

SEQ ID NO: 13861 - DNA, 20 bp, Artificial Sequence
  sgRNA
  Cd6_15
taccgtgtgcgacgacacgt

SEQ ID NO: 13862 - DNA, 20 bp, Artificial Sequence
  sgRNA
  Cd6_16
catgctccagcatctccact

SEQ ID NO: 13863 - DNA, 20 bp, Artificial Sequence
  sgRNA
  Cd6_17
tcagcaatccagcgatccca

SEQ ID NO: 13864 - DNA, 20 bp, Artificial Sequence
  sgRNA
  Cd6_18
gaggaggattacgatgacat

SEQ ID NO: 13865 - DNA, 20 bp, Artificial Sequence
  sgRNA
  Cd6_19
gctggtggttcactgaagca

SEQ ID NO: 13866 - DNA, 20 bp, Artificial Sequence
  sgRNA
  Cd6_20
ggcaccaactgagagatgca

SEQ ID NO: 13867 - DNA, 20 bp, Artificial Sequence
  sgRNA
  Cd63_1
ccccgcactactcacgcaga

SEQ ID NO: 13868 - DNA, 20 bp, Artificial Sequence
  sgRNA
  Cd63_2
ccttcctagaataactgctg

SEQ ID NO: 13869 - DNA, 20 bp, Artificial Sequence
  sgRNA
  Cd63_3
gacaggaagatggcaaactg

SEQ ID NO: 13870 - DNA, 20 bp, Artificial Sequence
  sgRNA
  Cd63_4
attacccatgagactactgc

SEQ ID NO: 13871 - DNA, 20 bp, Artificial Sequence
  sgRNA
  Cd63_5
gaatccactatccataccca

SEQ ID NO: 13872 - DNA, 20 bp, Artificial Sequence
  sgRNA
  Cd63_6
tatccatacccagggctgcg

SEQ ID NO: 13873 - DNA, 20 bp, Artificial Sequence
  sgRNA
  Cd63_7
tatagtctccacgcagccct

SEQ ID NO: 13874 - DNA, 20 bp, Artificial Sequence
  sgRNA
  Cd63_8
ctctgtccttggccatgccg

SEQ ID NO: 13875 - DNA, 20 bp, Artificial Sequence
  sgRNA
  Cd63_9
acagactgggaaaacatccc

SEQ ID NO: 13876 - DNA, 20 bp, Artificial Sequence
  sgRNA
  Cd63_10
tattaaactctgacttcacc

SEQ ID NO: 13877 - DNA, 20 bp, Artificial Sequence
  sgRNA
  Cd63_11
ctatagtctccacgcagccc

SEQ ID NO: 13878 - DNA, 20 bp, Artificial Sequence
  sgRNA
  Cd63_12
aatactcttcaccagacagc

SEQ ID NO: 13879 - DNA, 20 bp, Artificial Sequence
  sgRNA
  Cd63_13
aaacatccccggcatggcca

SEQ ID NO: 13880 - DNA, 20 bp, Artificial Sequence
  sgRNA
  Cd63_14
gcgagccagcagtagtctca

SEQ ID NO: 13881 - DNA, 20 bp, Artificial Sequence
  sgRNA
  Cd63_15
gcagccctgggtatggatag

SEQ ID NO: 13882 - DNA, 20 bp, Artificial Sequence
  sgRNA
  Cd63_16
ggcctttgtgggctgctgtg

SEQ ID NO: 13883 - DNA, 20 bp, Artificial Sequence
  sgRNA
  Cd63_17
ggccccacagcagcccacaa

SEQ ID NO: 13884 - DNA, 20 bp, Artificial Sequence
  sgRNA
  Cd63_18
ctggtgaagagtattcgaag

SEQ ID NO: 13885 - DNA, 20 bp, Artificial Sequence
  sgRNA
  Cd63_19
tctccacgcagccctgggta

SEQ ID NO: 13886 - DNA, 20 bp, Artificial Sequence
  sgRNA
  Cd63_20
actctgtccttggccatgcc

SEQ ID NO: 13887 - DNA, 20 bp, Artificial Sequence
  sgRNA
  Cd69_1
gtgggcaagtacaattgccc

SEQ ID NO: 13888 - DNA, 20 bp, Artificial Sequence
  sgRNA
  Cd69_2
caaaatgtatactggtgcca

SEQ ID NO: 13889 - DNA, 20 bp, Artificial Sequence
  sgRNA
  Cd69_3
cattcttgcaggtagcaaca

SEQ ID NO: 13890 - DNA, 20 bp, Artificial Sequence
  sgRNA
  Cd69_4
atgagtggatttcatacaag

SEQ ID NO: 13891 - DNA, 20 bp, Artificial Sequence
  sgRNA
  Cd69_5
tcaacttgacggggtctggg

SEQ ID NO: 13892 - DNA, 20 bp, Artificial Sequence
  sgRNA
  Cd69_6
ttgctacctgcaagaatgag

SEQ ID NO: 13893 - DNA, 20 bp, Artificial Sequence
  sgRNA
  Cd69_7
ccactattaacacagcccaa

SEQ ID NO: 13894 - DNA, 20 bp, Artificial Sequence
  sgRNA
  Cd69_8
tgaaatccactcattcttgc

SEQ ID NO: 13895 - DNA, 20 bp, Artificial Sequence
  sgRNA
  Cd69_9
ctgtgaggcaaacttccact

SEQ ID NO: 13896 - DNA, 20 bp, Artificial Sequence
  sgRNA
  Cd69_10
gtttgcctcacagtccacag

SEQ ID NO: 13897 - DNA, 20 bp, Artificial Sequence
  sgRNA
  Cd69_11
gctcttcacatctggagaga

SEQ ID NO: 13898 - DNA, 20 bp, Artificial Sequence
  sgRNA
  Cd69_12
catcttcagaacaagagcgt

SEQ ID NO: 13899 - DNA, 20 bp, Artificial Sequence
  sgRNA
  Cd69_13
ccaacttctcgtacaagcct

SEQ ID NO: 13900 - DNA, 20 bp, Artificial Sequence
  sgRNA
  Cd69_14
cccttgggctgtgttaatag

SEQ ID NO: 13901 - DNA, 20 bp, Artificial Sequence
  sgRNA
  Cd69_15
ggtgaactggaacattggat

SEQ ID NO: 13902 - DNA, 20 bp, Artificial Sequence
  sgRNA
  Cd69_16
agctaatcagacatggaaat

SEQ ID NO: 13903 - DNA, 20 bp, Artificial Sequence
  sgRNA
  Cd69_17
cattcaagtttctatccctt

SEQ ID NO: 13904 - DNA, 20 bp, Artificial Sequence
  sgRNA
  Cd69_18
tgttaccgctgtggactgtg

SEQ ID NO: 13905 - DNA, 20 bp, Artificial Sequence
  sgRNA
  Cd69_19
tctccaccacaaccaagagt

SEQ ID NO: 13906 - DNA, 20 bp, Artificial Sequence
  sgRNA
  Cd69_20
agggcttgctgcagacccag

SEQ ID NO: 13907 - DNA, 20 bp, Artificial Sequence
  sgRNA
  Cd7_1
cttacctttcaccacaaccg

SEQ ID NO: 13908 - DNA, 20 bp, Artificial Sequence
  sgRNA
  Cd7_2
taaatcacattgtaagcctg

SEQ ID NO: 13909 - DNA, 20 bp, Artificial Sequence
  sgRNA
  Cd7_3
tcagaggcaatcgtgagtcg

SEQ ID NO: 13910 - DNA, 20 bp, Artificial Sequence
  sgRNA
  Cd7_4
acatcacctgctctacaaga

SEQ ID NO: 13911 - DNA, 20 bp, Artificial Sequence
  sgRNA
  Cd7_5
gcatgctgcacaccacccca

SEQ ID NO: 13912 - DNA, 20 bp, Artificial Sequence
  sgRNA
  Cd7_6
gctttgctgcttacactggc

SEQ ID NO: 13913 - DNA, 20 bp, Artificial Sequence
  sgRNA
  Cd7_7
cggagattccttaatccctg

SEQ ID NO: 13914 - DNA, 20 bp, Artificial Sequence
  sgRNA
  Cd7_8
atgtcttcatacactacgca

SEQ ID NO: 13915 - DNA, 20 bp, Artificial Sequence
  sgRNA
  Cd7_9
gatttactttgaagaccggc

SEQ ID NO: 13916 - DNA, 20 bp, Artificial Sequence
  sgRNA
  Cd7_10
tgtctactgtgggctcctgc

SEQ ID NO: 13917 - DNA, 20 bp, Artificial Sequence
  sgRNA
  Cd7_11
cactggagactacacctgcg

SEQ ID NO: 13918 - DNA, 20 bp, Artificial Sequence
  sgRNA
  Cd7_12
actcacgattgcctctgagg

SEQ ID NO: 13919 - DNA, 20 bp, Artificial Sequence
  sgRNA
  Cd7_13
agaggcaatcgtgagtcggg

SEQ ID NO: 13920 - DNA, 20 bp, Artificial Sequence
  sgRNA
  Cd7_14
gactttcctgacagcctcgc

SEQ ID NO: 13921 - DNA, 20 bp, Artificial Sequence
  sgRNA
  Cd7_15
gactcacgattgcctctgag

SEQ ID NO: 13922 - DNA, 20 bp, Artificial Sequence
  sgRNA
  Cd7_16
gggaaccagagaaattaatt

SEQ ID NO: 13923 - DNA, 20 bp, Artificial Sequence
  sgRNA
  Cd7_17
tgatgtctgcagaggttcct

SEQ ID NO: 13924 - DNA, 20 bp, Artificial Sequence
  sgRNA
  Cd7_18
ccaagaagcatacagatccc

SEQ ID NO: 13925 - DNA, 20 bp, Artificial Sequence
  sgRNA
  Cd7_19
aaccgtggtgaacaagccac

SEQ ID NO: 13926 - DNA, 20 bp, Artificial Sequence
  sgRNA
  Cd7_20
gtcaggaaagtcagtgcccg

SEQ ID NO: 13927 - DNA, 20 bp, Artificial Sequence
  sgRNA
  Cd70_1
ttgggaaggtccttcacaca

SEQ ID NO: 13928 - DNA, 20 bp, Artificial Sequence
  sgRNA
  Cd70_2
agctgtaactcagctgtgtg

SEQ ID NO: 13929 - DNA, 20 bp, Artificial Sequence
  sgRNA
  Cd70_3
aaggaccccacactgcgctg

SEQ ID NO: 13930 - DNA, 20 bp, Artificial Sequence
  sgRNA
  Cd70_4
catctgcgtatccatcaaga

SEQ ID NO: 13931 - DNA, 20 bp, Artificial Sequence
  sgRNA
  Cd70_5
tggtacagaggacatctccg

SEQ ID NO: 13932 - DNA, 20 bp, Artificial Sequence
  sgRNA
  Cd70_6
tggccattggcgctggaacg

SEQ ID NO: 13933 - DNA, 20 bp, Artificial Sequence
  sgRNA
  Cd70_7
ctttggacaggactgtacag

SEQ ID NO: 13934 - DNA, 20 bp, Artificial Sequence
  sgRNA
  Cd70_8
gtcccgctccagcgaaccca

SEQ ID NO: 13935 - DNA, 20 bp, Artificial Sequence
  sgRNA
  Cd70_9
tcccgctccagcgaacccag

SEQ ID NO: 13936 - DNA, 20 bp, Artificial Sequence
  sgRNA
  Cd70_10
cacggcatcagcttgctgcg

SEQ ID NO: 13937 - DNA, 20 bp, Artificial Sequence
  sgRNA
  Cd70_11
gcgttgcgggacggcagcag

SEQ ID NO: 13938 - DNA, 20 bp, Artificial Sequence
  sgRNA
  Cd70_12
cgttccagcgccaatggcca

SEQ ID NO: 13939 - DNA, 20 bp, Artificial Sequence
  sgRNA
  Cd70_13
cacggaccagagctggagga

SEQ ID NO: 13940 - DNA, 20 bp, Artificial Sequence
  sgRNA
  Cd70_14
gtctcatcagcgttgcggga

SEQ ID NO: 13941 - DNA, 20 bp, Artificial Sequence
  sgRNA
  Cd70_15
ggaaggtcgcccttgcccct

SEQ ID NO: 13942 - DNA, 20 bp, Artificial Sequence
  sgRNA
  Cd70_16
tatccactgaactccaaaga

SEQ ID NO: 13943 - DNA, 20 bp, Artificial Sequence
  sgRNA
  Cd70_17
agaaggtctcatcagcgttg

SEQ ID NO: 13944 - DNA, 20 bp, Artificial Sequence
  sgRNA
  Cd70_18
agctgatgccgtgcgcagcg

SEQ ID NO: 13945 - DNA, 20 bp, Artificial Sequence
  sgRNA
  Cd70_19
gcagccatggccattggcgc

SEQ ID NO: 13946 - DNA, 20 bp, Artificial Sequence
  sgRNA
  Cd70_20
agaccttctttggagttcag

SEQ ID NO: 13947 - DNA, 20 bp, Artificial Sequence
  sgRNA
  Cd74_1
gctgatgcgtccaatgtcca

SEQ ID NO: 13948 - DNA, 20 bp, Artificial Sequence
  sgRNA
  Cd74_2
ccatgtgatgcatctgctca

SEQ ID NO: 13949 - DNA, 20 bp, Artificial Sequence
  sgRNA
  Cd74_3
catggatggcgtgaactgga

SEQ ID NO: 13950 - DNA, 20 bp, Artificial Sequence
  sgRNA
  Cd74_4
agccgtggagctctgtacac

SEQ ID NO: 13951 - DNA, 20 bp, Artificial Sequence
  sgRNA
  Cd74_5
ttaccgttctcgtcgcactt

SEQ ID NO: 13952 - DNA, 20 bp, Artificial Sequence
  sgRNA
  Cd74_6
gatgagcaagaactccctgg

SEQ ID NO: 13953 - DNA, 20 bp, Artificial Sequence
  sgRNA
  Cd74_7
gttcctcacaccaagagccg

SEQ ID NO: 13954 - DNA, 20 bp, Artificial Sequence
  sgRNA
  Cd74_8
caccggtgtacagagctcca

SEQ ID NO: 13955 - DNA, 20 bp, Artificial Sequence
  sgRNA
  Cd74_9
tacttcctgtaccagcaaca

SEQ ID NO: 13956 - DNA, 20 bp, Artificial Sequence
  sgRNA
  Cd74_10
acttgggacggaacgcaccc

SEQ ID NO: 13957 - DNA, 20 bp, Artificial Sequence
  sgRNA
  Cd74_11
cgttctcgtcgcacttggga

SEQ ID NO: 13958 - DNA, 20 bp, Artificial Sequence
  sgRNA
  Cd74_12
ctccagttgcaggttctggg

SEQ ID NO: 13959 - DNA, 20 bp, Artificial Sequence
  sgRNA
  Cd74_13
tcactcccaggccagaagat

SEQ ID NO: 13960 - DNA, 20 bp, Artificial Sequence
  sgRNA
  Cd74_14
cgtcccaagtgcgacgagaa

SEQ ID NO: 13961 - DNA, 20 bp, Artificial Sequence
  sgRNA
  Cd74_15
tgtgttccccaacggcactg

SEQ ID NO: 13962 - DNA, 20 bp, Artificial Sequence
  sgRNA
  Cd74_16
gataggtcttccatgtccag

SEQ ID NO: 13963 - DNA, 20 bp, Artificial Sequence
  sgRNA
  Cd74_17
tgctggtgtgtgttccccaa

SEQ ID NO: 13964 - DNA, 20 bp, Artificial Sequence
  sgRNA
  Cd74_18
ggaggagaagaagcccaccg

SEQ ID NO: 13965 - DNA, 20 bp, Artificial Sequence
  sgRNA
  Cd74_19
ctggtacaggaagtaagcag

SEQ ID NO: 13966 - DNA, 20 bp, Artificial Sequence
  sgRNA
  Cd74_20
cactgcagttatggcgcccg

SEQ ID NO: 13967 - DNA, 20 bp, Artificial Sequence
  sgRNA
  Cd79a_1
ggaaccctaatatcacatgg

SEQ ID NO: 13968 - DNA, 20 bp, Artificial Sequence
  sgRNA
  Cd79a_2
cctactcactgcgcacgcgg

SEQ ID NO: 13969 - DNA, 20 bp, Artificial Sequence
  sgRNA
  Cd79a_3
cgaagtaaacaagaaccaca

SEQ ID NO: 13970 - DNA, 20 bp, Artificial Sequence
  sgRNA
  Cd79a_4
aggcgtatgacaagaagagg

SEQ ID NO: 13971 - DNA, 20 bp, Artificial Sequence
  sgRNA
  Cd79a_5
cctgacggtgaacttgggcg

SEQ ID NO: 13972 - DNA, 20 bp, Artificial Sequence
  sgRNA
  Cd79a_6
tggacccccttctacccgca

SEQ ID NO: 13973 - DNA, 20 bp, Artificial Sequence
  sgRNA
  Cd79a_7
accgcatcatcacagcagaa

SEQ ID NO: 13974 - DNA, 20 bp, Artificial Sequence
  sgRNA
  Cd79a_8
gcaggaaccctaatatcaca

SEQ ID NO: 13975 - DNA, 20 bp, Artificial Sequence
  sgRNA
  Cd79a_9
ccatccctgacggtgaactt

SEQ ID NO: 13976 - DNA, 20 bp, Artificial Sequence
  sgRNA
  Cd79a_10
tgtggttcttgtttacttcg

SEQ ID NO: 13977 - DNA, 20 bp, Artificial Sequence
  sgRNA
  Cd79a_11
acatggcccccagtgccact

SEQ ID NO: 13978 - DNA, 20 bp, Artificial Sequence
  sgRNA
  Cd79a_12
gccttcagtctaacatcaca

SEQ ID NO: 13979 - DNA, 20 bp, Artificial Sequence
  sgRNA
  Cd79a_13
gccatgtgatgttagactga

SEQ ID NO: 13980 - DNA, 20 bp, Artificial Sequence
  sgRNA
  Cd79a_14
tatgtatgaggacatctcca

SEQ ID NO: 13981 - DNA, 20 bp, Artificial Sequence
  sgRNA
  Cd79a_15
agaaccacaggggcttgtac

SEQ ID NO: 13982 - DNA, 20 bp, Artificial Sequence
  sgRNA
  Cd79a_16
tgctgctattcaggaaacgg

SEQ ID NO: 13983 - DNA, 20 bp, Artificial Sequence
  sgRNA
  Cd79a_17
gtggacccccttctacccgc

SEQ ID NO: 13984 - DNA, 20 bp, Artificial Sequence
  sgRNA
  Cd79a_18
cccaagttcaccgtcaggga

SEQ ID NO: 13985 - DNA, 20 bp, Artificial Sequence
  sgRNA
  Cd79a_19
ggtcctggccagggtaccac

SEQ ID NO: 13986 - DNA, 20 bp, Artificial Sequence
  sgRNA
  Cd79a_20
tcacctgtgaaaacaatggc

SEQ ID NO: 13987 - DNA, 20 bp, Artificial Sequence
  sgRNA
  Cd79b_1
tgacctggttccgaaagcga

SEQ ID NO: 13988 - DNA, 20 bp, Artificial Sequence
  sgRNA
  Cd79b_2
tcccccaggattcagcacgt

SEQ ID NO: 13989 - DNA, 20 bp, Artificial Sequence
  sgRNA
  Cd79b_3
cataatgtcaccgacagctg

SEQ ID NO: 13990 - DNA, 20 bp, Artificial Sequence
  sgRNA
  Cd79b_4
cgaggtttgcagccaaaaag

SEQ ID NO: 13991 - DNA, 20 bp, Artificial Sequence
  sgRNA
  Cd79b_5
cgttggaccaactgaagcgg

SEQ ID NO: 13992 - DNA, 20 bp, Artificial Sequence
  sgRNA
  Cd79b_6
gctgccagatctgggaacaa

SEQ ID NO: 13993 - DNA, 20 bp, Artificial Sequence
  sgRNA
  Cd79b_7
gtagcagtgaaacttcacca

SEQ ID NO: 13994 - DNA, 20 bp, Artificial Sequence
  sgRNA
  Cd79b_8
gctgtcggtgacattatggt

SEQ ID NO: 13995 - DNA, 20 bp, Artificial Sequence
  sgRNA
  Cd79b_9
tatccaaaacatccagtacg

SEQ ID NO: 13996 - DNA, 20 bp, Artificial Sequence
  sgRNA
  Cd79b_10
ccatgcaaattgagacccag

SEQ ID NO: 13997 - DNA, 20 bp, Artificial Sequence
  sgRNA
  Cd79b_11
cccctgggtctcaatttgca

SEQ ID NO: 13998 - DNA, 20 bp, Artificial Sequence
  sgRNA
  Cd79b_12
tgtcaccgacagctgtggca

SEQ ID NO: 13999 - DNA, 20 bp, Artificial Sequence
  sgRNA
  Cd79b_13
ggagggatggtgcctcccct

SEQ ID NO: 14000 - DNA, 20 bp, Artificial Sequence
  sgRNA
  Cd79b_14
tcttctgagaccagttcctg

SEQ ID NO: 14001 - DNA, 20 bp, Artificial Sequence
  sgRNA
  Cd79b_15
tttcgcccccaaacctcctt

SEQ ID NO: 14002 - DNA, 20 bp, Artificial Sequence
  sgRNA
  Cd79b_16
cctcccatagggtccctgga

SEQ ID NO: 14003 - DNA, 20 bp, Artificial Sequence
  sgRNA
  Cd79b_17
cggcggaacacactgaaaga

SEQ ID NO: 14004 - DNA, 20 bp, Artificial Sequence
  sgRNA
  Cd79b_18
acatagtgactcttcggaca

SEQ ID NO: 14005 - DNA, 20 bp, Artificial Sequence
  sgRNA
  Cd79b_19
accaggtcagtgcacctgag

SEQ ID NO: 14006 - DNA, 20 bp, Artificial Sequence
  sgRNA
  Cd79b_20
cctccagggaccctatggga

SEQ ID NO: 14007 - DNA, 20 bp, Artificial Sequence
  sgRNA
  Cd80_1
tgaggagagttgtaacggca

SEQ ID NO: 14008 - DNA, 20 bp, Artificial Sequence
  sgRNA
  Cd80_2
gaaattgtcgtattgatgcc

SEQ ID NO: 14009 - DNA, 20 bp, Artificial Sequence
  sgRNA
  Cd80_3
ctggcaaaaacatgacaaag

SEQ ID NO: 14010 - DNA, 20 bp, Artificial Sequence
  sgRNA
  Cd80_4
tgccccggtctgaaaggacc

SEQ ID NO: 14011 - DNA, 20 bp, Artificial Sequence
  sgRNA
  Cd80_5
cgtgtcagaggacttcacct

SEQ ID NO: 14012 - DNA, 20 bp, Artificial Sequence
  sgRNA
  Cd80_6
attacctgctttgcttccgg

SEQ ID NO: 14013 - DNA, 20 bp, Artificial Sequence
  sgRNA
  Cd80_7
taatgcttcttcaggcccga

SEQ ID NO: 14014 - DNA, 20 bp, Artificial Sequence
  sgRNA
  Cd80_8
agtgtgttcttgctatcagg

SEQ ID NO: 14015 - DNA, 20 bp, Artificial Sequence
  sgRNA
  Cd80_9
gcgaggctttgggaaacccc

SEQ ID NO: 14016 - DNA, 20 bp, Artificial Sequence
  sgRNA
  Cd80_10
tgtggcccgagtataagaac

SEQ ID NO: 14017 - DNA, 20 bp, Artificial Sequence
  sgRNA
  Cd80_11
ggcctggtcctttcagaccg

SEQ ID NO: 14018 - DNA, 20 bp, Artificial Sequence
  sgRNA
  Cd80_12
tggagatgctcacgtgtcag

SEQ ID NO: 14019 - DNA, 20 bp, Artificial Sequence
  sgRNA
  Cd80_13
cttcatgaggagagttgtaa

SEQ ID NO: 14020 - DNA, 20 bp, Artificial Sequence
  sgRNA
  Cd80_14
gagtcgtattgaaatctagt

SEQ ID NO: 14021 - DNA, 20 bp, Artificial Sequence
  sgRNA
  Cd80_15
atatttaatgagacacttaa

SEQ ID NO: 14022 - DNA, 20 bp, Artificial Sequence
  sgRNA
  Cd80_16
catcaatacgacaatttccc

SEQ ID NO: 14023 - DNA, 20 bp, Artificial Sequence
  sgRNA
  Cd80_17
gtgtgttcttgctatcagga

SEQ ID NO: 14024 - DNA, 20 bp, Artificial Sequence
  sgRNA
  Cd80_18
gccttggacatggaaacttg

SEQ ID NO: 14025 - DNA, 20 bp, Artificial Sequence
  sgRNA
  Cd80_19
tgtatgtgccccggtctgaa

SEQ ID NO: 14026 - DNA, 20 bp, Artificial Sequence
  sgRNA
  Cd80_20
acaaagagaagaatgagcct

SEQ ID NO: 14027 - DNA, 20 bp, Artificial Sequence
  sgRNA
  Cd82_1
tgccaccagtagccgcgagg

SEQ ID NO: 14028 - DNA, 20 bp, Artificial Sequence
  sgRNA
  Cd82_2
ctgtatcggtgctgtcaatg

SEQ ID NO: 14029 - DNA, 20 bp, Artificial Sequence
  sgRNA
  Cd82_3
gaagtagaagaggaccccta

SEQ ID NO: 14030 - DNA, 20 bp, Artificial Sequence
  sgRNA
  Cd82_4
agggggtgccttacgtagga

SEQ ID NO: 14031 - DNA, 20 bp, Artificial Sequence
  sgRNA
  Cd82_5
caatgccaccagtagccgcg

SEQ ID NO: 14032 - DNA, 20 bp, Artificial Sequence
  sgRNA
  Cd82_6
tgttcacaggccaatcctca

SEQ ID NO: 14033 - DNA, 20 bp, Artificial Sequence
  sgRNA
  Cd82_7
ctacaactggacagagaacg

SEQ ID NO: 14034 - DNA, 20 bp, Artificial Sequence
  sgRNA
  Cd82_8
tgtgagcgaaaacaaccctg

SEQ ID NO: 14035 - DNA, 20 bp, Artificial Sequence
  sgRNA
  Cd82_9
gtgcgatgaggatcagcaga

SEQ ID NO: 14036 - DNA, 20 bp, Artificial Sequence
  sgRNA
  Cd82_10
gcgtggcttcaggagaactt

SEQ ID NO: 14037 - DNA, 20 bp, Artificial Sequence
  sgRNA
  Cd82_11
cgtagtcccaggcctcctcg

SEQ ID NO: 14038 - DNA, 20 bp, Artificial Sequence
  sgRNA
  Cd82_12
catcgcacaggtgaccgtag

SEQ ID NO: 14039 - DNA, 20 bp, Artificial Sequence
  sgRNA
  Cd82_13
tgatcttctcgcaggagcat

SEQ ID NO: 14040 - DNA, 20 bp, Artificial Sequence
  sgRNA
  Cd82_14
tcatccagctcgctgcaggt

SEQ ID NO: 14041 - DNA, 20 bp, Artificial Sequence
  sgRNA
  Cd82_15
gcatggagaaggcgcaggcg

SEQ ID NO: 14042 - DNA, 20 bp, Artificial Sequence
  sgRNA
  Cd82_16
ctacggtcacctgtgcgatg

SEQ ID NO: 14043 - DNA, 20 bp, Artificial Sequence
  sgRNA
  Cd82_17
tcatcgcacaggtgaccgta

SEQ ID NO: 14044 - DNA, 20 bp, Artificial Sequence
  sgRNA
  Cd82_18
tgtcagcgttgaagtagaag

SEQ ID NO: 14045 - DNA, 20 bp, Artificial Sequence
  sgRNA
  Cd82_19
gcttacgtcttcatcggtgt

SEQ ID NO: 14046 - DNA, 20 bp, Artificial Sequence
  sgRNA
  Cd82_20
tcattctgaagactacagca

SEQ ID NO: 14047 - DNA, 20 bp, Artificial Sequence
  sgRNA
  Cd83_1
gggcgctgtgcaaggcaagt

SEQ ID NO: 14048 - DNA, 20 bp, Artificial Sequence
  sgRNA
  Cd83_2
acccgcgatggcgatgcggg

SEQ ID NO: 14049 - DNA, 20 bp, Artificial Sequence
  sgRNA
  Cd83_3
caagcaaaacagctccttcg

SEQ ID NO: 14050 - DNA, 20 bp, Artificial Sequence
  sgRNA
  Cd83_4
cacactctcagtgccactct

SEQ ID NO: 14051 - DNA, 20 bp, Artificial Sequence
  sgRNA
  Cd83_5
gcgcaacttgagcggcaccg

SEQ ID NO: 14052 - DNA, 20 bp, Artificial Sequence
  sgRNA
  Cd83_6
ggagggcagcgcaacttgag

SEQ ID NO: 14053 - DNA, 20 bp, Artificial Sequence
  sgRNA
  Cd83_7
tctgcagctcgggcacctac

SEQ ID NO: 14054 - DNA, 20 bp, Artificial Sequence
  sgRNA
  Cd83_8
cgctgtgcaaggcaagtcgg

SEQ ID NO: 14055 - DNA, 20 bp, Artificial Sequence
  sgRNA
  Cd83_9
ctgccctccgagctcctgca

SEQ ID NO: 14056 - DNA, 20 bp, Artificial Sequence
  sgRNA
  Cd83_10
gctctcctatgcagtgtcct

SEQ ID NO: 14057 - DNA, 20 bp, Artificial Sequence
  sgRNA
  Cd83_11
agatatttctaaacctggta

SEQ ID NO: 14058 - DNA, 20 bp, Artificial Sequence
  sgRNA
  Cd83_12
ggaataggcccttctcctgg

SEQ ID NO: 14059 - DNA, 20 bp, Artificial Sequence
  sgRNA
  Cd83_13
taggagagctgcgggtccca

SEQ ID NO: 14060 - DNA, 20 bp, Artificial Sequence
  sgRNA
  Cd83_14
gcatcgccatcgcgggtgcc

SEQ ID NO: 14061 - DNA, 20 bp, Artificial Sequence
  sgRNA
  Cd83_15
gtgccctgcaggagctcgga

SEQ ID NO: 14062 - DNA, 20 bp, Artificial Sequence
  sgRNA
  Cd83_16
tgtgccctgcaggagctcgg

SEQ ID NO: 14063 - DNA, 20 bp, Artificial Sequence
  sgRNA
  Cd83_17
gtaggtgcccgagctgcaga

SEQ ID NO: 14064 - DNA, 20 bp, Artificial Sequence
  sgRNA
  Cd83_18
acagctccttcgaggccccc

SEQ ID NO: 14065 - DNA, 20 bp, Artificial Sequence
  sgRNA
  Cd83_19
gacactgcataggagagctg

SEQ ID NO: 14066 - DNA, 20 bp, Artificial Sequence
  sgRNA
  Cd83_20
cctccccaagcaaacatttg

SEQ ID NO: 14067 - DNA, 20 bp, Artificial Sequence
  sgRNA
  Cd84_1
gaatcccattcattaccacc

SEQ ID NO: 14068 - DNA, 20 bp, Artificial Sequence
  sgRNA
  Cd84_2
catagatcagaagtatgacc

SEQ ID NO: 14069 - DNA, 20 bp, Artificial Sequence
  sgRNA
  Cd84_3
aggagctggttacctgtaca

SEQ ID NO: 14070 - DNA, 20 bp, Artificial Sequence
  sgRNA
  Cd84_4
ataacttacggtagatatga

SEQ ID NO: 14071 - DNA, 20 bp, Artificial Sequence
  sgRNA
  Cd84_5
tcaaatcgtccactccccca

SEQ ID NO: 14072 - DNA, 20 bp, Artificial Sequence
  sgRNA
  Cd84_6
aggaaaagatgcagacccgg

SEQ ID NO: 14073 - DNA, 20 bp, Artificial Sequence
  sgRNA
  Cd84_7
cctggcaacacagcatggcg

SEQ ID NO: 14074 - DNA, 20 bp, Artificial Sequence
  sgRNA
  Cd84_8
ggtcattagagacctgagga

SEQ ID NO: 14075 - DNA, 20 bp, Artificial Sequence
  sgRNA
  Cd84_9
agaatcccattcattaccac

SEQ ID NO: 14076 - DNA, 20 bp, Artificial Sequence
  sgRNA
  Cd84_10
atttcattacccaaagcctt

SEQ ID NO: 14077 - DNA, 20 bp, Artificial Sequence
  sgRNA
  Cd84_11
gctgaagttaccataaccca

SEQ ID NO: 14078 - DNA, 20 bp, Artificial Sequence
  sgRNA
  Cd84_12
tatcacactgacatgctctg

SEQ ID NO: 14079 - DNA, 20 bp, Artificial Sequence
  sgRNA
  Cd84_13
gcagacccggtggtaatgaa

SEQ ID NO: 14080 - DNA, 20 bp, Artificial Sequence
  sgRNA
  Cd84_14
ccgtaagttatggcagcacg

SEQ ID NO: 14081 - DNA, 20 bp, Artificial Sequence
  sgRNA
  Cd84_15
ccccgtgctgccataactta

SEQ ID NO: 14082 - DNA, 20 bp, Artificial Sequence
  sgRNA
  Cd84_16
acctggtcattagagacctg

SEQ ID NO: 14083 - DNA, 20 bp, Artificial Sequence
  sgRNA
  Cd84_17
gcaacacagcatggcgagga

SEQ ID NO: 14084 - DNA, 20 bp, Artificial Sequence
  sgRNA
  Cd84_18
cgccatgctgtgttgccagg

SEQ ID NO: 14085 - DNA, 20 bp, Artificial Sequence
  sgRNA
  Cd84_19
gctgtcctgtaagaaagatc

SEQ ID NO: 14086 - DNA, 20 bp, Artificial Sequence
  sgRNA
  Cd84_20
aaggtagtagatcttggtga

SEQ ID NO: 14087 - DNA, 20 bp, Artificial Sequence
  sgRNA
  Cd86_1
agtgtgaatgccaagtacct

SEQ ID NO: 14088 - DNA, 20 bp, Artificial Sequence
  sgRNA
  Cd86_2
ttgacctgcacgtctaagca

SEQ ID NO: 14089 - DNA, 20 bp, Artificial Sequence
  sgRNA
  Cd86_3
tctgccgtgcccatttacaa

SEQ ID NO: 14090 - DNA, 20 bp, Artificial Sequence
  sgRNA
  Cd86_4
tggaggataattgatcctgt

SEQ ID NO: 14091 - DNA, 20 bp, Artificial Sequence
  sgRNA
  Cd86_5
gaaataagcttgcgtctcca

SEQ ID NO: 14092 - DNA, 20 bp, Artificial Sequence
  sgRNA
  Cd86_6
actatcccgctctaacttag

SEQ ID NO: 14093 - DNA, 20 bp, Artificial Sequence
  sgRNA
  Cd86_7
tgatgagcagcatcacaagg

SEQ ID NO: 14094 - DNA, 20 bp, Artificial Sequence
  sgRNA
  Cd86_8
ctctctctttcattcccgga

SEQ ID NO: 14095 - DNA, 20 bp, Artificial Sequence
  sgRNA
  Cd86_9
tgagcagcatcacaaggagg

SEQ ID NO: 14096 - DNA, 20 bp, Artificial Sequence
  sgRNA
  Cd86_10
gataaggattgccaagccca

SEQ ID NO: 14097 - DNA, 20 bp, Artificial Sequence
  sgRNA
  Cd86_11
gcaagactgtcacaaagata

SEQ ID NO: 14098 - DNA, 20 bp, Artificial Sequence
  sgRNA
  Cd86_12
tgagcctttgtaaatgggca

SEQ ID NO: 14099 - DNA, 20 bp, Artificial Sequence
  sgRNA
  Cd86_13
atacaaaaaaagccacccac

SEQ ID NO: 14100 - DNA, 20 bp, Artificial Sequence
  sgRNA
  Cd86_14
tgttcctgtcaaagctcgtg

SEQ ID NO: 14101 - DNA, 20 bp, Artificial Sequence
  sgRNA
  Cd86_15
ttggcaggaccagcaaaagt

SEQ ID NO: 14102 - DNA, 20 bp, Artificial Sequence
  sgRNA
  Cd86_16
agacgcaagcttatttcaat

SEQ ID NO: 14103 - DNA, 20 bp, Artificial Sequence
  sgRNA
  Cd86_17
acacagcctctaagttagag

SEQ ID NO: 14104 - DNA, 20 bp, Artificial Sequence
  sgRNA
  Cd86_18
cgtttccagaacacacacaa

SEQ ID NO: 14105 - DNA, 20 bp, Artificial Sequence
  sgRNA
  Cd86_19
ttccatctcctcaaacgtat

SEQ ID NO: 14106 - DNA, 20 bp, Artificial Sequence
  sgRNA
  Cd86_20
gtcatatgccacacaccatc

SEQ ID NO: 14107 - DNA, 20 bp, Artificial Sequence
  sgRNA
  Cd8a_1
tgggtgagtcgattatcctg

SEQ ID NO: 14108 - DNA, 20 bp, Artificial Sequence
  sgRNA
  Cd8a_2
atcccacaacaagataacgt

SEQ ID NO: 14109 - DNA, 20 bp, Artificial Sequence
  sgRNA
  Cd8a_3
gtgttggggtccgtttcgca

SEQ ID NO: 14110 - DNA, 20 bp, Artificial Sequence
  sgRNA
  Cd8a_4
ggacgccgaacttggtcaga

SEQ ID NO: 14111 - DNA, 20 bp, Artificial Sequence
  sgRNA
  Cd8a_5
acccttggccggaatctgcg

SEQ ID NO: 14112 - DNA, 20 bp, Artificial Sequence
  sgRNA
  Cd8a_6
ccagaagattgtcggccccg

SEQ ID NO: 14113 - DNA, 20 bp, Artificial Sequence
  sgRNA
  Cd8a_7
gatgatcaaggacagcagaa

SEQ ID NO: 14114 - DNA, 20 bp, Artificial Sequence
  sgRNA
  Cd8a_8
catcccacaacaagataacg

SEQ ID NO: 14115 - DNA, 20 bp, Artificial Sequence
  sgRNA
  Cd8a_9
agccatatagacaacgaagg

SEQ ID NO: 14116 - DNA, 20 bp, Artificial Sequence
  sgRNA
  Cd8a_10
tgaagccatatagacaacga

SEQ ID NO: 14117 - DNA, 20 bp, Artificial Sequence
  sgRNA
  Cd8a_11
ttgccttcctgtctgactag

SEQ ID NO: 14118 - DNA, 20 bp, Artificial Sequence
  sgRNA
  Cd8a_12
gccacgcagattccggccaa

SEQ ID NO: 14119 - DNA, 20 bp, Artificial Sequence
  sgRNA
  Cd8a_13
ctgctcagtcatcagcaact

SEQ ID NO: 14120 - DNA, 20 bp, Artificial Sequence
  sgRNA
  Cd8a_14
acttggtcagaaggtggacc

SEQ ID NO: 14121 - DNA, 20 bp, Artificial Sequence
  sgRNA
  Cd8a_15
caccctgaacaagttcagca

SEQ ID NO: 14122 - DNA, 20 bp, Artificial Sequence
  sgRNA
  Cd8a_16
gcaggttcagcgacagaaag

SEQ ID NO: 14123 - DNA, 20 bp, Artificial Sequence
  sgRNA
  Cd8a_17
tggggctgagatgtcccggt

SEQ ID NO: 14124 - DNA, 20 bp, Artificial Sequence
  sgRNA
  Cd8a_18
atcacaggcgaagtccaatc

SEQ ID NO: 14125 - DNA, 20 bp, Artificial Sequence
  sgRNA
  Cd8a_19
ccgaatctttccaaagaaaa

SEQ ID NO: 14126 - DNA, 20 bp, Artificial Sequence
  sgRNA
  Cd8a_20
aggccgctagtcagacagga

SEQ ID NO: 14127 - DNA, 20 bp, Artificial Sequence
  sgRNA
  Cd8b1_1
acagggacgaagctgactgt

SEQ ID NO: 14128 - DNA, 20 bp, Artificial Sequence
  sgRNA
  Cd8b1_2
tgacttctacttctgcgcga

SEQ ID NO: 14129 - DNA, 20 bp, Artificial Sequence
  sgRNA
  Cd8b1_3
gctggttcaaaccaaccata

SEQ ID NO: 14130 - DNA, 20 bp, Artificial Sequence
  sgRNA
  Cd8b1_4
ggacgaaggggtctgaatga

SEQ ID NO: 14131 - DNA, 20 bp, Artificial Sequence
  sgRNA
  Cd8b1_5
aaaagtagacggccactccg

SEQ ID NO: 14132 - DNA, 20 bp, Artificial Sequence
  sgRNA
  Cd8b1_6
tcctttggaagaactccagg

SEQ ID NO: 14133 - DNA, 20 bp, Artificial Sequence
  sgRNA
  Cd8b1_7
gcaggatgcagactaccagc

SEQ ID NO: 14134 - DNA, 20 bp, Artificial Sequence
  sgRNA
  Cd8b1_8
tttgaaccagcagggacgaa

SEQ ID NO: 14135 - DNA, 20 bp, Artificial Sequence
  sgRNA
  Cd8b1_9
tctgctggcattcctcggag

SEQ ID NO: 14136 - DNA, 20 bp, Artificial Sequence
  sgRNA
  Cd8b1_10
gctggtcttcagtatgaagc

SEQ ID NO: 14137 - DNA, 20 bp, Artificial Sequence
  sgRNA
  Cd8b1_11
ctgaagaccagccagagcca

SEQ ID NO: 14138 - DNA, 20 bp, Artificial Sequence
  sgRNA
  Cd8b1_12
tacggcaaagatgtcctgtg

SEQ ID NO: 14139 - DNA, 20 bp, Artificial Sequence
  sgRNA
  Cd8b1_13
ggacatctttgccgtatggt

SEQ ID NO: 14140 - DNA, 20 bp, Artificial Sequence
  sgRNA
  Cd8b1_14
acattcatgatactgagaaa

SEQ ID NO: 14141 - DNA, 20 bp, Artificial Sequence
  sgRNA
  Cd8b1_15
taacaagcatctactggctg

SEQ ID NO: 14142 - DNA, 20 bp, Artificial Sequence
  sgRNA
  Cd8b1_16
ctaagttaacaagcatctac

SEQ ID NO: 14143 - DNA, 20 bp, Artificial Sequence
  sgRNA
  Cd8b1_17
ttctacttctgcgcgacggt

SEQ ID NO: 14144 - DNA, 20 bp, Artificial Sequence
  sgRNA
  Cd8b1_18
atggttggtttgaaccagca

SEQ ID NO: 14145 - DNA, 20 bp, Artificial Sequence
  sgRNA
  Cd8b1_19
tctacttctgcgcgacggtt

SEQ ID NO: 14146 - DNA, 20 bp, Artificial Sequence
  sgRNA
  Cd8b1_20
tgcagactaccagcaggctg

SEQ ID NO: 14147 - DNA, 20 bp, Artificial Sequence
  sgRNA
  Cd9_1
caatggcgaatatcaccaag

SEQ ID NO: 14148 - DNA, 20 bp, Artificial Sequence
  sgRNA
  Cd9_2
aaagccatccatatggcggt

SEQ ID NO: 14149 - DNA, 20 bp, Artificial Sequence
  sgRNA
  Cd9_3
cttgtgggtatagccccaga

SEQ ID NO: 14150 - DNA, 20 bp, Artificial Sequence
  sgRNA
  Cd9_4
tcttggtctgagagtcgaat

SEQ ID NO: 14151 - DNA, 20 bp, Artificial Sequence
  sgRNA
  Cd9_5
agtgggtatcggcatcgccg

SEQ ID NO: 14152 - DNA, 20 bp, Artificial Sequence
  sgRNA
  Cd9_6
ggtatagccccagacggcgg

SEQ ID NO: 14153 - DNA, 20 bp, Artificial Sequence
  sgRNA
  Cd9_7
gacggcggcggctatctcaa

SEQ ID NO: 14154 - DNA, 20 bp, Artificial Sequence
  sgRNA
  Cd9_8
gtacagctccacagcagccc

SEQ ID NO: 14155 - DNA, 20 bp, Artificial Sequence
  sgRNA
  Cd9_9
gctttgagtgtttcccgctg

SEQ ID NO: 14156 - DNA, 20 bp, Artificial Sequence
  sgRNA
  Cd9_10
gagcaaggatgaaccccagc

SEQ ID NO: 14157 - DNA, 20 bp, Artificial Sequence
  sgRNA
  Cd9_11
tggctttgagtgtttcccgc

SEQ ID NO: 14158 - DNA, 20 bp, Artificial Sequence
  sgRNA
  Cd9_12
ggagcaaggatgaaccccag

SEQ ID NO: 14159 - DNA, 20 bp, Artificial Sequence
  sgRNA
  Cd9_13
gtgggtatagccccagacgg

SEQ ID NO: 14160 - DNA, 20 bp, Artificial Sequence
  sgRNA
  Cd9_14
gttgttgaagacctcactga

SEQ ID NO: 14161 - DNA, 20 bp, Artificial Sequence
  sgRNA
  Cd9_15
aggacacctaccaaaagtta

SEQ ID NO: 14162 - DNA, 20 bp, Artificial Sequence
  sgRNA
  Cd9_16
tgaagttaaatccgaagagc

SEQ ID NO: 14163 - DNA, 20 bp, Artificial Sequence
  sgRNA
  Cd9_17
tgcatcaaatacctgctctt

SEQ ID NO: 14164 - DNA, 20 bp, Artificial Sequence
  sgRNA
  Cd9_18
tttaatcacctcatccttgt

SEQ ID NO: 14165 - DNA, 20 bp, Artificial Sequence
  sgRNA
  Cd9_19
aacactcaaagccatccata

SEQ ID NO: 14166 - DNA, 20 bp, Artificial Sequence
  sgRNA
  Cd9_20
ggctttgagtgtttcccgct

SEQ ID NO: 14167 - DNA, 20 bp, Artificial Sequence
  sgRNA
  Cd93_1
actccaggaatatttcactg

SEQ ID NO: 14168 - DNA, 20 bp, Artificial Sequence
  sgRNA
  Cd93_2
gcctgctatacagcccattg

SEQ ID NO: 14169 - DNA, 20 bp, Artificial Sequence
  sgRNA
  Cd93_3
tgggttggttaccaacccag

SEQ ID NO: 14170 - DNA, 20 bp, Artificial Sequence
  sgRNA
  Cd93_4
agtggcatgagagtccctgt

SEQ ID NO: 14171 - DNA, 20 bp, Artificial Sequence
  sgRNA
  Cd93_5
ccagcagtcgaaatccaggc

SEQ ID NO: 14172 - DNA, 20 bp, Artificial Sequence
  sgRNA
  Cd93_6
gatgagtgttcggacgcaag

SEQ ID NO: 14173 - DNA, 20 bp, Artificial Sequence
  sgRNA
  Cd93_7
ggttgcagtttcaacaacgg

SEQ ID NO: 14174 - DNA, 20 bp, Artificial Sequence
  sgRNA
  Cd93_8
agatgagtgttcggacgcaa

SEQ ID NO: 14175 - DNA, 20 bp, Artificial Sequence
  sgRNA
  Cd93_9
aggattgtgtcaacactcta

SEQ ID NO: 14176 - DNA, 20 bp, Artificial Sequence
  sgRNA
  Cd93_10
gcacccttggaagcaaagat

SEQ ID NO: 14177 - DNA, 20 bp, Artificial Sequence
  sgRNA
  Cd93_11
gattgcttcgaaggtggcga

SEQ ID NO: 14178 - DNA, 20 bp, Artificial Sequence
  sgRNA
  Cd93_12
ctgcacacagtgacaccgat

SEQ ID NO: 14179 - DNA, 20 bp, Artificial Sequence
  sgRNA
  Cd93_13
tggaacccaggaatagctgt

SEQ ID NO: 14180 - DNA, 20 bp, Artificial Sequence
  sgRNA
  Cd93_14
cctgctacaaaagaccccat

SEQ ID NO: 14181 - DNA, 20 bp, Artificial Sequence
  sgRNA
  Cd93_15
agacatcagatacttcacta

SEQ ID NO: 14182 - DNA, 20 bp, Artificial Sequence
  sgRNA
  Cd93_16
gaaatgcccagttctcctag

SEQ ID NO: 14183 - DNA, 20 bp, Artificial Sequence
  sgRNA
  Cd93_17
aaccaacccaacattcacag

SEQ ID NO: 14184 - DNA, 20 bp, Artificial Sequence
  sgRNA
  Cd93_18
gagtccagctggtagccgct

SEQ ID NO: 14185 - DNA, 20 bp, Artificial Sequence
  sgRNA
  Cd93_19
gcacttggctagagtccagc

SEQ ID NO: 14186 - DNA, 20 bp, Artificial Sequence
  sgRNA
  Cd93_20
ttagagccactaggagaact

SEQ ID NO: 14187 - DNA, 20 bp, Artificial Sequence
  sgRNA
  Cd96_1
agtgggtagatgtttcgttg

SEQ ID NO: 14188 - DNA, 20 bp, Artificial Sequence
  sgRNA
  Cd96_2
ccagtccaaatccaagacga

SEQ ID NO: 14189 - DNA, 20 bp, Artificial Sequence
  sgRNA
  Cd96_3
ccacagtagaggccatattg

SEQ ID NO: 14190 - DNA, 20 bp, Artificial Sequence
  sgRNA
  Cd96_4
tacagtctacaacctcattg

SEQ ID NO: 14191 - DNA, 20 bp, Artificial Sequence
  sgRNA
  Cd96_5
cctcctcagaaattccacct

SEQ ID NO: 14192 - DNA, 20 bp, Artificial Sequence
  sgRNA
  Cd96_6
gatgctggagtatctcctac

SEQ ID NO: 14193 - DNA, 20 bp, Artificial Sequence
  sgRNA
  Cd96_7
ggaactactaaaattgacca

SEQ ID NO: 14194 - DNA, 20 bp, Artificial Sequence
  sgRNA
  Cd96_8
gcactcatactttccaccca

SEQ ID NO: 14195 - DNA, 20 bp, Artificial Sequence
  sgRNA
  Cd96_9
gcatgcctgtgagtcacaag

SEQ ID NO: 14196 - DNA, 20 bp, Artificial Sequence
  sgRNA
  Cd96_10
actgaagaatgtgttcccca

SEQ ID NO: 14197 - DNA, 20 bp, Artificial Sequence
  sgRNA
  Cd96_11
gctgccacagaaactgagaa

SEQ ID NO: 14198 - DNA, 20 bp, Artificial Sequence
  sgRNA
  Cd96_12
gactgtggaaaacagcacca

SEQ ID NO: 14199 - DNA, 20 bp, Artificial Sequence
  sgRNA
  Cd96_13
actgtgacaggttctaccct

SEQ ID NO: 14200 - DNA, 20 bp, Artificial Sequence
  sgRNA
  Cd96_14
actatttggaagcctccagt

SEQ ID NO: 14201 - DNA, 20 bp, Artificial Sequence
  sgRNA
  Cd96_15
gctgaagtgtgtacttcact

SEQ ID NO: 14202 - DNA, 20 bp, Artificial Sequence
  sgRNA
  Cd96_16
attgttgacgtggtgatggt

SEQ ID NO: 14203 - DNA, 20 bp, Artificial Sequence
  sgRNA
  Cd96_17
tgacaattgtagatgaaaat

SEQ ID NO: 14204 - DNA, 20 bp, Artificial Sequence
  sgRNA
  Cd96_18
atatggcctctactgtgggc

SEQ ID NO: 14205 - DNA, 20 bp, Artificial Sequence
  sgRNA
  Cd96_19
gctgctgcttcttctaaaag

SEQ ID NO: 14206 - DNA, 20 bp, Artificial Sequence
  sgRNA
  Cd96_20
cagtgggtagatgtttcgtt

SEQ ID NO: 14207 - DNA, 20 bp, Artificial Sequence
  sgRNA
  Cdcp1_1
aggactgcctatagcagtag

SEQ ID NO: 14208 - DNA, 20 bp, Artificial Sequence
  sgRNA
  Cdcp1_2
agttcgcaacccctcgactg

SEQ ID NO: 14209 - DNA, 20 bp, Artificial Sequence
  sgRNA
  Cdcp1_3
atcatcgagtcagtatttga

SEQ ID NO: 14210 - DNA, 20 bp, Artificial Sequence
  sgRNA
  Cdcp1_4
accgagttgattatcagacc

SEQ ID NO: 14211 - DNA, 20 bp, Artificial Sequence
  sgRNA
  Cdcp1_5
tccaatctgcctcagtcgag

SEQ ID NO: 14212 - DNA, 20 bp, Artificial Sequence
  sgRNA
  Cdcp1_6
tctgggtgactcttaccccg

SEQ ID NO: 14213 - DNA, 20 bp, Artificial Sequence
  sgRNA
  Cdcp1_7
tgtcgctcaccatagagcca

SEQ ID NO: 14214 - DNA, 20 bp, Artificial Sequence
  sgRNA
  Cdcp1_8
cagcaagtgcccatacacca

SEQ ID NO: 14215 - DNA, 20 bp, Artificial Sequence
  sgRNA
  Cdcp1_9
ctttctcgcatcccaacaag

SEQ ID NO: 14216 - DNA, 20 bp, Artificial Sequence
  sgRNA
  Cdcp1_10
tttctcgcatcccaacaagg

SEQ ID NO: 14217 - DNA, 20 bp, Artificial Sequence
  sgRNA
  Cdcp1_11
tgttgtccccgcacacctaa

SEQ ID NO: 14218 - DNA, 20 bp, Artificial Sequence
  sgRNA
  Cdcp1_12
ggcgtgtcaagtcatcgcac

SEQ ID NO: 14219 - DNA, 20 bp, Artificial Sequence
  sgRNA
  Cdcp1_13
cagtgtgcctagcaaccaag

SEQ ID NO: 14220 - DNA, 20 bp, Artificial Sequence
  sgRNA
  Cdcp1_14
ggtccaatctgcctcagtcg

SEQ ID NO: 14221 - DNA, 20 bp, Artificial Sequence
  sgRNA
  Cdcp1_15
gccagaacgctctttcaaga

SEQ ID NO: 14222 - DNA, 20 bp, Artificial Sequence
  sgRNA
  Cdcp1_16
cttcacctggatcttctcga

SEQ ID NO: 14223 - DNA, 20 bp, Artificial Sequence
  sgRNA
  Cdcp1_17
tcaatgtctccaactgtgag

SEQ ID NO: 14224 - DNA, 20 bp, Artificial Sequence
  sgRNA
  Cdcp1_18
tgaagcctgagacgttcctg

SEQ ID NO: 14225 - DNA, 20 bp, Artificial Sequence
  sgRNA
  Cdcp1_19
ggtcctggtccaacgtccac

SEQ ID NO: 14226 - DNA, 20 bp, Artificial Sequence
  sgRNA
  Cdcp1_20
acgttcctgcggtggaacca

SEQ ID NO: 14227 - DNA, 20 bp, Artificial Sequence
  sgRNA
  Cdh1_1
atgatgaaaacgccaacggg

SEQ ID NO: 14228 - DNA, 20 bp, Artificial Sequence
  sgRNA
  Cdh1_2
ccctccaaatccgatacctg

SEQ ID NO: 14229 - DNA, 20 bp, Artificial Sequence
  sgRNA
  Cdh1_3
ggtggctgagaccttcatca

SEQ ID NO: 14230 - DNA, 20 bp, Artificial Sequence
  sgRNA
  Cdh1_4
aaatgccatcattggtcgtg

SEQ ID NO: 14231 - DNA, 20 bp, Artificial Sequence
  sgRNA
  Cdh1_5
ctgttggtgttcgattacga

SEQ ID NO: 14232 - DNA, 20 bp, Artificial Sequence
  sgRNA
  Cdh1_6
catttcgagtcacttccggt

SEQ ID NO: 14233 - DNA, 20 bp, Artificial Sequence
  sgRNA
  Cdh1_7
ggttagctcagcagtaaagg

SEQ ID NO: 14234 - DNA, 20 bp, Artificial Sequence
  sgRNA
  Cdh1_8
gttgacgtcatcgtctgcat

SEQ ID NO: 14235 - DNA, 20 bp, Artificial Sequence
  sgRNA
  Cdh1_9
gaacgtgtccggctctcgag

SEQ ID NO: 14236 - DNA, 20 bp, Artificial Sequence
  sgRNA
  Cdh1_10
gggacaagagacccctcaaa

SEQ ID NO: 14237 - DNA, 20 bp, Artificial Sequence
  sgRNA
  Cdh1_11
ggatccctccaaggattccg

SEQ ID NO: 14238 - DNA, 20 bp, Artificial Sequence
  sgRNA
  Cdh1_12
acaccaacagagagtcgtaa

SEQ ID NO: 14239 - DNA, 20 bp, Artificial Sequence
  sgRNA
  Cdh1_13
tctgttggtgttcgattacg

SEQ ID NO: 14240 - DNA, 20 bp, Artificial Sequence
  sgRNA
  Cdh1_14
cgtctgtcgccactttgaat

SEQ ID NO: 14241 - DNA, 20 bp, Artificial Sequence
  sgRNA
  Cdh1_15
gcaggagcgcggaaaagctg

SEQ ID NO: 14242 - DNA, 20 bp, Artificial Sequence
  sgRNA
  Cdh1_16
ggctgagaccttcatcacgg

SEQ ID NO: 14243 - DNA, 20 bp, Artificial Sequence
  sgRNA
  Cdh1_17
agtcgtaagggggtgccgtg

SEQ ID NO: 14244 - DNA, 20 bp, Artificial Sequence
  sgRNA
  Cdh1_18
gtttctacggaggagaacgg

SEQ ID NO: 14245 - DNA, 20 bp, Artificial Sequence
  sgRNA
  Cdh1_19
ttactgctgagctaacccat

SEQ ID NO: 14246 - DNA, 20 bp, Artificial Sequence
  sgRNA
  Cdh1_20
ggataaccagaacaaagacc

SEQ ID NO: 14247 - DNA, 20 bp, Artificial Sequence
  sgRNA
  Cdh10_1
ataaaaacgtggatccacat

SEQ ID NO: 14248 - DNA, 20 bp, Artificial Sequence
  sgRNA
  Cdh10_2
aagccactgatgctgacacg

SEQ ID NO: 14249 - DNA, 20 bp, Artificial Sequence
  sgRNA
  Cdh10_3
tgattatcaatatgtaggca

SEQ ID NO: 14250 - DNA, 20 bp, Artificial Sequence
  sgRNA
  Cdh10_4
tgagataattcacgatcaag

SEQ ID NO: 14251 - DNA, 20 bp, Artificial Sequence
  sgRNA
  Cdh10_5
tctgctagtttattaaaccg

SEQ ID NO: 14252 - DNA, 20 bp, Artificial Sequence
  sgRNA
  Cdh10_6
aaactagcagaaatgtacgg

SEQ ID NO: 14253 - DNA, 20 bp, Artificial Sequence
  sgRNA
  Cdh10_7
gtagccagtgagtcgtaggg

SEQ ID NO: 14254 - DNA, 20 bp, Artificial Sequence
  sgRNA
  Cdh10_8
gataggtgcttatttcatga

SEQ ID NO: 14255 - DNA, 20 bp, Artificial Sequence
  sgRNA
  Cdh10_9
tggcgctgtttccataggaa

SEQ ID NO: 14256 - DNA, 20 bp, Artificial Sequence
  sgRNA
  Cdh10_10
tcgttatccgatatcaccac

SEQ ID NO: 14257 - DNA, 20 bp, Artificial Sequence
  sgRNA
  Cdh10_11
tatcaccaccggcagtagat

SEQ ID NO: 14258 - DNA, 20 bp, Artificial Sequence
  sgRNA
  Cdh10_12
ggccctagataataaaaacg

SEQ ID NO: 14259 - DNA, 20 bp, Artificial Sequence
  sgRNA
  Cdh10_13
cttcggttctcatagtcaag

SEQ ID NO: 14260 - DNA, 20 bp, Artificial Sequence
  sgRNA
  Cdh10_14
gttcttgaatcctctccagt

SEQ ID NO: 14261 - DNA, 20 bp, Artificial Sequence
  sgRNA
  Cdh10_15
accgaggtccccattctcgg

SEQ ID NO: 14262 - DNA, 20 bp, Artificial Sequence
  sgRNA
  Cdh10_16
cctttgatataggaaccctg

SEQ ID NO: 14263 - DNA, 20 bp, Artificial Sequence
  sgRNA
  Cdh10_17
aaacgttatttataccccgg

SEQ ID NO: 14264 - DNA, 20 bp, Artificial Sequence
  sgRNA
  Cdh10_18
ggcgcacacacggatcgtca

SEQ ID NO: 14265 - DNA, 20 bp, Artificial Sequence
  sgRNA
  Cdh10_19
ccttggcttgaataaccacc

SEQ ID NO: 14266 - DNA, 20 bp, Artificial Sequence
  sgRNA
  Cdh10_20
gtcgtttccttcgtaggcgt

SEQ ID NO: 14267 - DNA, 20 bp, Artificial Sequence
  sgRNA
  Cdh11_1
caccaagacattggaccgag

SEQ ID NO: 14268 - DNA, 20 bp, Artificial Sequence
  sgRNA
  Cdh11_2
aggacaaccctatttctcgg

SEQ ID NO: 14269 - DNA, 20 bp, Artificial Sequence
  sgRNA
  Cdh11_3
tttgtgatagaagagtacac

SEQ ID NO: 14270 - DNA, 20 bp, Artificial Sequence
  sgRNA
  Cdh11_4
ctgtgagagcgatcacccca

SEQ ID NO: 14271 - DNA, 20 bp, Artificial Sequence
  sgRNA
  Cdh11_5
tctgccagtttcttaaaacg

SEQ ID NO: 14272 - DNA, 20 bp, Artificial Sequence
  sgRNA
  Cdh11_6
gcaggagtatatgcccgacg

SEQ ID NO: 14273 - DNA, 20 bp, Artificial Sequence
  sgRNA
  Cdh11_7
gggttgtgcatgatttcagg

SEQ ID NO: 14274 - DNA, 20 bp, Artificial Sequence
  sgRNA
  Cdh11_8
tatcagaagcagctgtcccg

SEQ ID NO: 14275 - DNA, 20 bp, Artificial Sequence
  sgRNA
  Cdh11_9
gccaccctgcagaatcctga

SEQ ID NO: 14276 - DNA, 20 bp, Artificial Sequence
  sgRNA
  Cdh11_10
ataaatccattgatgccgtc

SEQ ID NO: 14277 - DNA, 20 bp, Artificial Sequence
  sgRNA
  Cdh11_11
ccaccatcactgatcacaat

SEQ ID NO: 14278 - DNA, 20 bp, Artificial Sequence
  sgRNA
  Cdh11_12
ggtccattgctgatgaactt

SEQ ID NO: 14279 - DNA, 20 bp, Artificial Sequence
  sgRNA
  Cdh11_13
ataacctatgatgatgaagg

SEQ ID NO: 14280 - DNA, 20 bp, Artificial Sequence
  sgRNA
  Cdh11_14
gccgactgaaccctccacgt

SEQ ID NO: 14281 - DNA, 20 bp, Artificial Sequence
  sgRNA
  Cdh11_15
gagtatatgcccgacgtgga

SEQ ID NO: 14282 - DNA, 20 bp, Artificial Sequence
  sgRNA
  Cdh11_16
tcaggaaaccaaagtcccag

SEQ ID NO: 14283 - DNA, 20 bp, Artificial Sequence
  sgRNA
  Cdh11_17
acaaccctatttctcggtgg

SEQ ID NO: 14284 - DNA, 20 bp, Artificial Sequence
  sgRNA
  Cdh11_18
caggtttgatatctttgcga

SEQ ID NO: 14285 - DNA, 20 bp, Artificial Sequence
  sgRNA
  Cdh11_19
gatccgaagttcatcagcaa

SEQ ID NO: 14286 - DNA, 20 bp, Artificial Sequence
  sgRNA
  Cdh11_20
gatgccgtcaggattctgca

SEQ ID NO: 14287 - DNA, 20 bp, Artificial Sequence
  sgRNA
  Cdh12_1
catttccaacgagttaaacg

SEQ ID NO: 14288 - DNA, 20 bp, Artificial Sequence
  sgRNA
  Cdh12_2
caaaccactgtacaccatgg

SEQ ID NO: 14289 - DNA, 20 bp, Artificial Sequence
  sgRNA
  Cdh12_3
atgcagacgatcctacctat

SEQ ID NO: 14290 - DNA, 20 bp, Artificial Sequence
  sgRNA
  Cdh12_4
tattgacaacatacctgtcc

SEQ ID NO: 14291 - DNA, 20 bp, Artificial Sequence
  sgRNA
  Cdh12_5
gaccatcctgtcttgcaacg

SEQ ID NO: 14292 - DNA, 20 bp, Artificial Sequence
  sgRNA
  Cdh12_6
tctgccaagaccttaaagcg

SEQ ID NO: 14293 - DNA, 20 bp, Artificial Sequence
  sgRNA
  Cdh12_7
tctttgacgagataaacaga

SEQ ID NO: 14294 - DNA, 20 bp, Artificial Sequence
  sgRNA
  Cdh12_8
taaacctccatggtgtacag

SEQ ID NO: 14295 - DNA, 20 bp, Artificial Sequence
  sgRNA
  Cdh12_9
gctccgaacctcaatatgtg

SEQ ID NO: 14296 - DNA, 20 bp, Artificial Sequence
  sgRNA
  Cdh12_10
aatcgtatggtggagccgct

SEQ ID NO: 14297 - DNA, 20 bp, Artificial Sequence
  sgRNA
  Cdh12_11
aatgggatcgtctccccgaa

SEQ ID NO: 14298 - DNA, 20 bp, Artificial Sequence
  sgRNA
  Cdh12_12
tttacaatagatggaacgga

SEQ ID NO: 14299 - DNA, 20 bp, Artificial Sequence
  sgRNA
  Cdh12_13
gggatcgtctccccgaaagg

SEQ ID NO: 14300 - DNA, 20 bp, Artificial Sequence
  sgRNA
  Cdh12_14
attcaagcgaaagacatggg

SEQ ID NO: 14301 - DNA, 20 bp, Artificial Sequence
  sgRNA
  Cdh12_15
ccaacgagttaaacgtggct

SEQ ID NO: 14302 - DNA, 20 bp, Artificial Sequence
  sgRNA
  Cdh12_16
gttccagaaatgtctcctgt

SEQ ID NO: 14303 - DNA, 20 bp, Artificial Sequence
  sgRNA
  Cdh12_17
ggaaaatgacgcagacccag

SEQ ID NO: 14304 - DNA, 20 bp, Artificial Sequence
  sgRNA
  Cdh12_18
tggccacttatgcgtatgag

SEQ ID NO: 14305 - DNA, 20 bp, Artificial Sequence
  sgRNA
  Cdh12_19
gcccagcagagtgaaagcgg

SEQ ID NO: 14306 - DNA, 20 bp, Artificial Sequence
  sgRNA
  Cdh12_20
tttgtgctggaagagtacat

SEQ ID NO: 14307 - DNA, 20 bp, Artificial Sequence
  sgRNA
  Cdh13_1
ccagcctgccgaattcatcg

SEQ ID NO: 14308 - DNA, 20 bp, Artificial Sequence
  sgRNA
  Cdh13_2
gcagagatctcatagtccag

SEQ ID NO: 14309 - DNA, 20 bp, Artificial Sequence
  sgRNA
  Cdh13_3
cgctgtcatccgcatcaccg

SEQ ID NO: 14310 - DNA, 20 bp, Artificial Sequence
  sgRNA
  Cdh13_4
gcagaactcgtgattgtcgg

SEQ ID NO: 14311 - DNA, 20 bp, Artificial Sequence
  sgRNA
  Cdh13_5
tcgatagcgacagacccgaa

SEQ ID NO: 14312 - DNA, 20 bp, Artificial Sequence
  sgRNA
  Cdh13_6
ggctctcaggaacatcactg

SEQ ID NO: 14313 - DNA, 20 bp, Artificial Sequence
  sgRNA
  Cdh13_7
attctgaagaaggctcacga

SEQ ID NO: 14314 - DNA, 20 bp, Artificial Sequence
  sgRNA
  Cdh13_8
tttgtcatcgatcacgatgg

SEQ ID NO: 14315 - DNA, 20 bp, Artificial Sequence
  sgRNA
  Cdh13_9
aggagacgtcgggtaccagt

SEQ ID NO: 14316 - DNA, 20 bp, Artificial Sequence
  sgRNA
  Cdh13_10
agtcctcgcatggacaaaca

SEQ ID NO: 14317 - DNA, 20 bp, Artificial Sequence
  sgRNA
  Cdh13_11
tgatgccagaaacctcagcg

SEQ ID NO: 14318 - DNA, 20 bp, Artificial Sequence
  sgRNA
  Cdh13_12
attctccactttgatcagca

SEQ ID NO: 14319 - DNA, 20 bp, Artificial Sequence
  sgRNA
  Cdh13_13
acagtcctggatgtcaacga

SEQ ID NO: 14320 - DNA, 20 bp, Artificial Sequence
  sgRNA
  Cdh13_14
ctccaaagtggactgcaacg

SEQ ID NO: 14321 - DNA, 20 bp, Artificial Sequence
  sgRNA
  Cdh13_15
accaacccacagaccaacga

SEQ ID NO: 14322 - DNA, 20 bp, Artificial Sequence
  sgRNA
  Cdh13_16
tggtcctcgatgaattcggc

SEQ ID NO: 14323 - DNA, 20 bp, Artificial Sequence
  sgRNA
  Cdh13_17
tgtgatgtggacagttgccg

SEQ ID NO: 14324 - DNA, 20 bp, Artificial Sequence
  sgRNA
  Cdh13_18
acatcggccatgtcatggaa

SEQ ID NO: 14325 - DNA, 20 bp, Artificial Sequence
  sgRNA
  Cdh13_19
ccatcatcaatggaaatcct

SEQ ID NO: 14326 - DNA, 20 bp, Artificial Sequence
  sgRNA
  Cdh13_20
cctgtttagtcaccatcatg

SEQ ID NO: 14327 - DNA, 20 bp, Artificial Sequence
  sgRNA
  Cdh15_1
ccatcgacaagttcaccggg

SEQ ID NO: 14328 - DNA, 20 bp, Artificial Sequence
  sgRNA
  Cdh15_2
gtataatctgaccttgcaag

SEQ ID NO: 14329 - DNA, 20 bp, Artificial Sequence
  sgRNA
  Cdh15_3
ctgaggacgagcatagctga

SEQ ID NO: 14330 - DNA, 20 bp, Artificial Sequence
  sgRNA
  Cdh15_4
ccttcaaaaagggtgaagca

SEQ ID NO: 14331 - DNA, 20 bp, Artificial Sequence
  sgRNA
  Cdh15_5
gctctcatctatgactacga

SEQ ID NO: 14332 - DNA, 20 bp, Artificial Sequence
  sgRNA
  Cdh15_6
tacacctcctcctcgaagcg

SEQ ID NO: 14333 - DNA, 20 bp, Artificial Sequence
  sgRNA
  Cdh15_7
tcacggctctcatagtccag

SEQ ID NO: 14334 - DNA, 20 bp, Artificial Sequence
  sgRNA
  Cdh15_8
gtaccagccgtccttcaaaa

SEQ ID NO: 14335 - DNA, 20 bp, Artificial Sequence
  sgRNA
  Cdh15_9
ccagccccacttgcaccgtg

SEQ ID NO: 14336 - DNA, 20 bp, Artificial Sequence
  sgRNA
  Cdh15_10
tccgccagccgagcaaagcg

SEQ ID NO: 14337 - DNA, 20 bp, Artificial Sequence
  sgRNA
  Cdh15_11
cattgtgctggccagcaccg

SEQ ID NO: 14338 - DNA, 20 bp, Artificial Sequence
  sgRNA
  Cdh15_12
cctcccggtgaacttgtcga

SEQ ID NO: 14339 - DNA, 20 bp, Artificial Sequence
  sgRNA
  Cdh15_13
atctatggagatgatggccg

SEQ ID NO: 14340 - DNA, 20 bp, Artificial Sequence
  sgRNA
  Cdh15_14
ggcctctgaacacatcctgt

SEQ ID NO: 14341 - DNA, 20 bp, Artificial Sequence
  sgRNA
  Cdh15_15
gcctggttcccccaactggg

SEQ ID NO: 14342 - DNA, 20 bp, Artificial Sequence
  sgRNA
  Cdh15_16
gcacacgggagagatccgca

SEQ ID NO: 14343 - DNA, 20 bp, Artificial Sequence
  sgRNA
  Cdh15_17
ctgtgcagtgaaccagacca

SEQ ID NO: 14344 - DNA, 20 bp, Artificial Sequence
  sgRNA
  Cdh15_18
cgtcgatgctgaagaactca

SEQ ID NO: 14345 - DNA, 20 bp, Artificial Sequence
  sgRNA
  Cdh15_19
tctccatcgacaagttcacc

SEQ ID NO: 14346 - DNA, 20 bp, Artificial Sequence
  sgRNA
  Cdh15_20
caacgatctccaggtccgtg

SEQ ID NO: 14347 - DNA, 20 bp, Artificial Sequence
  sgRNA
  Cdh16_1
tgaggtcggatctaactcga

SEQ ID NO: 14348 - DNA, 20 bp, Artificial Sequence
  sgRNA
  Cdh16_2
gaggatggacgtatcttgtg

SEQ ID NO: 14349 - DNA, 20 bp, Artificial Sequence
  sgRNA
  Cdh16_3
ggggatgctccatgttacca

SEQ ID NO: 14350 - DNA, 20 bp, Artificial Sequence
  sgRNA
  Cdh16_4
ggcaaagtccataaggcgga

SEQ ID NO: 14351 - DNA, 20 bp, Artificial Sequence
  sgRNA
  Cdh16_5
gattgtgtgtcgctgcaacg

SEQ ID NO: 14352 - DNA, 20 bp, Artificial Sequence
  sgRNA
  Cdh16_6
ccctctgtatccacatcgaa

SEQ ID NO: 14353 - DNA, 20 bp, Artificial Sequence
  sgRNA
  Cdh16_7
tgtacaccccgccaagacta

SEQ ID NO: 14354 - DNA, 20 bp, Artificial Sequence
  sgRNA
  Cdh16_8
actacaccgtagtcttggcg

SEQ ID NO: 14355 - DNA, 20 bp, Artificial Sequence
  sgRNA
  Cdh16_9
ggaaggccaatgtatgcgca

SEQ ID NO: 14356 - DNA, 20 bp, Artificial Sequence
  sgRNA
  Cdh16_10
ccatggtcatcccataaagt

SEQ ID NO: 14357 - DNA, 20 bp, Artificial Sequence
  sgRNA
  Cdh16_11
ggtaggcgtgggaatctgtt

SEQ ID NO: 14358 - DNA, 20 bp, Artificial Sequence
  sgRNA
  Cdh16_12
ggaccgagagcaaagctgta

SEQ ID NO: 14359 - DNA, 20 bp, Artificial Sequence
  sgRNA
  Cdh16_13
gccctctgagtcattgacca

SEQ ID NO: 14360 - DNA, 20 bp, Artificial Sequence
  sgRNA
  Cdh16_14
agtgttacactgcctgaggt

SEQ ID NO: 14361 - DNA, 20 bp, Artificial Sequence
  sgRNA
  Cdh16_15
caccagctaccactacccct

SEQ ID NO: 14362 - DNA, 20 bp, Artificial Sequence
  sgRNA
  Cdh16_16
tgccaaggtgaggtaggcgt

SEQ ID NO: 14363 - DNA, 20 bp, Artificial Sequence
  sgRNA
  Cdh16_17
gcgccaatcccgctgcacag

SEQ ID NO: 14364 - DNA, 20 bp, Artificial Sequence
  sgRNA
  Cdh16_18
gtcccaatcccactgtgcag

SEQ ID NO: 14365 - DNA, 20 bp, Artificial Sequence
  sgRNA
  Cdh16_19
ccttgacctgtaccaatagc

SEQ ID NO: 14366 - DNA, 20 bp, Artificial Sequence
  sgRNA
  Cdh16_20
gcagcgacacacaatcactg

SEQ ID NO: 14367 - DNA, 20 bp, Artificial Sequence
  sgRNA
  Cdh17_1
tcagtacaacttaagtatcg

SEQ ID NO: 14368 - DNA, 20 bp, Artificial Sequence
  sgRNA
  Cdh17_2
ctggagacagacatgtcggt

SEQ ID NO: 14369 - DNA, 20 bp, Artificial Sequence
  sgRNA
  Cdh17_3
tgtagcttggatgattagga

SEQ ID NO: 14370 - DNA, 20 bp, Artificial Sequence
  sgRNA
  Cdh17_4
tacataacatcgttgatttg

SEQ ID NO: 14371 - DNA, 20 bp, Artificial Sequence
  sgRNA
  Cdh17_5
attccaagcaaacgtcagcg

SEQ ID NO: 14372 - DNA, 20 bp, Artificial Sequence
  sgRNA
  Cdh17_6
gctcgaaagtcacagctgga

SEQ ID NO: 14373 - DNA, 20 bp, Artificial Sequence
  sgRNA
  Cdh17_7
tagcagcattgtgttccaag

SEQ ID NO: 14374 - DNA, 20 bp, Artificial Sequence
  sgRNA
  Cdh17_8
tgtagtccttagctaggcga

SEQ ID NO: 14375 - DNA, 20 bp, Artificial Sequence
  sgRNA
  Cdh17_9
gctgtgactttcgagctaac

SEQ ID NO: 14376 - DNA, 20 bp, Artificial Sequence
  sgRNA
  Cdh17_10
ggtgcagtggaatgacccag

SEQ ID NO: 14377 - DNA, 20 bp, Artificial Sequence
  sgRNA
  Cdh17_11
attgtacagggagacacgga

SEQ ID NO: 14378 - DNA, 20 bp, Artificial Sequence
  sgRNA
  Cdh17_12
gtagcattgacatacatgaa

SEQ ID NO: 14379 - DNA, 20 bp, Artificial Sequence
  sgRNA
  Cdh17_13
ggttgagtttcaaaatcaag

SEQ ID NO: 14380 - DNA, 20 bp, Artificial Sequence
  sgRNA
  Cdh17_14
gtgtagtccttagctaggcg

SEQ ID NO: 14381 - DNA, 20 bp, Artificial Sequence
  sgRNA
  Cdh17_15
tgtccttcaccgagaccacc

SEQ ID NO: 14382 - DNA, 20 bp, Artificial Sequence
  sgRNA
  Cdh17_16
gatgatccggctactcccaa

SEQ ID NO: 14383 - DNA, 20 bp, Artificial Sequence
  sgRNA
  Cdh17_17
tcaccccatcaaaatcactc

SEQ ID NO: 14384 - DNA, 20 bp, Artificial Sequence
  sgRNA
  Cdh17_18
ttgtaagccttctctgccaa

SEQ ID NO: 14385 - DNA, 20 bp, Artificial Sequence
  sgRNA
  Cdh17_19
tggtcgatcgagaatgggaa

SEQ ID NO: 14386 - DNA, 20 bp, Artificial Sequence
  sgRNA
  Cdh17_20
ctttctgtttccctatccag

SEQ ID NO: 14387 - DNA, 20 bp, Artificial Sequence
  sgRNA
  Cdh18_1
gtcactgtgatattgtacca

SEQ ID NO: 14388 - DNA, 20 bp, Artificial Sequence
  sgRNA
  Cdh18_2
aagtacaccatcgtcccaag

SEQ ID NO: 14389 - DNA, 20 bp, Artificial Sequence
  sgRNA
  Cdh18_3
aactcgagcactgttcccat

SEQ ID NO: 14390 - DNA, 20 bp, Artificial Sequence
  sgRNA
  Cdh18_4
cccaacaataaccttcagca

SEQ ID NO: 14391 - DNA, 20 bp, Artificial Sequence
  sgRNA
  Cdh18_5
aatcccgtctccattagtga

SEQ ID NO: 14392 - DNA, 20 bp, Artificial Sequence
  sgRNA
  Cdh18_6
cttcagacttatgcctacga

SEQ ID NO: 14393 - DNA, 20 bp, Artificial Sequence
  sgRNA
  Cdh18_7
ccaccgtcagagatcataat

SEQ ID NO: 14394 - DNA, 20 bp, Artificial Sequence
  sgRNA
  Cdh18_8
atgtcaatgacaacccacca

SEQ ID NO: 14395 - DNA, 20 bp, Artificial Sequence
  sgRNA
  Cdh18_9
ccagcattctgacaaggcgg

SEQ ID NO: 14396 - DNA, 20 bp, Artificial Sequence
  sgRNA
  Cdh18_10
agtacaccatcgtcccaaga

SEQ ID NO: 14397 - DNA, 20 bp, Artificial Sequence
  sgRNA
  Cdh18_11
gcacaaaacagagacacacg

SEQ ID NO: 14398 - DNA, 20 bp, Artificial Sequence
  sgRNA
  Cdh18_12
gtacaccatcgtcccaagag

SEQ ID NO: 14399 - DNA, 20 bp, Artificial Sequence
  sgRNA
  Cdh18_13
caatccacctgaacttgcca

SEQ ID NO: 14400 - DNA, 20 bp, Artificial Sequence
  sgRNA
  Cdh18_14
ggtcattcaagccaaagaca

SEQ ID NO: 14401 - DNA, 20 bp, Artificial Sequence
  sgRNA
  Cdh18_15
ggcaaagtcatctttatcag

SEQ ID NO: 14402 - DNA, 20 bp, Artificial Sequence
  sgRNA
  Cdh18_16
attctctcgcacatcctcct

SEQ ID NO: 14403 - DNA, 20 bp, Artificial Sequence
  sgRNA
  Cdh18_17
ttctctggtgtccttgtccg

SEQ ID NO: 14404 - DNA, 20 bp, Artificial Sequence
  sgRNA
  Cdh18_18
atgcagatgaccccacctat

SEQ ID NO: 14405 - DNA, 20 bp, Artificial Sequence
  sgRNA
  Cdh18_19
agtcaaggtaatattgacag

SEQ ID NO: 14406 - DNA, 20 bp, Artificial Sequence
  sgRNA
  Cdh18_20
agtacatcctgactggagaa

SEQ ID NO: 14407 - DNA, 20 bp, Artificial Sequence
  sgRNA
  Cdh19_1
atcctatacaacttagaacg

SEQ ID NO: 14408 - DNA, 20 bp, Artificial Sequence
  sgRNA
  Cdh19_2
ggttgtggaagcgttaacat

SEQ ID NO: 14409 - DNA, 20 bp, Artificial Sequence
  sgRNA
  Cdh19_3
ctgggctctcagaatgtaga

SEQ ID NO: 14410 - DNA, 20 bp, Artificial Sequence
  sgRNA
  Cdh19_4
aaccatatggaacaattgtg

SEQ ID NO: 14411 - DNA, 20 bp, Artificial Sequence
  sgRNA
  Cdh19_5
cacccattggaacatcaata

SEQ ID NO: 14412 - DNA, 20 bp, Artificial Sequence
  sgRNA
  Cdh19_6
ggagaacagtaccttccact

SEQ ID NO: 14413 - DNA, 20 bp, Artificial Sequence
  sgRNA
  Cdh19_7
ttgacaatgacacccaagaa

SEQ ID NO: 14414 - DNA, 20 bp, Artificial Sequence
  sgRNA
  Cdh19_8
aatagtggtgtctattacct

SEQ ID NO: 14415 - DNA, 20 bp, Artificial Sequence
  sgRNA
  Cdh19_9
tccgcactcttgcttctctg

SEQ ID NO: 14416 - DNA, 20 bp, Artificial Sequence
  sgRNA
  Cdh19_10
cgtctgtagtgaatcaaagg

SEQ ID NO: 14417 - DNA, 20 bp, Artificial Sequence
  sgRNA
  Cdh19_11
atatctgaatctgcacccat

SEQ ID NO: 14418 - DNA, 20 bp, Artificial Sequence
  sgRNA
  Cdh19_12
gcacccattggaacatcaat

SEQ ID NO: 14419 - DNA, 20 bp, Artificial Sequence
  sgRNA
  Cdh19_13
ctacagacgtttgcctatga

SEQ ID NO: 14420 - DNA, 20 bp, Artificial Sequence
  sgRNA
  Cdh19_14
ttaaggcaaggccatagaag

SEQ ID NO: 14421 - DNA, 20 bp, Artificial Sequence
  sgRNA
  Cdh19_15
acgtctgtagtgaatcaaag

SEQ ID NO: 14422 - DNA, 20 bp, Artificial Sequence
  sgRNA
  Cdh19_16
gtacctgagatgtctccaga

SEQ ID NO: 14423 - DNA, 20 bp, Artificial Sequence
  sgRNA
  Cdh19_17
tggcatatgatgatgacata

SEQ ID NO: 14424 - DNA, 20 bp, Artificial Sequence
  sgRNA
  Cdh19_18
gctatgatgatgaaggcggc

SEQ ID NO: 14425 - DNA, 20 bp, Artificial Sequence
  sgRNA
  Cdh19_19
ttccctattgatgttccaat

SEQ ID NO: 14426 - DNA, 20 bp, Artificial Sequence
  sgRNA
  Cdh19_20
aggctgaccgagcatgtcct

SEQ ID NO: 14427 - DNA, 20 bp, Artificial Sequence
  sgRNA
  Cdh2_1
ttaccgaaggatgtgcacga

SEQ ID NO: 14428 - DNA, 20 bp, Artificial Sequence
  sgRNA
  Cdh2_2
aatgcggcatacagaatcag

SEQ ID NO: 14429 - DNA, 20 bp, Artificial Sequence
  sgRNA
  Cdh2_3
tctgttgcatatatcgatcg

SEQ ID NO: 14430 - DNA, 20 bp, Artificial Sequence
  sgRNA
  Cdh2_4
gtgtttgaaaggccataagt

SEQ ID NO: 14431 - DNA, 20 bp, Artificial Sequence
  sgRNA
  Cdh2_5
tatgacatagacccaaacgc

SEQ ID NO: 14432 - DNA, 20 bp, Artificial Sequence
  sgRNA
  Cdh2_6
ttacagcgcagtcttaccga

SEQ ID NO: 14433 - DNA, 20 bp, Artificial Sequence
  sgRNA
  Cdh2_7
gctatcagctctcgatccag

SEQ ID NO: 14434 - DNA, 20 bp, Artificial Sequence
  sgRNA
  Cdh2_8
tagtgatctgcccattcacg

SEQ ID NO: 14435 - DNA, 20 bp, Artificial Sequence
  sgRNA
  Cdh2_9
gttcctgtcccactcatagg

SEQ ID NO: 14436 - DNA, 20 bp, Artificial Sequence
  sgRNA
  Cdh2_10
cgagccagcagatttcaagg

SEQ ID NO: 14437 - DNA, 20 bp, Artificial Sequence
  sgRNA
  Cdh2_11
atgacatagacccaaacgcc

SEQ ID NO: 14438 - DNA, 20 bp, Artificial Sequence
  sgRNA
  Cdh2_12
ggatggcaaaccttcctgta

SEQ ID NO: 14439 - DNA, 20 bp, Artificial Sequence
  sgRNA
  Cdh2_13
aattgtctgatcctgccaac

SEQ ID NO: 14440 - DNA, 20 bp, Artificial Sequence
  sgRNA
  Cdh2_14
gctgtgatgttaattgagtt

SEQ ID NO: 14441 - DNA, 20 bp, Artificial Sequence
  sgRNA
  Cdh2_15
gtagtgatctgcccattcac

SEQ ID NO: 14442 - DNA, 20 bp, Artificial Sequence
  sgRNA
  Cdh2_16
ttgataatgaagatgcccgt

SEQ ID NO: 14443 - DNA, 20 bp, Artificial Sequence
  sgRNA
  Cdh2_17
gcacatgcagtggacatcaa

SEQ ID NO: 14444 - DNA, 20 bp, Artificial Sequence
  sgRNA
  Cdh2_18
gcaggatgatgatacacaga

SEQ ID NO: 14445 - DNA, 20 bp, Artificial Sequence
  sgRNA
  Cdh2_19
tgtccttcgtgcacatcctt

SEQ ID NO: 14446 - DNA, 20 bp, Artificial Sequence
  sgRNA
  Cdh2_20
ggacatcaatggcaatcaag

SEQ ID NO: 14447 - DNA, 20 bp, Artificial Sequence
  sgRNA
  Cdh20_1
agagatgaagtataccattg

SEQ ID NO: 14448 - DNA, 20 bp, Artificial Sequence
  sgRNA
  Cdh20_2
ttagacaatccctcccaagt

SEQ ID NO: 14449 - DNA, 20 bp, Artificial Sequence
  sgRNA
  Cdh20_3
ttggataacagatgtacctg

SEQ ID NO: 14450 - DNA, 20 bp, Artificial Sequence
  sgRNA
  Cdh20_4
aacaacagtgcacatcagtg

SEQ ID NO: 14451 - DNA, 20 bp, Artificial Sequence
  sgRNA
  Cdh20_5
gtagtgtacagcattctcca

SEQ ID NO: 14452 - DNA, 20 bp, Artificial Sequence
  sgRNA
  Cdh20_6
tcatcgtcgtcgatgatgta

SEQ ID NO: 14453 - DNA, 20 bp, Artificial Sequence
  sgRNA
  Cdh20_7
ttctcggtcgagcctctgaa

SEQ ID NO: 14454 - DNA, 20 bp, Artificial Sequence
  sgRNA
  Cdh20_8
ttgtgcgctacgacgacgag

SEQ ID NO: 14455 - DNA, 20 bp, Artificial Sequence
  sgRNA
  Cdh20_9
cgcctcgcgcgggttccaca

SEQ ID NO: 14456 - DNA, 20 bp, Artificial Sequence
  sgRNA
  Cdh20_10
aactctacggggcgtccgag

SEQ ID NO: 14457 - DNA, 20 bp, Artificial Sequence
  sgRNA
  Cdh20_11
gtgccagaaatgtcaccagt

SEQ ID NO: 14458 - DNA, 20 bp, Artificial Sequence
  sgRNA
  Cdh20_12
cttcattcagacatggacag

SEQ ID NO: 14459 - DNA, 20 bp, Artificial Sequence
  sgRNA
  Cdh20_13
ctacgtgcctcagacctgcg

SEQ ID NO: 14460 - DNA, 20 bp, Artificial Sequence
  sgRNA
  Cdh20_14
tgtgcgctacgacgacgagg

SEQ ID NO: 14461 - DNA, 20 bp, Artificial Sequence
  sgRNA
  Cdh20_15
aagagcccaatatactctaa

SEQ ID NO: 14462 - DNA, 20 bp, Artificial Sequence
  sgRNA
  Cdh20_16
gagacatccatgccattcag

SEQ ID NO: 14463 - DNA, 20 bp, Artificial Sequence
  sgRNA
  Cdh20_17
cgtgctggccaagctctacg

SEQ ID NO: 14464 - DNA, 20 bp, Artificial Sequence
  sgRNA
  Cdh20_18
gcaacacttcccacttggga

SEQ ID NO: 14465 - DNA, 20 bp, Artificial Sequence
  sgRNA
  Cdh20_19
agcggggtccccagtccgtg

SEQ ID NO: 14466 - DNA, 20 bp, Artificial Sequence
  sgRNA
  Cdh20_20
ctgctcggattctgacccgg

SEQ ID NO: 14467 - DNA, 20 bp, Artificial Sequence
  sgRNA
  Cdh22_1
ggagctcgctacaccctacg

SEQ ID NO: 14468 - DNA, 20 bp, Artificial Sequence
  sgRNA
  Cdh22_2
atacaggagtcagcccccat

SEQ ID NO: 14469 - DNA, 20 bp, Artificial Sequence
  sgRNA
  Cdh22_3
gacccccgcttcgccgacct

SEQ ID NO: 14470 - DNA, 20 bp, Artificial Sequence
  sgRNA
  Cdh22_4
tgagagccaggaacgctacg

SEQ ID NO: 14471 - DNA, 20 bp, Artificial Sequence
  sgRNA
  Cdh22_5
gtagggtgtagcgagctccg

SEQ ID NO: 14472 - DNA, 20 bp, Artificial Sequence
  sgRNA
  Cdh22_6
gatgcagacgaccctactta

SEQ ID NO: 14473 - DNA, 20 bp, Artificial Sequence
  sgRNA
  Cdh22_7
gctcatccaaaccatcagtg

SEQ ID NO: 14474 - DNA, 20 bp, Artificial Sequence
  sgRNA
  Cdh22_8
gtccaggattcggatccgta

SEQ ID NO: 14475 - DNA, 20 bp, Artificial Sequence
  sgRNA
  Cdh22_9
agaccaggcaatcgtgcgcg

SEQ ID NO: 14476 - DNA, 20 bp, Artificial Sequence
  sgRNA
  Cdh22_10
gtggcccgctgtccacaacg

SEQ ID NO: 14477 - DNA, 20 bp, Artificial Sequence
  sgRNA
  Cdh22_11
gctggcggacgcggacctat

SEQ ID NO: 14478 - DNA, 20 bp, Artificial Sequence
  sgRNA
  Cdh22_12
gggacagaacccctgtacgt

SEQ ID NO: 14479 - DNA, 20 bp, Artificial Sequence
  sgRNA
  Cdh22_13
ccccttcgtcagaatccgag

SEQ ID NO: 14480 - DNA, 20 bp, Artificial Sequence
  sgRNA
  Cdh22_14
agtgaaccacgctttctcca

SEQ ID NO: 14481 - DNA, 20 bp, Artificial Sequence
  sgRNA
  Cdh22_15
ggtgtggaaccagttcttcg

SEQ ID NO: 14482 - DNA, 20 bp, Artificial Sequence
  sgRNA
  Cdh22_16
gggcactgctgccgtaagta

SEQ ID NO: 14483 - DNA, 20 bp, Artificial Sequence
  sgRNA
  Cdh22_17
ggtgccatcgtgactggcaa

SEQ ID NO: 14484 - DNA, 20 bp, Artificial Sequence
  sgRNA
  Cdh22_18
gtacgccattgatcgggact

SEQ ID NO: 14485 - DNA, 20 bp, Artificial Sequence
  sgRNA
  Cdh22_19
cgtcctcctgcacctccagt

SEQ ID NO: 14486 - DNA, 20 bp, Artificial Sequence
  sgRNA
  Cdh22_20
agagagcgatgagtgcgccg

SEQ ID NO: 14487 - DNA, 20 bp, Artificial Sequence
  sgRNA
  Cdh23_1
gagagtgtacccgaccacgt

SEQ ID NO: 14488 - DNA, 20 bp, Artificial Sequence
  sgRNA
  Cdh23_2
cacgatagtcacgtacacgt

SEQ ID NO: 14489 - DNA, 20 bp, Artificial Sequence
  sgRNA
  Cdh23_3
tctgctcgtaatccagaggg

SEQ ID NO: 14490 - DNA, 20 bp, Artificial Sequence
  sgRNA
  Cdh23_4
atagtgtagccaatcccacg

SEQ ID NO: 14491 - DNA, 20 bp, Artificial Sequence
  sgRNA
  Cdh23_5
cgttccccgtgagttccgcg

SEQ ID NO: 14492 - DNA, 20 bp, Artificial Sequence
  sgRNA
  Cdh23_6
ggtgaactaccgcatcctgt

SEQ ID NO: 14493 - DNA, 20 bp, Artificial Sequence
  sgRNA
  Cdh23_7
ggttactggccacatcccca

SEQ ID NO: 14494 - DNA, 20 bp, Artificial Sequence
  sgRNA
  Cdh23_8
gctgggccagatcattcgag

SEQ ID NO: 14495 - DNA, 20 bp, Artificial Sequence
  sgRNA
  Cdh23_9
ttccgtatggaccgtatcag

SEQ ID NO: 14496 - DNA, 20 bp, Artificial Sequence
  sgRNA
  Cdh23_10
aatggtccttcgtagtcccg

SEQ ID NO: 14497 - DNA, 20 bp, Artificial Sequence
  sgRNA
  Cdh23_11
cctcctcgaagccacgcacg

SEQ ID NO: 14498 - DNA, 20 bp, Artificial Sequence
  sgRNA
  Cdh23_12
ttgcccacaagggtgccgcg

SEQ ID NO: 14499 - DNA, 20 bp, Artificial Sequence
  sgRNA
  Cdh23_13
gcatgagctccgcttccaca

SEQ ID NO: 14500 - DNA, 20 bp, Artificial Sequence
  sgRNA
  Cdh23_14
ggtatctgctcgtaatccag

SEQ ID NO: 14501 - DNA, 20 bp, Artificial Sequence
  sgRNA
  Cdh23_15
ttcgccatcgacagtgcccg

SEQ ID NO: 14502 - DNA, 20 bp, Artificial Sequence
  sgRNA
  Cdh23_16
gttgatcccgatgtcacggt

SEQ ID NO: 14503 - DNA, 20 bp, Artificial Sequence
  sgRNA
  Cdh23_17
cctgtaccgagttctctcga

SEQ ID NO: 14504 - DNA, 20 bp, Artificial Sequence
  sgRNA
  Cdh23_18
ttgtgtcgcgattgaccacg

SEQ ID NO: 14505 - DNA, 20 bp, Artificial Sequence
  sgRNA
  Cdh23_19
ggtataccgaatagaagccg

SEQ ID NO: 14506 - DNA, 20 bp, Artificial Sequence
  sgRNA
  Cdh23_20
cgaggacatgactttccgta

SEQ ID NO: 14507 - DNA, 20 bp, Artificial Sequence
  sgRNA
  Cdh24_1
gtgtgttggtggcttctaca

SEQ ID NO: 14508 - DNA, 20 bp, Artificial Sequence
  sgRNA
  Cdh24_2
caacgttctggatccgagtg

SEQ ID NO: 14509 - DNA, 20 bp, Artificial Sequence
  sgRNA
  Cdh24_3
aacattggacatctcaggca

SEQ ID NO: 14510 - DNA, 20 bp, Artificial Sequence
  sgRNA
  Cdh24_4
agagcctgtccttattggca

SEQ ID NO: 14511 - DNA, 20 bp, Artificial Sequence
  sgRNA
  Cdh24_5
gcaactgcaccacatcggcg

SEQ ID NO: 14512 - DNA, 20 bp, Artificial Sequence
  sgRNA
  Cdh24_6
gttgtcgttgacatcgctga

SEQ ID NO: 14513 - DNA, 20 bp, Artificial Sequence
  sgRNA
  Cdh24_7
agtcgtccagtggctcggcg

SEQ ID NO: 14514 - DNA, 20 bp, Artificial Sequence
  sgRNA
  Cdh24_8
gcgacgagtctcgaagtcca

SEQ ID NO: 14515 - DNA, 20 bp, Artificial Sequence
  sgRNA
  Cdh24_9
acctgcaccgagtcatacgg

SEQ ID NO: 14516 - DNA, 20 bp, Artificial Sequence
  sgRNA
  Cdh24_10
ctgcactcagatgttgaccg

SEQ ID NO: 14517 - DNA, 20 bp, Artificial Sequence
  sgRNA
  Cdh24_11
ctttgatgatgaactccgat

SEQ ID NO: 14518 - DNA, 20 bp, Artificial Sequence
  sgRNA
  Cdh24_12
gctccagtgctgagaccggt

SEQ ID NO: 14519 - DNA, 20 bp, Artificial Sequence
  sgRNA
  Cdh24_13
cgacgagtctcgaagtccag

SEQ ID NO: 14520 - DNA, 20 bp, Artificial Sequence
  sgRNA
  Cdh24_14
tgtgccagacacgagcctcg

SEQ ID NO: 14521 - DNA, 20 bp, Artificial Sequence
  sgRNA
  Cdh24_15
gaggctcagctatcgcccac

SEQ ID NO: 14522 - DNA, 20 bp, Artificial Sequence
  sgRNA
  Cdh24_16
ccacgagagcattatcccct

SEQ ID NO: 14523 - DNA, 20 bp, Artificial Sequence
  sgRNA
  Cdh24_17
agcagtgcgcctggaccgcg

SEQ ID NO: 14524 - DNA, 20 bp, Artificial Sequence
  sgRNA
  Cdh24_18
gttcgataggaatcaggtag

SEQ ID NO: 14525 - DNA, 20 bp, Artificial Sequence
  sgRNA
  Cdh24_19
ggttgtcgttgacatcgctg

SEQ ID NO: 14526 - DNA, 20 bp, Artificial Sequence
  sgRNA
  Cdh24_20
gtttccatagctgggatcgt

SEQ ID NO: 14527 - DNA, 20 bp, Artificial Sequence
  sgRNA
  Cdh26_1
atgccgtagatcgatccaca

SEQ ID NO: 14528 - DNA, 20 bp, Artificial Sequence
  sgRNA
  Cdh26_2
tcggattgatctcatcagcg

SEQ ID NO: 14529 - DNA, 20 bp, Artificial Sequence
  sgRNA
  Cdh26_3
caacatatgggatggcaacg

SEQ ID NO: 14530 - DNA, 20 bp, Artificial Sequence
  sgRNA
  Cdh26_4
gcagctcttcgtttgtacgg

SEQ ID NO: 14531 - DNA, 20 bp, Artificial Sequence
  sgRNA
  Cdh26_5
gattctccacaacaacgacg

SEQ ID NO: 14532 - DNA, 20 bp, Artificial Sequence
  sgRNA
  Cdh26_6
gacactgattgtgtataacg

SEQ ID NO: 14533 - DNA, 20 bp, Artificial Sequence
  sgRNA
  Cdh26_7
gtgtcacttctcgatcgaca

SEQ ID NO: 14534 - DNA, 20 bp, Artificial Sequence
  sgRNA
  Cdh26_8
agagccatccctgacatcca

SEQ ID NO: 14535 - DNA, 20 bp, Artificial Sequence
  sgRNA
  Cdh26_9
tccagaaaattgggtgaccg

SEQ ID NO: 14536 - DNA, 20 bp, Artificial Sequence
  sgRNA
  Cdh26_10
ctgaccctgagaccaaccaa

SEQ ID NO: 14537 - DNA, 20 bp, Artificial Sequence
  sgRNA
  Cdh26_11
tcacttctcgatcgacaggg

SEQ ID NO: 14538 - DNA, 20 bp, Artificial Sequence
  sgRNA
  Cdh26_12
gatgccgtagatcgatccac

SEQ ID NO: 14539 - DNA, 20 bp, Artificial Sequence
  sgRNA
  Cdh26_13
actgacatgaatggtggccg

SEQ ID NO: 14540 - DNA, 20 bp, Artificial Sequence
  sgRNA
  Cdh26_14
atatgggatggcaacgagga

SEQ ID NO: 14541 - DNA, 20 bp, Artificial Sequence
  sgRNA
  Cdh26_15
acgacaatgctccaaccctc

SEQ ID NO: 14542 - DNA, 20 bp, Artificial Sequence
  sgRNA
  Cdh26_16
gtcttcctcctgcagttcca

SEQ ID NO: 14543 - DNA, 20 bp, Artificial Sequence
  sgRNA
  Cdh26_17
ggacaatgctcagggagacg

SEQ ID NO: 14544 - DNA, 20 bp, Artificial Sequence
  sgRNA
  Cdh26_18
gtaatggcgtttgagagacg

SEQ ID NO: 14545 - DNA, 20 bp, Artificial Sequence
  sgRNA
  Cdh26_19
gatgctgaggacaaagcagg

SEQ ID NO: 14546 - DNA, 20 bp, Artificial Sequence
  sgRNA
  Cdh26_20
gtgtcgggaatggggccgga

SEQ ID NO: 14547 - DNA, 20 bp, Artificial Sequence
  sgRNA
  Cdh3_1
atggtgaagactccttcggg

SEQ ID NO: 14548 - DNA, 20 bp, Artificial Sequence
  sgRNA
  Cdh3_2
atggtgaacatgaggtcgtg

SEQ ID NO: 14549 - DNA, 20 bp, Artificial Sequence
  sgRNA
  Cdh3_3
atcacctcccacgatgtggt

SEQ ID NO: 14550 - DNA, 20 bp, Artificial Sequence
  sgRNA
  Cdh3_4
aaactccggagcgttatcgt

SEQ ID NO: 14551 - DNA, 20 bp, Artificial Sequence
  sgRNA
  Cdh3_5
tttcacatggaccaccacgg

SEQ ID NO: 14552 - DNA, 20 bp, Artificial Sequence
  sgRNA
  Cdh3_6
ttcgtccccgagaatggcaa

SEQ ID NO: 14553 - DNA, 20 bp, Artificial Sequence
  sgRNA
  Cdh3_7
ggtctccgagccctaccgag

SEQ ID NO: 14554 - DNA, 20 bp, Artificial Sequence
  sgRNA
  Cdh3_8
gacatcacccaactccaccg

SEQ ID NO: 14555 - DNA, 20 bp, Artificial Sequence
  sgRNA
  Cdh3_9
actacaactaccttaacgag

SEQ ID NO: 14556 - DNA, 20 bp, Artificial Sequence
  sgRNA
  Cdh3_10
ggtttgctggctacgcagcg

SEQ ID NO: 14557 - DNA, 20 bp, Artificial Sequence
  sgRNA
  Cdh3_11
tcgtctccttaagatgcggg

SEQ ID NO: 14558 - DNA, 20 bp, Artificial Sequence
  sgRNA
  Cdh3_12
tgatgccaacgataacgctc

SEQ ID NO: 14559 - DNA, 20 bp, Artificial Sequence
  sgRNA
  Cdh3_13
cctccccgatgaagcccgct

SEQ ID NO: 14560 - DNA, 20 bp, Artificial Sequence
  sgRNA
  Cdh3_14
gtatgtagaagtgaccaacg

SEQ ID NO: 14561 - DNA, 20 bp, Artificial Sequence
  sgRNA
  Cdh3_15
ctacaactaccttaacgagt

SEQ ID NO: 14562 - DNA, 20 bp, Artificial Sequence
  sgRNA
  Cdh3_16
gttggtcacttctacataca

SEQ ID NO: 14563 - DNA, 20 bp, Artificial Sequence
  sgRNA
  Cdh3_17
cctcgtagtcaaaaaccagc

SEQ ID NO: 14564 - DNA, 20 bp, Artificial Sequence
  sgRNA
  Cdh3_18
cttcggctcttggctatgga

SEQ ID NO: 14565 - DNA, 20 bp, Artificial Sequence
  sgRNA
  Cdh3_19
tcttcttcctcaccaacagg

SEQ ID NO: 14566 - DNA, 20 bp, Artificial Sequence
  sgRNA
  Cdh3_20
tgacatcacccaactccacc

SEQ ID NO: 14567 - DNA, 20 bp, Artificial Sequence
  sgRNA
  Cdh4_1
ggatatgaacggtaacaagg

SEQ ID NO: 14568 - DNA, 20 bp, Artificial Sequence
  sgRNA
  Cdh4_2
cgtctaccgaatcataagtg

SEQ ID NO: 14569 - DNA, 20 bp, Artificial Sequence
  sgRNA
  Cdh4_3
caccatcaacagtgaaacag

SEQ ID NO: 14570 - DNA, 20 bp, Artificial Sequence
  sgRNA
  Cdh4_4
cttggacttcaaagtcgggg

SEQ ID NO: 14571 - DNA, 20 bp, Artificial Sequence
  sgRNA
  Cdh4_5
tgcttgtggtgaattccgga

SEQ ID NO: 14572 - DNA, 20 bp, Artificial Sequence
  sgRNA
  Cdh4_6
tggcctttaccgtcactgcg

SEQ ID NO: 14573 - DNA, 20 bp, Artificial Sequence
  sgRNA
  Cdh4_7
gttggggtccatatcggcgt

SEQ ID NO: 14574 - DNA, 20 bp, Artificial Sequence
  sgRNA
  Cdh4_8
tgcacatcaacacatccaat

SEQ ID NO: 14575 - DNA, 20 bp, Artificial Sequence
  sgRNA
  Cdh4_9
ggtctcggtccatcaccgtg

SEQ ID NO: 14576 - DNA, 20 bp, Artificial Sequence
  sgRNA
  Cdh4_10
ttcatagtcgaagactagca

SEQ ID NO: 14577 - DNA, 20 bp, Artificial Sequence
  sgRNA
  Cdh4_11
gcccacgcggtggatatgaa

SEQ ID NO: 14578 - DNA, 20 bp, Artificial Sequence
  sgRNA
  Cdh4_12
agtcgccgttctcatcacat

SEQ ID NO: 14579 - DNA, 20 bp, Artificial Sequence
  sgRNA
  Cdh4_13
tgagaacggcgactgtacca

SEQ ID NO: 14580 - DNA, 20 bp, Artificial Sequence
  sgRNA
  Cdh4_14
tgactgtaagatcctcacgg

SEQ ID NO: 14581 - DNA, 20 bp, Artificial Sequence
  sgRNA
  Cdh4_15
acatcgactctatgtctggc

SEQ ID NO: 14582 - DNA, 20 bp, Artificial Sequence
  sgRNA
  Cdh4_16
gtagggggcctcgttgacat

SEQ ID NO: 14583 - DNA, 20 bp, Artificial Sequence
  sgRNA
  Cdh4_17
tccgccagcttcttgaaccg

SEQ ID NO: 14584 - DNA, 20 bp, Artificial Sequence
  sgRNA
  Cdh4_18
agtcccagacccatgtcccg

SEQ ID NO: 14585 - DNA, 20 bp, Artificial Sequence
  sgRNA
  Cdh4_19
ggactctcggtccagaatgg

SEQ ID NO: 14586 - DNA, 20 bp, Artificial Sequence
  sgRNA
  Cdh4_20
gttgatgtgcagccagttgg

SEQ ID NO: 14587 - DNA, 20 bp, Artificial Sequence
  sgRNA
  Cdh5_1
acagaccccaaacgtaacga

SEQ ID NO: 14588 - DNA, 20 bp, Artificial Sequence
  sgRNA
  Cdh5_2
gccaacgaactggattctcg

SEQ ID NO: 14589 - DNA, 20 bp, Artificial Sequence
  sgRNA
  Cdh5_3
gcttacattgagtaaagacg

SEQ ID NO: 14590 - DNA, 20 bp, Artificial Sequence
  sgRNA
  Cdh5_4
tcggggtcgatgctaacaca

SEQ ID NO: 14591 - DNA, 20 bp, Artificial Sequence
  sgRNA
  Cdh5_5
ggtgcctgaagacatccgag

SEQ ID NO: 14592 - DNA, 20 bp, Artificial Sequence
  sgRNA
  Cdh5_6
gacagaccccaaacgtaacg

SEQ ID NO: 14593 - DNA, 20 bp, Artificial Sequence
  sgRNA
  Cdh5_7
agggctgggcaaattccgga

SEQ ID NO: 14594 - DNA, 20 bp, Artificial Sequence
  sgRNA
  Cdh5_8
ctgcacatctacggctacga

SEQ ID NO: 14595 - DNA, 20 bp, Artificial Sequence
  sgRNA
  Cdh5_9
gcagttggtcacttacgatg

SEQ ID NO: 14596 - DNA, 20 bp, Artificial Sequence
  sgRNA
  Cdh5_10
ggaaccagcacgctaaccgt

SEQ ID NO: 14597 - DNA, 20 bp, Artificial Sequence
  sgRNA
  Cdh5_11
tgtcatccgtgtgacagcag

SEQ ID NO: 14598 - DNA, 20 bp, Artificial Sequence
  sgRNA
  Cdh5_12
gtgcttaattctgtgcgcgg

SEQ ID NO: 14599 - DNA, 20 bp, Artificial Sequence
  sgRNA
  Cdh5_13
tcacacactttaggttcgta

SEQ ID NO: 14600 - DNA, 20 bp, Artificial Sequence
  sgRNA
  Cdh5_14
gatcgacgtgaagaaagaag

SEQ ID NO: 14601 - DNA, 20 bp, Artificial Sequence
  sgRNA
  Cdh5_15
cctgcgtgtacactgccggc

SEQ ID NO: 14602 - DNA, 20 bp, Artificial Sequence
  sgRNA
  Cdh5_16
ctgcatccactgctgtcaca

SEQ ID NO: 14603 - DNA, 20 bp, Artificial Sequence
  sgRNA
  Cdh5_17
tggaaccagcacgctaaccg

SEQ ID NO: 14604 - DNA, 20 bp, Artificial Sequence
  sgRNA
  Cdh5_18
gaagaggcagacaatgacgg

SEQ ID NO: 14605 - DNA, 20 bp, Artificial Sequence
  sgRNA
  Cdh5_19
ggtattcgtatcggatagtg

SEQ ID NO: 14606 - DNA, 20 bp, Artificial Sequence
  sgRNA
  Cdh5_20
ggaatgtgcttgcctatgag

SEQ ID NO: 14607 - DNA, 20 bp, Artificial Sequence
  sgRNA
  Cdh6_1
ggatccgattatcagtacgt

SEQ ID NO: 14608 - DNA, 20 bp, Artificial Sequence
  sgRNA
  Cdh6_2
caatgagccaatattcacca

SEQ ID NO: 14609 - DNA, 20 bp, Artificial Sequence
  sgRNA
  Cdh6_3
ctacatcctacagatacggg

SEQ ID NO: 14610 - DNA, 20 bp, Artificial Sequence
  sgRNA
  Cdh6_4
caacatcacagtgatcgcaa

SEQ ID NO: 14611 - DNA, 20 bp, Artificial Sequence
  sgRNA
  Cdh6_5
tctccaccgggaacgccaat

SEQ ID NO: 14612 - DNA, 20 bp, Artificial Sequence
  sgRNA
  Cdh6_6
gtccaccacgattctcaccg

SEQ ID NO: 14613 - DNA, 20 bp, Artificial Sequence
  sgRNA
  Cdh6_7
ggaggacagcaaatcgcgca

SEQ ID NO: 14614 - DNA, 20 bp, Artificial Sequence
  sgRNA
  Cdh6_8
catgcagtcctgccacgccg

SEQ ID NO: 14615 - DNA, 20 bp, Artificial Sequence
  sgRNA
  Cdh6_9
agtcgtctatagcatcctgc

SEQ ID NO: 14616 - DNA, 20 bp, Artificial Sequence
  sgRNA
  Cdh6_10
ataatcttgatctccatccg

SEQ ID NO: 14617 - DNA, 20 bp, Artificial Sequence
  sgRNA
  Cdh6_11
aggccctcatccaccccaca

SEQ ID NO: 14618 - DNA, 20 bp, Artificial Sequence
  sgRNA
  Cdh6_12
gcgacatacaggccaccaag

SEQ ID NO: 14619 - DNA, 20 bp, Artificial Sequence
  sgRNA
  Cdh6_13
tcgagaactttaatatatag

SEQ ID NO: 14620 - DNA, 20 bp, Artificial Sequence
  sgRNA
  Cdh6_14
gggatccgattatcagtacg

SEQ ID NO: 14621 - DNA, 20 bp, Artificial Sequence
  sgRNA
  Cdh6_15
ctttaatatatagaggaacg

SEQ ID NO: 14622 - DNA, 20 bp, Artificial Sequence
  sgRNA
  Cdh6_16
agagaaatcggggttcgacg

SEQ ID NO: 14623 - DNA, 20 bp, Artificial Sequence
  sgRNA
  Cdh6_17
ggccaaggagtcgtaaggag

SEQ ID NO: 14624 - DNA, 20 bp, Artificial Sequence
  sgRNA
  Cdh6_18
cgagctgttggagtccgccg

SEQ ID NO: 14625 - DNA, 20 bp, Artificial Sequence
  sgRNA
  Cdh6_19
ccttggcctgaatcaccact

SEQ ID NO: 14626 - DNA, 20 bp, Artificial Sequence
  sgRNA
  Cdh6_20
agttacaacgacgaaggtgg

SEQ ID NO: 14627 - DNA, 20 bp, Artificial Sequence
  sgRNA
  Cdh7_1
caacgcacctgagttcgcca

SEQ ID NO: 14628 - DNA, 20 bp, Artificial Sequence
  sgRNA
  Cdh7_2
taccaagagactggatcggg

SEQ ID NO: 14629 - DNA, 20 bp, Artificial Sequence
  sgRNA
  Cdh7_3
agttagggtcacagtaactg

SEQ ID NO: 14630 - DNA, 20 bp, Artificial Sequence
  sgRNA
  Cdh7_4
aacaacggttaagataattg

SEQ ID NO: 14631 - DNA, 20 bp, Artificial Sequence
  sgRNA
  Cdh7_5
tcagctagtcgtttaaaacg

SEQ ID NO: 14632 - DNA, 20 bp, Artificial Sequence
  sgRNA
  Cdh7_6
tctgtgaaaacgctcagcca

SEQ ID NO: 14633 - DNA, 20 bp, Artificial Sequence
  sgRNA
  Cdh7_7
ggacccaagctcagaaaccg

SEQ ID NO: 14634 - DNA, 20 bp, Artificial Sequence
  sgRNA
  Cdh7_8
atcacagtcacatacacgga

SEQ ID NO: 14635 - DNA, 20 bp, Artificial Sequence
  sgRNA
  Cdh7_9
tttcagctagtcgtttaaaa

SEQ ID NO: 14636 - DNA, 20 bp, Artificial Sequence
  sgRNA
  Cdh7_10
gttcagatcccctctatgta

SEQ ID NO: 14637 - DNA, 20 bp, Artificial Sequence
  sgRNA
  Cdh7_11
gacagtggtttcatagtcca

SEQ ID NO: 14638 - DNA, 20 bp, Artificial Sequence
  sgRNA
  Cdh7_12
attggatcgagagacaaatg

SEQ ID NO: 14639 - DNA, 20 bp, Artificial Sequence
  sgRNA
  Cdh7_13
cgagcactgttgccatatgt

SEQ ID NO: 14640 - DNA, 20 bp, Artificial Sequence
  sgRNA
  Cdh7_14
ctctcctcatcaaaaatgag

SEQ ID NO: 14641 - DNA, 20 bp, Artificial Sequence
  sgRNA
  Cdh7_15
gttgccatatgtaggatcat

SEQ ID NO: 14642 - DNA, 20 bp, Artificial Sequence
  sgRNA
  Cdh7_16
gtcgcttctgacacctccat

SEQ ID NO: 14643 - DNA, 20 bp, Artificial Sequence
  sgRNA
  Cdh7_17
agacacagaagcctttgaca

SEQ ID NO: 14644 - DNA, 20 bp, Artificial Sequence
  sgRNA
  Cdh7_18
aggacagccatatttctcag

SEQ ID NO: 14645 - DNA, 20 bp, Artificial Sequence
  sgRNA
  Cdh7_19
ctagatggtccatacacagc

SEQ ID NO: 14646 - DNA, 20 bp, Artificial Sequence
  sgRNA
  Cdh7_20
tgtcgcttctgacacctcca

SEQ ID NO: 14647 - DNA, 20 bp, Artificial Sequence
  sgRNA
  Cdh8_1
tatcaaaagacttgaccgag

SEQ ID NO: 14648 - DNA, 20 bp, Artificial Sequence
  sgRNA
  Cdh8_2
atattcggatgcgaattcag

SEQ ID NO: 14649 - DNA, 20 bp, Artificial Sequence
  sgRNA
  Cdh8_3
tactgaaacgtgggtcgatg

SEQ ID NO: 14650 - DNA, 20 bp, Artificial Sequence
  sgRNA
  Cdh8_4
agatgatgggaagataacac

SEQ ID NO: 14651 - DNA, 20 bp, Artificial Sequence
  sgRNA
  Cdh8_5
tctggtttaatatccttacg

SEQ ID NO: 14652 - DNA, 20 bp, Artificial Sequence
  sgRNA
  Cdh8_6
gcgcccatactgagtccaat

SEQ ID NO: 14653 - DNA, 20 bp, Artificial Sequence
  sgRNA
  Cdh8_7
gttcgcccagtctcttaaag

SEQ ID NO: 14654 - DNA, 20 bp, Artificial Sequence
  sgRNA
  Cdh8_8
ggtcccctgctactgaaacg

SEQ ID NO: 14655 - DNA, 20 bp, Artificial Sequence
  sgRNA
  Cdh8_9
gggcttgctccagttccaaa

SEQ ID NO: 14656 - DNA, 20 bp, Artificial Sequence
  sgRNA
  Cdh8_10
ggacctgaaccgattctcgt

SEQ ID NO: 14657 - DNA, 20 bp, Artificial Sequence
  sgRNA
  Cdh8_11
gctacgacgacgaaggagga

SEQ ID NO: 14658 - DNA, 20 bp, Artificial Sequence
  sgRNA
  Cdh8_12
atttatggctatgaaggccg

SEQ ID NO: 14659 - DNA, 20 bp, Artificial Sequence
  sgRNA
  Cdh8_13
tcgtcatctttgataataag

SEQ ID NO: 14660 - DNA, 20 bp, Artificial Sequence
  sgRNA
  Cdh8_14
gctacagccacagactcgga

SEQ ID NO: 14661 - DNA, 20 bp, Artificial Sequence
  sgRNA
  Cdh8_15
gcaactttgcaaaacccaga

SEQ ID NO: 14662 - DNA, 20 bp, Artificial Sequence
  sgRNA
  Cdh8_16
tcaacatcaatgcagatgat

SEQ ID NO: 14663 - DNA, 20 bp, Artificial Sequence
  sgRNA
  Cdh8_17
gacccacgtttcagtagcag

SEQ ID NO: 14664 - DNA, 20 bp, Artificial Sequence
  sgRNA
  Cdh8_18
cgacccacgtttcagtagca

SEQ ID NO: 14665 - DNA, 20 bp, Artificial Sequence
  sgRNA
  Cdh8_19
attcgctacgacgacgaagg

SEQ ID NO: 14666 - DNA, 20 bp, Artificial Sequence
  sgRNA
  Cdh8_20
agtcatatggtggggccgtg

SEQ ID NO: 14667 - DNA, 20 bp, Artificial Sequence
  sgRNA
  Cdh9_1
gtaatggtgatgttatgcca

SEQ ID NO: 14668 - DNA, 20 bp, Artificial Sequence
  sgRNA
  Cdh9_2
ggtccaaggtgtaagaatcg

SEQ ID NO: 14669 - DNA, 20 bp, Artificial Sequence
  sgRNA
  Cdh9_3
atgctccatcgtgccaagcg

SEQ ID NO: 14670 - DNA, 20 bp, Artificial Sequence
  sgRNA
  Cdh9_4
tgttagggtgatgttcactg

SEQ ID NO: 14671 - DNA, 20 bp, Artificial Sequence
  sgRNA
  Cdh9_5
ccttagcctgaataacaact

SEQ ID NO: 14672 - DNA, 20 bp, Artificial Sequence
  sgRNA
  Cdh9_6
ggttatcgcatgcgcacaca

SEQ ID NO: 14673 - DNA, 20 bp, Artificial Sequence
  sgRNA
  Cdh9_7
gatcctcgattcttacacct

SEQ ID NO: 14674 - DNA, 20 bp, Artificial Sequence
  sgRNA
  Cdh9_8
atagttagcatcatctgcat

SEQ ID NO: 14675 - DNA, 20 bp, Artificial Sequence
  sgRNA
  Cdh9_9
ggagcctctgatcatttcaa

SEQ ID NO: 14676 - DNA, 20 bp, Artificial Sequence
  sgRNA
  Cdh9_10
tggtctacagcattctgcaa

SEQ ID NO: 14677 - DNA, 20 bp, Artificial Sequence
  sgRNA
  Cdh9_11
gacaaagatgatcctcctcg

SEQ ID NO: 14678 - DNA, 20 bp, Artificial Sequence
  sgRNA
  Cdh9_12
tggccacttatgcctatgaa

SEQ ID NO: 14679 - DNA, 20 bp, Artificial Sequence
  sgRNA
  Cdh9_13
tcattgtcgaagattaaaac

SEQ ID NO: 14680 - DNA, 20 bp, Artificial Sequence
  sgRNA
  Cdh9_14
tcatcctttgaaatgatcag

SEQ ID NO: 14681 - DNA, 20 bp, Artificial Sequence
  sgRNA
  Cdh9_15
gaacatgcagtcctgcaatg

SEQ ID NO: 14682 - DNA, 20 bp, Artificial Sequence
  sgRNA
  Cdh9_16
gttagcatcatctgcatcgg

SEQ ID NO: 14683 - DNA, 20 bp, Artificial Sequence
  sgRNA
  Cdh9_17
gagagcttactgaacacagg

SEQ ID NO: 14684 - DNA, 20 bp, Artificial Sequence
  sgRNA
  Cdh9_18
catgcagtcctgcaatgcgg

SEQ ID NO: 14685 - DNA, 20 bp, Artificial Sequence
  sgRNA
  Cdh9_19
aggggatgattcccgatcca

SEQ ID NO: 14686 - DNA, 20 bp, Artificial Sequence
  sgRNA
  Cdh9_20
ttccacagatatcttaacca

SEQ ID NO: 14687 - DNA, 20 bp, Artificial Sequence
  sgRNA
  Cdhr1_1
ctccatggaccgtcacagcg

SEQ ID NO: 14688 - DNA, 20 bp, Artificial Sequence
  sgRNA
  Cdhr1_2
cctggcaatgtagtagtgcg

SEQ ID NO: 14689 - DNA, 20 bp, Artificial Sequence
  sgRNA
  Cdhr1_3
ttacatcatccgggttccag

SEQ ID NO: 14690 - DNA, 20 bp, Artificial Sequence
  sgRNA
  Cdhr1_4
tgtagataagcccagtggat

SEQ ID NO: 14691 - DNA, 20 bp, Artificial Sequence
  sgRNA
  Cdhr1_5
gttacgccagaaggtagccg

SEQ ID NO: 14692 - DNA, 20 bp, Artificial Sequence
  sgRNA
  Cdhr1_6
cacttgggcttcattcagga

SEQ ID NO: 14693 - DNA, 20 bp, Artificial Sequence
  sgRNA
  Cdhr1_7
ggacgctctgtacaaactgg

SEQ ID NO: 14694 - DNA, 20 bp, Artificial Sequence
  sgRNA
  Cdhr1_8
agcccaagtgaccatcatag

SEQ ID NO: 14695 - DNA, 20 bp, Artificial Sequence
  sgRNA
  Cdhr1_9
ggactactcatggtccctac

SEQ ID NO: 14696 - DNA, 20 bp, Artificial Sequence
  sgRNA
  Cdhr1_10
gaacagggccatgttcccgt

SEQ ID NO: 14697 - DNA, 20 bp, Artificial Sequence
  sgRNA
  Cdhr1_11
acaccaaagaagactgaacg

SEQ ID NO: 14698 - DNA, 20 bp, Artificial Sequence
  sgRNA
  Cdhr1_12
actggactatgagaagtcga

SEQ ID NO: 14699 - DNA, 20 bp, Artificial Sequence
  sgRNA
  Cdhr1_13
atgccaatgatgaagcaccc

SEQ ID NO: 14700 - DNA, 20 bp, Artificial Sequence
  sgRNA
  Cdhr1_14
acactcctccaagttctcca

SEQ ID NO: 14701 - DNA, 20 bp, Artificial Sequence
  sgRNA
  Cdhr1_15
ctacggagcacacgccgcac

SEQ ID NO: 14702 - DNA, 20 bp, Artificial Sequence
  sgRNA
  Cdhr1_16
gttgaggtccacgatcctga

SEQ ID NO: 14703 - DNA, 20 bp, Artificial Sequence
  sgRNA
  Cdhr1_17
gtccacggagaatctccccc

SEQ ID NO: 14704 - DNA, 20 bp, Artificial Sequence
  sgRNA
  Cdhr1_18
gacaatcccatgaaagccgt

SEQ ID NO: 14705 - DNA, 20 bp, Artificial Sequence
  sgRNA
  Cdhr1_19
tgtgatgtcgatcttgagta

SEQ ID NO: 14706 - DNA, 20 bp, Artificial Sequence
  sgRNA
  Cdhr1_20
tcttaattcacccatccact

SEQ ID NO: 14707 - DNA, 20 bp, Artificial Sequence
  sgRNA
  Cdhr2_1
agtcaacttcataggctacg

SEQ ID NO: 14708 - DNA, 20 bp, Artificial Sequence
  sgRNA
  Cdhr2_2
ctccgtcaacgcgaacactg

SEQ ID NO: 14709 - DNA, 20 bp, Artificial Sequence
  sgRNA
  Cdhr2_3
tagaactccctgataaaccg

SEQ ID NO: 14710 - DNA, 20 bp, Artificial Sequence
  sgRNA
  Cdhr2_4
gacctggatggggatgaatg

SEQ ID NO: 14711 - DNA, 20 bp, Artificial Sequence
  sgRNA
  Cdhr2_5
gatggtcacaacgtagacag

SEQ ID NO: 14712 - DNA, 20 bp, Artificial Sequence
  sgRNA
  Cdhr2_6
gcgggcgtatgacctcaaca

SEQ ID NO: 14713 - DNA, 20 bp, Artificial Sequence
  sgRNA
  Cdhr2_7
agatggatacgaagaccggc

SEQ ID NO: 14714 - DNA, 20 bp, Artificial Sequence
  sgRNA
  Cdhr2_8
ctgccagaggacttaccagt

SEQ ID NO: 14715 - DNA, 20 bp, Artificial Sequence
  sgRNA
  Cdhr2_9
tcagtgaccagataacctgt

SEQ ID NO: 14716 - DNA, 20 bp, Artificial Sequence
  sgRNA
  Cdhr2_10
ctataacgtcttcgtgccgg

SEQ ID NO: 14717 - DNA, 20 bp, Artificial Sequence
  sgRNA
  Cdhr2_11
gaaaacaccacagaaccgac

SEQ ID NO: 14718 - DNA, 20 bp, Artificial Sequence
  sgRNA
  Cdhr2_12
cttccggattaccagatcag

SEQ ID NO: 14719 - DNA, 20 bp, Artificial Sequence
  sgRNA
  Cdhr2_13
ctccaactgctgctatccca

SEQ ID NO: 14720 - DNA, 20 bp, Artificial Sequence
  sgRNA
  Cdhr2_14
agaactccctgataaaccga

SEQ ID NO: 14721 - DNA, 20 bp, Artificial Sequence
  sgRNA
  Cdhr2_15
tatgaaatattgcaccaaac

SEQ ID NO: 14722 - DNA, 20 bp, Artificial Sequence
  sgRNA
  Cdhr2_16
gcttgtgttgcccaaccagc

SEQ ID NO: 14723 - DNA, 20 bp, Artificial Sequence
  sgRNA
  Cdhr2_17
attcacatccatcaccgtga

SEQ ID NO: 14724 - DNA, 20 bp, Artificial Sequence
  sgRNA
  Cdhr2_18
ggtggacgtcatctgcacca

SEQ ID NO: 14725 - DNA, 20 bp, Artificial Sequence
  sgRNA
  Cdhr2_19
cgaagacgttataggagcct

SEQ ID NO: 14726 - DNA, 20 bp, Artificial Sequence
  sgRNA
  Cdhr2_20
gacaaattctgctttcagga

SEQ ID NO: 14727 - DNA, 20 bp, Artificial Sequence
  sgRNA
  Cdhr3_1
tccagggtacttaccccgag

SEQ ID NO: 14728 - DNA, 20 bp, Artificial Sequence
  sgRNA
  Cdhr3_2
ggcacatcaaacacgtacga

SEQ ID NO: 14729 - DNA, 20 bp, Artificial Sequence
  sgRNA
  Cdhr3_3
caacccaaggcccttcacgg

SEQ ID NO: 14730 - DNA, 20 bp, Artificial Sequence
  sgRNA
  Cdhr3_4
tgtctacattctcaccgtcg

SEQ ID NO: 14731 - DNA, 20 bp, Artificial Sequence
  sgRNA
  Cdhr3_5
gattacctaccagatccgca

SEQ ID NO: 14732 - DNA, 20 bp, Artificial Sequence
  sgRNA
  Cdhr3_6
ttaccacgccatctggagcg

SEQ ID NO: 14733 - DNA, 20 bp, Artificial Sequence
  sgRNA
  Cdhr3_7
aatacaccactggagtccgg

SEQ ID NO: 14734 - DNA, 20 bp, Artificial Sequence
  sgRNA
  Cdhr3_8
tgcctgaaagaacagccaac

SEQ ID NO: 14735 - DNA, 20 bp, Artificial Sequence
  sgRNA
  Cdhr3_9
ggtagtcccagacggtatcg

SEQ ID NO: 14736 - DNA, 20 bp, Artificial Sequence
  sgRNA
  Cdhr3_10
ttgctcctctacgaccagga

SEQ ID NO: 14737 - DNA, 20 bp, Artificial Sequence
  sgRNA
  Cdhr3_11
attgctcctctacgaccagg

SEQ ID NO: 14738 - DNA, 20 bp, Artificial Sequence
  sgRNA
  Cdhr3_12
acgtgtactccacatctgca

SEQ ID NO: 14739 - DNA, 20 bp, Artificial Sequence
  sgRNA
  Cdhr3_13
cctgcctgccactagcaacg

SEQ ID NO: 14740 - DNA, 20 bp, Artificial Sequence
  sgRNA
  Cdhr3_14
gttctctgccacgttgctag

SEQ ID NO: 14741 - DNA, 20 bp, Artificial Sequence
  sgRNA
  Cdhr3_15
tgagctttctgcatgttgca

SEQ ID NO: 14742 - DNA, 20 bp, Artificial Sequence
  sgRNA
  Cdhr3_16
gctccccgctccagatggcg

SEQ ID NO: 14743 - DNA, 20 bp, Artificial Sequence
  sgRNA
  Cdhr3_17
gatcccagagtgacgatgaa

SEQ ID NO: 14744 - DNA, 20 bp, Artificial Sequence
  sgRNA
  Cdhr3_18
gacattctgaagttcttcga

SEQ ID NO: 14745 - DNA, 20 bp, Artificial Sequence
  sgRNA
  Cdhr3_19
ctaccgatgcagacttcccc

SEQ ID NO: 14746 - DNA, 20 bp, Artificial Sequence
  sgRNA
  Cdhr3_20
aagcagctggtagtcccaga

SEQ ID NO: 14747 - DNA, 20 bp, Artificial Sequence
  sgRNA
  Cdhr4_1
tctcacggttagcgtgcgcg

SEQ ID NO: 14748 - DNA, 20 bp, Artificial Sequence
  sgRNA
  Cdhr4_2
agtactcgaggctgttacga

SEQ ID NO: 14749 - DNA, 20 bp, Artificial Sequence
  sgRNA
  Cdhr4_3
tagtactcgaggctgttacg

SEQ ID NO: 14750 - DNA, 20 bp, Artificial Sequence
  sgRNA
  Cdhr4_4
accaccatcgaccaccaaga

SEQ ID NO: 14751 - DNA, 20 bp, Artificial Sequence
  sgRNA
  Cdhr4_5
gcgtgcgcgcggtaaaccag

SEQ ID NO: 14752 - DNA, 20 bp, Artificial Sequence
  sgRNA
  Cdhr4_6
ggattctgtcacgaagacgg

SEQ ID NO: 14753 - DNA, 20 bp, Artificial Sequence
  sgRNA
  Cdhr4_7
ctgaacgcgagccaaatcca

SEQ ID NO: 14754 - DNA, 20 bp, Artificial Sequence
  sgRNA
  Cdhr4_8
actcagacgatccacagcaa

SEQ ID NO: 14755 - DNA, 20 bp, Artificial Sequence
  sgRNA
  Cdhr4_9
cctgaacccggaatgtgcgt

SEQ ID NO: 14756 - DNA, 20 bp, Artificial Sequence
  sgRNA
  Cdhr4_10
tggcaaaagcaccagtgcag

SEQ ID NO: 14757 - DNA, 20 bp, Artificial Sequence
  sgRNA
  Cdhr4_11
catagtccaaaggccccagg

SEQ ID NO: 14758 - DNA, 20 bp, Artificial Sequence
  sgRNA
  Cdhr4_12
ggtttattgaagaagctggt

SEQ ID NO: 14759 - DNA, 20 bp, Artificial Sequence
  sgRNA
  Cdhr4_13
gaaatgaaggacctattgag

SEQ ID NO: 14760 - DNA, 20 bp, Artificial Sequence
  sgRNA
  Cdhr4_14
aaccgcagctggtagtcgag

SEQ ID NO: 14761 - DNA, 20 bp, Artificial Sequence
  sgRNA
  Cdhr4_15
ccagagcattaccatctcag

SEQ ID NO: 14762 - DNA, 20 bp, Artificial Sequence
  sgRNA
  Cdhr4_16
tttgctgtggatcgtctgag

SEQ ID NO: 14763 - DNA, 20 bp, Artificial Sequence
  sgRNA
  Cdhr4_17
gagccggtttagactgcaag

SEQ ID NO: 14764 - DNA, 20 bp, Artificial Sequence
  sgRNA
  Cdhr4_18
gcattcagcttccatcttgg

SEQ ID NO: 14765 - DNA, 20 bp, Artificial Sequence
  sgRNA
  Cdhr4_19
tgtccttgagtagctctgct

SEQ ID NO: 14766 - DNA, 20 bp, Artificial Sequence
  sgRNA
  Cdhr4_20
tcatcaatggagaaaggccc

SEQ ID NO: 14767 - DNA, 20 bp, Artificial Sequence
  sgRNA
  Cdhr5_1
ttcatcatcaacgcacacga

SEQ ID NO: 14768 - DNA, 20 bp, Artificial Sequence
  sgRNA
  Cdhr5_2
gatcctaaaggcataaggag

SEQ ID NO: 14769 - DNA, 20 bp, Artificial Sequence
  sgRNA
  Cdhr5_3
aagaaccatccgtgtagagg

SEQ ID NO: 14770 - DNA, 20 bp, Artificial Sequence
  sgRNA
  Cdhr5_4
gatatgtgacagctgagttg

SEQ ID NO: 14771 - DNA, 20 bp, Artificial Sequence
  sgRNA
  Cdhr5_5
ggtctatcctgactaaggag

SEQ ID NO: 14772 - DNA, 20 bp, Artificial Sequence
  sgRNA
  Cdhr5_6
ctatcctgactaaggagcgg

SEQ ID NO: 14773 - DNA, 20 bp, Artificial Sequence
  sgRNA
  Cdhr5_7
gaaggacaagaccttccctt

SEQ ID NO: 14774 - DNA, 20 bp, Artificial Sequence
  sgRNA
  Cdhr5_8
agtggtcgcccacccccaac

SEQ ID NO: 14775 - DNA, 20 bp, Artificial Sequence
  sgRNA
  Cdhr5_9
tctcagccagccacacctag

SEQ ID NO: 14776 - DNA, 20 bp, Artificial Sequence
  sgRNA
  Cdhr5_10
gtaccactgtgccatagtac

SEQ ID NO: 14777 - DNA, 20 bp, Artificial Sequence
  sgRNA
  Cdhr5_11
tgtcagcatccacgccaaag

SEQ ID NO: 14778 - DNA, 20 bp, Artificial Sequence
  sgRNA
  Cdhr5_12
actaaggagcggcggccgga

SEQ ID NO: 14779 - DNA, 20 bp, Artificial Sequence
  sgRNA
  Cdhr5_13
tctccgtccacagcatagat

SEQ ID NO: 14780 - DNA, 20 bp, Artificial Sequence
  sgRNA
  Cdhr5_14
aggtctttgagaggtcccag

SEQ ID NO: 14781 - DNA, 20 bp, Artificial Sequence
  sgRNA
  Cdhr5_15
tgtgagccatggcaacagca

SEQ ID NO: 14782 - DNA, 20 bp, Artificial Sequence
  sgRNA
  Cdhr5_16
ggaccaggactcatgatgag

SEQ ID NO: 14783 - DNA, 20 bp, Artificial Sequence
  sgRNA
  Cdhr5_17
ggacatggcagtgttgggcg

SEQ ID NO: 14784 - DNA, 20 bp, Artificial Sequence
  sgRNA
  Cdhr5_18
actggcgctgtccacatcgg

SEQ ID NO: 14785 - DNA, 20 bp, Artificial Sequence
  sgRNA
  Cdhr5_19
gatgacggttgtattcactt

SEQ ID NO: 14786 - DNA, 20 bp, Artificial Sequence
  sgRNA
  Cdhr5_20
ggatagacctcacggctgaa

SEQ ID NO: 14787 - DNA, 20 bp, Artificial Sequence
  sgRNA
  Cdon_1
gaacagataaagattcatcg

SEQ ID NO: 14788 - DNA, 20 bp, Artificial Sequence
  sgRNA
  Cdon_2
atcacaggtaaaatgtacgg

SEQ ID NO: 14789 - DNA, 20 bp, Artificial Sequence
  sgRNA
  Cdon_3
ctatttcgtgaagtaccgaa

SEQ ID NO: 14790 - DNA, 20 bp, Artificial Sequence
  sgRNA
  Cdon_4
ggctggttatcaatccatgg

SEQ ID NO: 14791 - DNA, 20 bp, Artificial Sequence
  sgRNA
  Cdon_5
aatagttccccgaatccgct

SEQ ID NO: 14792 - DNA, 20 bp, Artificial Sequence
  sgRNA
  Cdon_6
ccagttcctcgggaaacgca

SEQ ID NO: 14793 - DNA, 20 bp, Artificial Sequence
  sgRNA
  Cdon_7
gcaatgtccataagggtccg

SEQ ID NO: 14794 - DNA, 20 bp, Artificial Sequence
  sgRNA
  Cdon_8
agcatcccgtccttaccagg

SEQ ID NO: 14795 - DNA, 20 bp, Artificial Sequence
  sgRNA
  Cdon_9
gatgagcgagacccacaaga

SEQ ID NO: 14796 - DNA, 20 bp, Artificial Sequence
  sgRNA
  Cdon_10
cacgttccctgcgtttcccg

SEQ ID NO: 14797 - DNA, 20 bp, Artificial Sequence
  sgRNA
  Cdon_11
tttatattccaccttgaagg

SEQ ID NO: 14798 - DNA, 20 bp, Artificial Sequence
  sgRNA
  Cdon_12
gcatcgacccagcggattcg

SEQ ID NO: 14799 - DNA, 20 bp, Artificial Sequence
  sgRNA
  Cdon_13
aacggatgagaactagtgat

SEQ ID NO: 14800 - DNA, 20 bp, Artificial Sequence
  sgRNA
  Cdon_14
gctggtgcggtgacaataac

SEQ ID NO: 14801 - DNA, 20 bp, Artificial Sequence
  sgRNA
  Cdon_15
gctggtccggaaggtaagca

SEQ ID NO: 14802 - DNA, 20 bp, Artificial Sequence
  sgRNA
  Cdon_16
gcttccacagttcctgacca

SEQ ID NO: 14803 - DNA, 20 bp, Artificial Sequence
  sgRNA
  Cdon_17
gtaggatcccttatccttag

SEQ ID NO: 14804 - DNA, 20 bp, Artificial Sequence
  sgRNA
  Cdon_18
ccacacactccaaggtaacg

SEQ ID NO: 14805 - DNA, 20 bp, Artificial Sequence
  sgRNA
  Cdon_19
aatccaggtgacatagactg

SEQ ID NO: 14806 - DNA, 20 bp, Artificial Sequence
  sgRNA
  Cdon_20
gaggataagaggctaccact

SEQ ID NO: 14807 - DNA, 20 bp, Artificial Sequence
  sgRNA
  Ceacam1_1
atagtaatatgaatttcacg

SEQ ID NO: 14808 - DNA, 20 bp, Artificial Sequence
  sgRNA
  Ceacam1_2
aagcaacaactccaatcccg

SEQ ID NO: 14809 - DNA, 20 bp, Artificial Sequence
  sgRNA
  Ceacam1_3
ttgttgtcttcagcaacctg

SEQ ID NO: 14810 - DNA, 20 bp, Artificial Sequence
  sgRNA
  Ceacam1_4
agctcttgggaggatgcatg

SEQ ID NO: 14811 - DNA, 20 bp, Artificial Sequence
  sgRNA
  Ceacam1_5
acattggagccaacatccag

SEQ ID NO: 14812 - DNA, 20 bp, Artificial Sequence
  sgRNA
  Ceacam1_6
ttcacggggcaagcatacag

SEQ ID NO: 14813 - DNA, 20 bp, Artificial Sequence
  sgRNA
  Ceacam1_7
gcaaaggctccaagcgccag

SEQ ID NO: 14814 - DNA, 20 bp, Artificial Sequence
  sgRNA
  Ceacam1_8
acctgcttgtcgaatgacat

SEQ ID NO: 14815 - DNA, 20 bp, Artificial Sequence
  sgRNA
  Ceacam1_9
ggcaaaggctccaagcgcca

SEQ ID NO: 14816 - DNA, 20 bp, Artificial Sequence
  sgRNA
  Ceacam1_10
gtttcccttgtaccaggcaa

SEQ ID NO: 14817 - DNA, 20 bp, Artificial Sequence
  sgRNA
  Ceacam1_11
tgaaaactatcgtcgtactc

SEQ ID NO: 14818 - DNA, 20 bp, Artificial Sequence
  sgRNA
  Ceacam1_12
ctgataatataaactacctg

SEQ ID NO: 14819 - DNA, 20 bp, Artificial Sequence
  sgRNA
  Ceacam1_13
acacaaggaggcctctcaga

SEQ ID NO: 14820 - DNA, 20 bp, Artificial Sequence
  sgRNA
  Ceacam1_14
acttgttcacaatctgcccc

SEQ ID NO: 14821 - DNA, 20 bp, Artificial Sequence
  sgRNA
  Ceacam1_15
tctattccaggaagtctggc

SEQ ID NO: 14822 - DNA, 20 bp, Artificial Sequence
  sgRNA
  Ceacam1_16
agtggtggcagggctccagg

SEQ ID NO: 14823 - DNA, 20 bp, Artificial Sequence
  sgRNA
  Ceacam1_17
cagaatagaccctattaaga

SEQ ID NO: 14824 - DNA, 20 bp, Artificial Sequence
  sgRNA
  Ceacam1_18
ctcaatggtgacttcagcag

SEQ ID NO: 14825 - DNA, 20 bp, Artificial Sequence
  sgRNA
  Ceacam1_19
ggtgatcatttggaagagca

SEQ ID NO: 14826 - DNA, 20 bp, Artificial Sequence
  sgRNA
  Ceacam1_20
ctggtacaagggaaacacta

SEQ ID NO: 14827 - DNA, 20 bp, Artificial Sequence
  sgRNA
  Ceacam10_1
tgcggcccaacgttgccgaa

SEQ ID NO: 14828 - DNA, 20 bp, Artificial Sequence
  sgRNA
  Ceacam10_2
actggtacaagggaaacagt

SEQ ID NO: 14829 - DNA, 20 bp, Artificial Sequence
  sgRNA
  Ceacam10_3
ccattaataggagtaaaatg

SEQ ID NO: 14830 - DNA, 20 bp, Artificial Sequence
  sgRNA
  Ceacam10_4
attgttgtctgcagtaacgt

SEQ ID NO: 14831 - DNA, 20 bp, Artificial Sequence
  sgRNA
  Ceacam10_5
tacttgttcacaatctgcca

SEQ ID NO: 14832 - DNA, 20 bp, Artificial Sequence
  sgRNA
  Ceacam10_6
gtgagcagtagtccaaccca

SEQ ID NO: 14833 - DNA, 20 bp, Artificial Sequence
  sgRNA
  Ceacam10_7
ttgtctgcagtaacgttggg

SEQ ID NO: 14834 - DNA, 20 bp, Artificial Sequence
  sgRNA
  Ceacam10_8
ggacgctccgagcaatttac

SEQ ID NO: 14835 - DNA, 20 bp, Artificial Sequence
  sgRNA
  Ceacam10_9
agagagacaatatatagcaa

SEQ ID NO: 14836 - DNA, 20 bp, Artificial Sequence
  sgRNA
  Ceacam10_10
gctcaaggagggtaaaagtg

SEQ ID NO: 14837 - DNA, 20 bp, Artificial Sequence
  sgRNA
  Ceacam10_11
taaattgctcggagcgtccg

SEQ ID NO: 14838 - DNA, 20 bp, Artificial Sequence
  sgRNA
  Ceacam10_12
gtggtgggagggctcaagga

SEQ ID NO: 14839 - DNA, 20 bp, Artificial Sequence
  sgRNA
  Ceacam10_13
gttgggccgcacagcctcaa

SEQ ID NO: 14840 - DNA, 20 bp, Artificial Sequence
  sgRNA
  Ceacam10_14
acatgaaatcgcacagaaat

SEQ ID NO: 14841 - DNA, 20 bp, Artificial Sequence
  sgRNA
  Ceacam10_15
gctccagtaagttaaaagtg

SEQ ID NO: 14842 - DNA, 20 bp, Artificial Sequence
  sgRNA
  Ceacam10_16
cgagcaatttactggtacag

SEQ ID NO: 14843 - DNA, 20 bp, Artificial Sequence
  sgRNA
  Ceacam10_17
ggtgacaccttggaagaaca

SEQ ID NO: 14844 - DNA, 20 bp, Artificial Sequence
  sgRNA
  Ceacam10_18
ccctgtaccagtaaattgct

SEQ ID NO: 14845 - DNA, 20 bp, Artificial Sequence
  sgRNA
  Ceacam10_19
ttgttgtctgcagtaacgtt

SEQ ID NO: 14846 - DNA, 20 bp, Artificial Sequence
  sgRNA
  Ceacam10_20
aagtcaccgttgaggctgtg

SEQ ID NO: 14847 - DNA, 20 bp, Artificial Sequence
  sgRNA
  Ceacam11_1
gacagctaccaattctactg

SEQ ID NO: 14848 - DNA, 20 bp, Artificial Sequence
  sgRNA
  Ceacam11_2
atggtgatctgggtggtagt

SEQ ID NO: 14849 - DNA, 20 bp, Artificial Sequence
  sgRNA
  Ceacam11_3
gctatcttaaaatggtcaag

SEQ ID NO: 14850 - DNA, 20 bp, Artificial Sequence
  sgRNA
  Ceacam11_4
ttctcaactcacaattaagt

SEQ ID NO: 14851 - DNA, 20 bp, Artificial Sequence
  sgRNA
  Ceacam11_5
ctcgaagagtcgaagacgag

SEQ ID NO: 14852 - DNA, 20 bp, Artificial Sequence
  sgRNA
  Ceacam11_6
cgactcttcgagaaagtcca

SEQ ID NO: 14853 - DNA, 20 bp, Artificial Sequence
  sgRNA
  Ceacam11_7
tcagaccaacaagtaaacca

SEQ ID NO: 14854 - DNA, 20 bp, Artificial Sequence
  sgRNA
  Ceacam11_8
aagactctacctcctggcag

SEQ ID NO: 14855 - DNA, 20 bp, Artificial Sequence
  sgRNA
  Ceacam11_9
gcaatttcacaattcttgag

SEQ ID NO: 14856 - DNA, 20 bp, Artificial Sequence
  sgRNA
  Ceacam11_10
tgattcaatggtgatctggg

SEQ ID NO: 14857 - DNA, 20 bp, Artificial Sequence
  sgRNA
  Ceacam11_11
tcaaatccacagatatggtt

SEQ ID NO: 14858 - DNA, 20 bp, Artificial Sequence
  sgRNA
  Ceacam11_12
gctaccaattctactgtggt

SEQ ID NO: 14859 - DNA, 20 bp, Artificial Sequence
  sgRNA
  Ceacam11_13
atgtcactcagaatgacaca

SEQ ID NO: 14860 - DNA, 20 bp, Artificial Sequence
  sgRNA
  Ceacam11_14
gcaaagccttgaagcttctg

SEQ ID NO: 14861 - DNA, 20 bp, Artificial Sequence
  sgRNA
  Ceacam11_15
tcacccattcaactatgctg

SEQ ID NO: 14862 - DNA, 20 bp, Artificial Sequence
  sgRNA
  Ceacam11_16
agtaccaccagaaaagactc

SEQ ID NO: 14863 - DNA, 20 bp, Artificial Sequence
  sgRNA
  Ceacam11_17
agtgacattcaagagcacca

SEQ ID NO: 14864 - DNA, 20 bp, Artificial Sequence
  sgRNA
  Ceacam11_18
ggtagttggaatcagccagc

SEQ ID NO: 14865 - DNA, 20 bp, Artificial Sequence
  sgRNA
  Ceacam11_19
acttaattgtgagttgagaa

SEQ ID NO: 14866 - DNA, 20 bp, Artificial Sequence
  sgRNA
  Ceacam11_20
ccagcatagttgaatgggtg

SEQ ID NO: 14867 - DNA, 20 bp, Artificial Sequence
  sgRNA
  Ceacam12_1
aatagttatctgggcagtag

SEQ ID NO: 14868 - DNA, 20 bp, Artificial Sequence
  sgRNA
  Ceacam12_2
gctaccaattctagtgtgat

SEQ ID NO: 14869 - DNA, 20 bp, Artificial Sequence
  sgRNA
  Ceacam12_3
acgcattatttcacgtcttg

SEQ ID NO: 14870 - DNA, 20 bp, Artificial Sequence
  sgRNA
  Ceacam12_4
aaattgagtttgtgccacct

SEQ ID NO: 14871 - DNA, 20 bp, Artificial Sequence
  sgRNA
  Ceacam12_5
gattctgacatcaaatccac

SEQ ID NO: 14872 - DNA, 20 bp, Artificial Sequence
  sgRNA
  Ceacam12_6
tctgctggtttataatctgc

SEQ ID NO: 14873 - DNA, 20 bp, Artificial Sequence
  sgRNA
  Ceacam12_7
gctgctctcgaaggtctcac

SEQ ID NO: 14874 - DNA, 20 bp, Artificial Sequence
  sgRNA
  Ceacam12_8
ggttggaccttggcatcgtg

SEQ ID NO: 14875 - DNA, 20 bp, Artificial Sequence
  sgRNA
  Ceacam12_9
cagcctacgaaccatacctg

SEQ ID NO: 14876 - DNA, 20 bp, Artificial Sequence
  sgRNA
  Ceacam12_10
aggtcccatcacactagaat

SEQ ID NO: 14877 - DNA, 20 bp, Artificial Sequence
  sgRNA
  Ceacam12_11
aatctgccggagaatcttca

SEQ ID NO: 14878 - DNA, 20 bp, Artificial Sequence
  sgRNA
  Ceacam12_12
ttcacttccacacgatgcca

SEQ ID NO: 14879 - DNA, 20 bp, Artificial Sequence
  sgRNA
  Ceacam12_13
ttatccccttcaacagcaat

SEQ ID NO: 14880 - DNA, 20 bp, Artificial Sequence
  sgRNA
  Ceacam12_14
accctttcctggtacaaagg

SEQ ID NO: 14881 - DNA, 20 bp, Artificial Sequence
  sgRNA
  Ceacam12_15
gtttactttgaggtacacaa

SEQ ID NO: 14882 - DNA, 20 bp, Artificial Sequence
  sgRNA
  Ceacam12_16
aggctttgtctggcacaaag

SEQ ID NO: 14883 - DNA, 20 bp, Artificial Sequence
  sgRNA
  Ceacam12_17
acctcctttgtaccaggaaa

SEQ ID NO: 14884 - DNA, 20 bp, Artificial Sequence
  sgRNA
  Ceacam12_18
tcaccaattcaaccatgctg

SEQ ID NO: 14885 - DNA, 20 bp, Artificial Sequence
  sgRNA
  Ceacam12_19
gtggaagtgaagctgctatc

SEQ ID NO: 14886 - DNA, 20 bp, Artificial Sequence
  sgRNA
  Ceacam12_20
atagttatctgggcagtagt

SEQ ID NO: 14887 - DNA, 20 bp, Artificial Sequence
  sgRNA
  Ceacam13_1
gcttcttgtagcctaatagt

SEQ ID NO: 14888 - DNA, 20 bp, Artificial Sequence
  sgRNA
  Ceacam13_2
agagagacagtactcaacaa

SEQ ID NO: 14889 - DNA, 20 bp, Artificial Sequence
  sgRNA
  Ceacam13_3
aaagactgcacctcttggca

SEQ ID NO: 14890 - DNA, 20 bp, Artificial Sequence
  sgRNA
  Ceacam13_4
atggtgagatgagaagtagt

SEQ ID NO: 14891 - DNA, 20 bp, Artificial Sequence
  sgRNA
  Ceacam13_5
gaacagaagcccctgccaag

SEQ ID NO: 14892 - DNA, 20 bp, Artificial Sequence
  sgRNA
  Ceacam13_6
gcagtgggacttgcacacag

SEQ ID NO: 14893 - DNA, 20 bp, Artificial Sequence
  sgRNA
  Ceacam13_7
gctatcttcaaatgttcaag

SEQ ID NO: 14894 - DNA, 20 bp, Artificial Sequence
  sgRNA
  Ceacam13_8
atgtcaagaagaaagacgca

SEQ ID NO: 14895 - DNA, 20 bp, Artificial Sequence
  sgRNA
  Ceacam13_9
gagtgaaagtacgcaatgat

SEQ ID NO: 14896 - DNA, 20 bp, Artificial Sequence
  sgRNA
  Ceacam13_10
tcaccaattcaaccactctg

SEQ ID NO: 14897 - DNA, 20 bp, Artificial Sequence
  sgRNA
  Ceacam13_11
actgaattgtgagttgagaa

SEQ ID NO: 14898 - DNA, 20 bp, Artificial Sequence
  sgRNA
  Ceacam13_12
gcaatttcacaacacttgaa

SEQ ID NO: 14899 - DNA, 20 bp, Artificial Sequence
  sgRNA
  Ceacam13_13
atttacttggaggtcaataa

SEQ ID NO: 14900 - DNA, 20 bp, Artificial Sequence
  sgRNA
  Ceacam13_14
atcaacagatacggttcgta

SEQ ID NO: 14901 - DNA, 20 bp, Artificial Sequence
  sgRNA
  Ceacam13_15
aatgtcaagaagaaagacgc

SEQ ID NO: 14902 - DNA, 20 bp, Artificial Sequence
  sgRNA
  Ceacam13_16
ctgaattgtgagttgagaag

SEQ ID NO: 14903 - DNA, 20 bp, Artificial Sequence
  sgRNA
  Ceacam13_17
ataatatgcataccccagag

SEQ ID NO: 14904 - DNA, 20 bp, Artificial Sequence
  sgRNA
  Ceacam13_18
aagtcccactgcagtaaaat

SEQ ID NO: 14905 - DNA, 20 bp, Artificial Sequence
  sgRNA
  Ceacam13_19
aagactgcacctcttggcag

SEQ ID NO: 14906 - DNA, 20 bp, Artificial Sequence
  sgRNA
  Ceacam13_20
cttgacattgaagagaagca

SEQ ID NO: 14907 - DNA, 20 bp, Artificial Sequence
  sgRNA
  Ceacam14_1
gctatcaatgctactgtgat

SEQ ID NO: 14908 - DNA, 20 bp, Artificial Sequence
  sgRNA
  Ceacam14_2
gcttcttgtaacctaaaagt

SEQ ID NO: 14909 - DNA, 20 bp, Artificial Sequence
  sgRNA
  Ceacam14_3
actcaggatactacactcta

SEQ ID NO: 14910 - DNA, 20 bp, Artificial Sequence
  sgRNA
  Ceacam14_4
aattgcgttggtgccaccta

SEQ ID NO: 14911 - DNA, 20 bp, Artificial Sequence
  sgRNA
  Ceacam14_5
atgtcacaaagaatgacaca

SEQ ID NO: 14912 - DNA, 20 bp, Artificial Sequence
  sgRNA
  Ceacam14_6
gattgacagtacgcaacgat

SEQ ID NO: 14913 - DNA, 20 bp, Artificial Sequence
  sgRNA
  Ceacam14_7
ttctcaactcaaaattgcgt

SEQ ID NO: 14914 - DNA, 20 bp, Artificial Sequence
  sgRNA
  Ceacam14_8
aagtctgtacctcctggcag

SEQ ID NO: 14915 - DNA, 20 bp, Artificial Sequence
  sgRNA
  Ceacam14_9
ataatatgcatgccccagca

SEQ ID NO: 14916 - DNA, 20 bp, Artificial Sequence
  sgRNA
  Ceacam14_10
gctatcttcaaatggtcaag

SEQ ID NO: 14917 - DNA, 20 bp, Artificial Sequence
  sgRNA
  Ceacam14_11
gagcaggagcccctgccagg

SEQ ID NO: 14918 - DNA, 20 bp, Artificial Sequence
  sgRNA
  Ceacam14_12
aatggcttgctatcttcaaa

SEQ ID NO: 14919 - DNA, 20 bp, Artificial Sequence
  sgRNA
  Ceacam14_13
tgtgacattcaagagaagca

SEQ ID NO: 14920 - DNA, 20 bp, Artificial Sequence
  sgRNA
  Ceacam14_14
gtgatcggactttcacatag

SEQ ID NO: 14921 - DNA, 20 bp, Artificial Sequence
  sgRNA
  Ceacam14_15
aatgtcacaaagaatgacac

SEQ ID NO: 14922 - DNA, 20 bp, Artificial Sequence
  sgRNA
  Ceacam14_16
gtagtatcctgagtctttac

SEQ ID NO: 14923 - DNA, 20 bp, Artificial Sequence
  sgRNA
  Ceacam14_17
gtttacttggacttcaataa

SEQ ID NO: 14924 - DNA, 20 bp, Artificial Sequence
  sgRNA
  Ceacam14_18
agattgacagtacgcaacga

SEQ ID NO: 14925 - DNA, 20 bp, Artificial Sequence
  sgRNA
  Ceacam14_19
agactttaacattcttcggc

SEQ ID NO: 14926 - DNA, 20 bp, Artificial Sequence
  sgRNA
  Ceacam14_20
tgttgatttgaaattagaat

SEQ ID NO: 14927 - DNA, 20 bp, Artificial Sequence
  sgRNA
  Ceacam19_1
agatagtggcacctatcagg

SEQ ID NO: 14928 - DNA, 20 bp, Artificial Sequence
  sgRNA
  Ceacam19_2
atcactcctaggtgcacgcg

SEQ ID NO: 14929 - DNA, 20 bp, Artificial Sequence
  sgRNA
  Ceacam19_3
agtgctgggaacaccgtgaa

SEQ ID NO: 14930 - DNA, 20 bp, Artificial Sequence
  sgRNA
  Ceacam19_4
cttatatccccggactacca

SEQ ID NO: 14931 - DNA, 20 bp, Artificial Sequence
  sgRNA
  Ceacam19_5
gcttcgagtgaccaggacat

SEQ ID NO: 14932 - DNA, 20 bp, Artificial Sequence
  sgRNA
  Ceacam19_6
cggactaccacggccccaga

SEQ ID NO: 14933 - DNA, 20 bp, Artificial Sequence
  sgRNA
  Ceacam19_7
tgataggtgccactatctga

SEQ ID NO: 14934 - DNA, 20 bp, Artificial Sequence
  sgRNA
  Ceacam19_8
gctctgggatcatctcgatg

SEQ ID NO: 14935 - DNA, 20 bp, Artificial Sequence
  sgRNA
  Ceacam19_9
tctggggccgtggtagtccg

SEQ ID NO: 14936 - DNA, 20 bp, Artificial Sequence
  sgRNA
  Ceacam19_10
gcactgctcaggatttcatc

SEQ ID NO: 14937 - DNA, 20 bp, Artificial Sequence
  sgRNA
  Ceacam19_11
tgtcactgatgggagacacc

SEQ ID NO: 14938 - DNA, 20 bp, Artificial Sequence
  sgRNA
  Ceacam19_12
ccaccgggctgcttctcaaa

SEQ ID NO: 14939 - DNA, 20 bp, Artificial Sequence
  sgRNA
  Ceacam19_13
agagcagcctcaaaagaacc

SEQ ID NO: 14940 - DNA, 20 bp, Artificial Sequence
  sgRNA
  Ceacam19_14
cctggtcactcgaagccgga

SEQ ID NO: 14941 - DNA, 20 bp, Artificial Sequence
  sgRNA
  Ceacam19_15
tggccttcattgtccaggca

SEQ ID NO: 14942 - DNA, 20 bp, Artificial Sequence
  sgRNA
  Ceacam19_16
tgggatcatctcgatgtgga

SEQ ID NO: 14943 - DNA, 20 bp, Artificial Sequence
  sgRNA
  Ceacam19_17
tcattgggagtcttgctatc

SEQ ID NO: 14944 - DNA, 20 bp, Artificial Sequence
  sgRNA
  Ceacam19_18
tgagccttggggcagctcaa

SEQ ID NO: 14945 - DNA, 20 bp, Artificial Sequence
  sgRNA
  Ceacam19_19
ggctcctgagatgctggtgg

SEQ ID NO: 14946 - DNA, 20 bp, Artificial Sequence
  sgRNA
  Ceacam19_20
ggatttcatctggtacctgg

SEQ ID NO: 14947 - DNA, 20 bp, Artificial Sequence
  sgRNA
  Ceacam2_1
tcggcctttagctggcacaa

SEQ ID NO: 14948 - DNA, 20 bp, Artificial Sequence
  sgRNA
  Ceacam2_2
agatcaaaactatcgtcgta

SEQ ID NO: 14949 - DNA, 20 bp, Artificial Sequence
  sgRNA
  Ceacam2_3
acaggtaggttatattatca

SEQ ID NO: 14950 - DNA, 20 bp, Artificial Sequence
  sgRNA
  Ceacam2_4
acagtcacttgtgcagtggt

SEQ ID NO: 14951 - DNA, 20 bp, Artificial Sequence
  sgRNA
  Ceacam2_5
gcactaataagactataaaa

SEQ ID NO: 14952 - DNA, 20 bp, Artificial Sequence
  sgRNA
  Ceacam2_6
ggtgaccctttggatgagca

SEQ ID NO: 14953 - DNA, 20 bp, Artificial Sequence
  sgRNA
  Ceacam2_7
ctgataatataacctacctg

SEQ ID NO: 14954 - DNA, 20 bp, Artificial Sequence
  sgRNA
  Ceacam2_8
gtgagcagtagtccaaacca

SEQ ID NO: 14955 - DNA, 20 bp, Artificial Sequence
  sgRNA
  Ceacam2_9
cattgttgccttcagcagcg

SEQ ID NO: 14956 - DNA, 20 bp, Artificial Sequence
  sgRNA
  Ceacam2_10
ataaaagggcctgtacacag

SEQ ID NO: 14957 - DNA, 20 bp, Artificial Sequence
  sgRNA
  Ceacam2_11
caacaactccaatcccgtag

SEQ ID NO: 14958 - DNA, 20 bp, Artificial Sequence
  sgRNA
  Ceacam2_12
gaagatgacaacctctcagg

SEQ ID NO: 14959 - DNA, 20 bp, Artificial Sequence
  sgRNA
  Ceacam2_13
ccggggtgattctaatagca

SEQ ID NO: 14960 - DNA, 20 bp, Artificial Sequence
  sgRNA
  Ceacam2_14
ccctgctattagaatcaccc

SEQ ID NO: 14961 - DNA, 20 bp, Artificial Sequence
  sgRNA
  Ceacam2_15
tggatccctgctcatccaaa

SEQ ID NO: 14962 - DNA, 20 bp, Artificial Sequence
  sgRNA
  Ceacam2_16
cataacagtcacttgtgcag

SEQ ID NO: 14963 - DNA, 20 bp, Artificial Sequence
  sgRNA
  Ceacam2_17
agcgagacttcctggaacag

SEQ ID NO: 14964 - DNA, 20 bp, Artificial Sequence
  sgRNA
  Ceacam2_18
ttgacggtctttcgacaagc

SEQ ID NO: 14965 - DNA, 20 bp, Artificial Sequence
  sgRNA
  Ceacam2_19
agttgtttacaatatgatga

SEQ ID NO: 14966 - DNA, 20 bp, Artificial Sequence
  sgRNA
  Ceacam2_20
caaaatagaccctattaaga

SEQ ID NO: 14967 - DNA, 20 bp, Artificial Sequence
  sgRNA
  Ceacam20_1
tgctaagcaggtcggcacgg

SEQ ID NO: 14968 - DNA, 20 bp, Artificial Sequence
  sgRNA
  Ceacam20_2
ctcacagttcaccgtcagcg

SEQ ID NO: 14969 - DNA, 20 bp, Artificial Sequence
  sgRNA
  Ceacam20_3
ggagtctgcccggcaataca

SEQ ID NO: 14970 - DNA, 20 bp, Artificial Sequence
  sgRNA
  Ceacam20_4
gagtgtgaggtgtggaactg

SEQ ID NO: 14971 - DNA, 20 bp, Artificial Sequence
  sgRNA
  Ceacam20_5
tcaccatcctcattgtccag

SEQ ID NO: 14972 - DNA, 20 bp, Artificial Sequence
  sgRNA
  Ceacam20_6
tgataacatcaccatccact

SEQ ID NO: 14973 - DNA, 20 bp, Artificial Sequence
  sgRNA
  Ceacam20_7
agctgagcatcgaagcactg

SEQ ID NO: 14974 - DNA, 20 bp, Artificial Sequence
  sgRNA
  Ceacam20_8
gttgttggagacccagtgga

SEQ ID NO: 14975 - DNA, 20 bp, Artificial Sequence
  sgRNA
  Ceacam20_9
cagccttacttccgaccaca

SEQ ID NO: 14976 - DNA, 20 bp, Artificial Sequence
  sgRNA
  Ceacam20_10
caacaccgtgaacttcaggg

SEQ ID NO: 14977 - DNA, 20 bp, Artificial Sequence
  sgRNA
  Ceacam20_11
cctgcttagcaacacccaga

SEQ ID NO: 14978 - DNA, 20 bp, Artificial Sequence
  sgRNA
  Ceacam20_12
tttgggatgacagtgtcagg

SEQ ID NO: 14979 - DNA, 20 bp, Artificial Sequence
  sgRNA
  Ceacam20_13
agaggtggcattctccacaa

SEQ ID NO: 14980 - DNA, 20 bp, Artificial Sequence
  sgRNA
  Ceacam20_14
ctccccatcaagcaccttag

SEQ ID NO: 14981 - DNA, 20 bp, Artificial Sequence
  sgRNA
  Ceacam20_15
caccttagaggagtgctcat

SEQ ID NO: 14982 - DNA, 20 bp, Artificial Sequence
  sgRNA
  Ceacam20_16
gagcactgtcacagagcaga

SEQ ID NO: 14983 - DNA, 20 bp, Artificial Sequence
  sgRNA
  Ceacam20_17
gaccaagtggaaatcaccca

SEQ ID NO: 14984 - DNA, 20 bp, Artificial Sequence
  sgRNA
  Ceacam20_18
tcactgtccacgagcagcag

SEQ ID NO: 14985 - DNA, 20 bp, Artificial Sequence
  sgRNA
  Ceacam20_19
gtatcaatcaagctggactc

SEQ ID NO: 14986 - DNA, 20 bp, Artificial Sequence
  sgRNA
  Ceacam20_20
gagagttgttggagacccag

SEQ ID NO: 14987 - DNA, 20 bp, Artificial Sequence
  sgRNA
  Ceacam3_1
tattcactgacctatagcag

SEQ ID NO: 14988 - DNA, 20 bp, Artificial Sequence
  sgRNA
  Ceacam3_2
ctttgtaccagaaaacggct

SEQ ID NO: 14989 - DNA, 20 bp, Artificial Sequence
  sgRNA
  Ceacam3_3
gcgtccacaggtcaaaatgg

SEQ ID NO: 14990 - DNA, 20 bp, Artificial Sequence
  sgRNA
  Ceacam3_4
ggaactggatcgatcgtgag

SEQ ID NO: 14991 - DNA, 20 bp, Artificial Sequence
  sgRNA
  Ceacam3_5
acactggaatctccacccag

SEQ ID NO: 14992 - DNA, 20 bp, Artificial Sequence
  sgRNA
  Ceacam3_6
agtgacattctgaatcagga

SEQ ID NO: 14993 - DNA, 20 bp, Artificial Sequence
  sgRNA
  Ceacam3_7
atgtcgacttgggtagtggt

SEQ ID NO: 14994 - DNA, 20 bp, Artificial Sequence
  sgRNA
  Ceacam3_8
ccttattaaccttaaacaga

SEQ ID NO: 14995 - DNA, 20 bp, Artificial Sequence
  sgRNA
  Ceacam3_9
gctccacaatgccacccaga

SEQ ID NO: 14996 - DNA, 20 bp, Artificial Sequence
  sgRNA
  Ceacam3_10
ctagtaatagaagtgtgctg

SEQ ID NO: 14997 - DNA, 20 bp, Artificial Sequence
  sgRNA
  Ceacam3_11
agtgacattctgaagcacga

SEQ ID NO: 14998 - DNA, 20 bp, Artificial Sequence
  sgRNA
  Ceacam3_12
tgccacccaatgttgttgaa

SEQ ID NO: 14999 - DNA, 20 bp, Artificial Sequence
  sgRNA
  Ceacam3_13
ctacgaaccataagtaaacg

SEQ ID NO: 15000 - DNA, 20 bp, Artificial Sequence
  sgRNA
  Ceacam3_14
gatgccaccgagaaagacac

SEQ ID NO: 15001 - DNA, 20 bp, Artificial Sequence
  sgRNA
  Ceacam3_15
gtgttgggccctgctcacag

SEQ ID NO: 15002 - DNA, 20 bp, Artificial Sequence
  sgRNA
  Ceacam3_16
tcgtgcttcagaatgtcact

SEQ ID NO: 15003 - DNA, 20 bp, Artificial Sequence
  sgRNA
  Ceacam3_17
aggcatgtacacactacaaa

SEQ ID NO: 15004 - DNA, 20 bp, Artificial Sequence
  sgRNA
  Ceacam3_18
gagtgacattctgaagcacg

SEQ ID NO: 15005 - DNA, 20 bp, Artificial Sequence
  sgRNA
  Ceacam3_19
ctcccttcaacaacattggg

SEQ ID NO: 15006 - DNA, 20 bp, Artificial Sequence
  sgRNA
  Ceacam3_20
tgctgtacactgtctctcta

SEQ ID NO: 15007 - DNA, 20 bp, Artificial Sequence
  sgRNA
  Ceacam5_1
tctgtatgcagcccccacgg

SEQ ID NO: 15008 - DNA, 20 bp, Artificial Sequence
  sgRNA
  Ceacam5_2
cccccttcaacaatgctcgg

SEQ ID NO: 15009 - DNA, 20 bp, Artificial Sequence
  sgRNA
  Ceacam5_3
gctaataattgatgtcactg

SEQ ID NO: 15010 - DNA, 20 bp, Artificial Sequence
  sgRNA
  Ceacam5_4
tcaagatcgaatcacttcct

SEQ ID NO: 15011 - DNA, 20 bp, Artificial Sequence
  sgRNA
  Ceacam5_5
tttcctacagcaacattccg

SEQ ID NO: 15012 - DNA, 20 bp, Artificial Sequence
  sgRNA
  Ceacam5_6
gtatgcactccccaaaatgg

SEQ ID NO: 15013 - DNA, 20 bp, Artificial Sequence
  sgRNA
  Ceacam5_7
atagaggtgatattcaccaa

SEQ ID NO: 15014 - DNA, 20 bp, Artificial Sequence
  sgRNA
  Ceacam5_8
gagaaggctacagcaagtag

SEQ ID NO: 15015 - DNA, 20 bp, Artificial Sequence
  sgRNA
  Ceacam5_9
agcacagtaactttagtggc

SEQ ID NO: 15016 - DNA, 20 bp, Artificial Sequence
  sgRNA
  Ceacam5_10
gatgagctcagatttctcct

SEQ ID NO: 15017 - DNA, 20 bp, Artificial Sequence
  sgRNA
  Ceacam5_11
gtgctgggtcctggtcacag

SEQ ID NO: 15018 - DNA, 20 bp, Artificial Sequence
  sgRNA
  Ceacam5_12
cgagaaacagtatacaacaa

SEQ ID NO: 15019 - DNA, 20 bp, Artificial Sequence
  sgRNA
  Ceacam5_13
atgtcactgaggatgatgca

SEQ ID NO: 15020 - DNA, 20 bp, Artificial Sequence
  sgRNA
  Ceacam5_14
ggctgcatacagaggaatag

SEQ ID NO: 15021 - DNA, 20 bp, Artificial Sequence
  sgRNA
  Ceacam5_15
tcctctgtatgcagccccca

SEQ ID NO: 15022 - DNA, 20 bp, Artificial Sequence
  sgRNA
  Ceacam5_16
agtgacatcaatcatcacca

SEQ ID NO: 15023 - DNA, 20 bp, Artificial Sequence
  sgRNA
  Ceacam5_17
agcacatgttcaactccagc

SEQ ID NO: 15024 - DNA, 20 bp, Artificial Sequence
  sgRNA
  Ceacam5_18
gtacaaaggcgtgattgccg

SEQ ID NO: 15025 - DNA, 20 bp, Artificial Sequence
  sgRNA
  Ceacam5_19
ccaccgagcattgttgaagg

SEQ ID NO: 15026 - DNA, 20 bp, Artificial Sequence
  sgRNA
  Ceacam5_20
tgcagaatacaagagagcca

SEQ ID NO: 15027 - DNA, 20 bp, Artificial Sequence
  sgRNA
  Celsr1_1
gtacggatcacaccagacgt

SEQ ID NO: 15028 - DNA, 20 bp, Artificial Sequence
  sgRNA
  Celsr1_2
gctggtgcagtactacaaca

SEQ ID NO: 15029 - DNA, 20 bp, Artificial Sequence
  sgRNA
  Celsr1_3
agtcccggataactgacggg

SEQ ID NO: 15030 - DNA, 20 bp, Artificial Sequence
  sgRNA
  Celsr1_4
ctttgctactccaatccgtg

SEQ ID NO: 15031 - DNA, 20 bp, Artificial Sequence
  sgRNA
  Celsr1_5
gataggccggaagagcaccg

SEQ ID NO: 15032 - DNA, 20 bp, Artificial Sequence
  sgRNA
  Celsr1_6
gtagggatgctcatactcgc

SEQ ID NO: 15033 - DNA, 20 bp, Artificial Sequence
  sgRNA
  Celsr1_7
agtggagtatgcaaaaacgg

SEQ ID NO: 15034 - DNA, 20 bp, Artificial Sequence
  sgRNA
  Celsr1_8
gcccatgcggttctaccacg

SEQ ID NO: 15035 - DNA, 20 bp, Artificial Sequence
  sgRNA
  Celsr1_9
gcctgtcatcaacacccccg

SEQ ID NO: 15036 - DNA, 20 bp, Artificial Sequence
  sgRNA
  Celsr1_10
attcccactgacgcactgag

SEQ ID NO: 15037 - DNA, 20 bp, Artificial Sequence
  sgRNA
  Celsr1_11
aacgttgataaagacctgcg

SEQ ID NO: 15038 - DNA, 20 bp, Artificial Sequence
  sgRNA
  Celsr1_12
ggtccggtaaatgacaacca

SEQ ID NO: 15039 - DNA, 20 bp, Artificial Sequence
  sgRNA
  Celsr1_13
gctgccccccacgatagtgg

SEQ ID NO: 15040 - DNA, 20 bp, Artificial Sequence
  sgRNA
  Celsr1_14
ggaagtcaggcaactccggt

SEQ ID NO: 15041 - DNA, 20 bp, Artificial Sequence
  sgRNA
  Celsr1_15
gcgcacatcattgccaaaga

SEQ ID NO: 15042 - DNA, 20 bp, Artificial Sequence
  sgRNA
  Celsr1_16
ggttggtcagcctcaccacg

SEQ ID NO: 15043 - DNA, 20 bp, Artificial Sequence
  sgRNA
  Celsr1_17
cgtccattcttgtctcgttg

SEQ ID NO: 15044 - DNA, 20 bp, Artificial Sequence
  sgRNA
  Celsr1_18
ctgtgataatcctttcgcgg

SEQ ID NO: 15045 - DNA, 20 bp, Artificial Sequence
  sgRNA
  Celsr1_19
gaccatccgtgccaccgacg

SEQ ID NO: 15046 - DNA, 20 bp, Artificial Sequence
  sgRNA
  Celsr1_20
ccaggaactgagcggacggc

SEQ ID NO: 15047 - DNA, 20 bp, Artificial Sequence
  sgRNA
  Celsr2_1
gtacaccgttcggctcaacg

SEQ ID NO: 15048 - DNA, 20 bp, Artificial Sequence
  sgRNA
  Celsr2_2
ctgacgtacagcttcgagcg

SEQ ID NO: 15049 - DNA, 20 bp, Artificial Sequence
  sgRNA
  Celsr2_3
cgggcattgtgcgcacactg

SEQ ID NO: 15050 - DNA, 20 bp, Artificial Sequence
  sgRNA
  Celsr2_4
cggcacaaacggagacacgg

SEQ ID NO: 15051 - DNA, 20 bp, Artificial Sequence
  sgRNA
  Celsr2_5
aggcgactactgcgagaccg

SEQ ID NO: 15052 - DNA, 20 bp, Artificial Sequence
  sgRNA
  Celsr2_6
ccacgtaatgcctcataacg

SEQ ID NO: 15053 - DNA, 20 bp, Artificial Sequence
  sgRNA
  Celsr2_7
cgctagactacaaactcgag

SEQ ID NO: 15054 - DNA, 20 bp, Artificial Sequence
  sgRNA
  Celsr2_8
ggcgtcctcgttgagccgaa

SEQ ID NO: 15055 - DNA, 20 bp, Artificial Sequence
  sgRNA
  Celsr2_9
ccacattgatgctctccccg

SEQ ID NO: 15056 - DNA, 20 bp, Artificial Sequence
  sgRNA
  Celsr2_10
gctgtgggcttggatccgga

SEQ ID NO: 15057 - DNA, 20 bp, Artificial Sequence
  sgRNA
  Celsr2_11
gctacgtgtcaccatcatca

SEQ ID NO: 15058 - DNA, 20 bp, Artificial Sequence
  sgRNA
  Celsr2_12
atctgagcagaaggtagccg

SEQ ID NO: 15059 - DNA, 20 bp, Artificial Sequence
  sgRNA
  Celsr2_13
gcattgtgcgcacactgcgg

SEQ ID NO: 15060 - DNA, 20 bp, Artificial Sequence
  sgRNA
  Celsr2_14
gtaccagccttacggagatt

SEQ ID NO: 15061 - DNA, 20 bp, Artificial Sequence
  sgRNA
  Celsr2_15
cgaaaacccaatacacccca

SEQ ID NO: 15062 - DNA, 20 bp, Artificial Sequence
  sgRNA
  Celsr2_16
tgagatcgatcctcgctcgg

SEQ ID NO: 15063 - DNA, 20 bp, Artificial Sequence
  sgRNA
  Celsr2_17
gaagaccaccacatgatccg

SEQ ID NO: 15064 - DNA, 20 bp, Artificial Sequence
  sgRNA
  Celsr2_18
gcacgggcgggttatcattg

SEQ ID NO: 15065 - DNA, 20 bp, Artificial Sequence
  sgRNA
  Celsr2_19
cagaccggagtctcgatccg

SEQ ID NO: 15066 - DNA, 20 bp, Artificial Sequence
  sgRNA
  Celsr2_20
cctccacacttagcactacg

SEQ ID NO: 15067 - DNA, 20 bp, Artificial Sequence
  sgRNA
  Celsr3_1
gagttccactatcgaccgag

SEQ ID NO: 15068 - DNA, 20 bp, Artificial Sequence
  sgRNA
  Celsr3_2
gtgctgataagacccgaacg

SEQ ID NO: 15069 - DNA, 20 bp, Artificial Sequence
  sgRNA
  Celsr3_3
gtaccaccttcggctcaatg

SEQ ID NO: 15070 - DNA, 20 bp, Artificial Sequence
  sgRNA
  Celsr3_4
aaagtaaaacagctccacgt

SEQ ID NO: 15071 - DNA, 20 bp, Artificial Sequence
  sgRNA
  Celsr3_5
gctgttctcgcgaagagtag

SEQ ID NO: 15072 - DNA, 20 bp, Artificial Sequence
  sgRNA
  Celsr3_6
tttccaacgtccactccgca

SEQ ID NO: 15073 - DNA, 20 bp, Artificial Sequence
  sgRNA
  Celsr3_7
tggtataccattgtcccgag

SEQ ID NO: 15074 - DNA, 20 bp, Artificial Sequence
  sgRNA
  Celsr3_8
gcacattgatggccgccgaa

SEQ ID NO: 15075 - DNA, 20 bp, Artificial Sequence
  sgRNA
  Celsr3_9
ggagctgtccgagactcgcg

SEQ ID NO: 15076 - DNA, 20 bp, Artificial Sequence
  sgRNA
  Celsr3_10
attatcagcggcaacagccg

SEQ ID NO: 15077 - DNA, 20 bp, Artificial Sequence
  sgRNA
  Celsr3_11
agctcctccgagctgaacca

SEQ ID NO: 15078 - DNA, 20 bp, Artificial Sequence
  sgRNA
  Celsr3_12
ggatgtgcgccctcacacgg

SEQ ID NO: 15079 - DNA, 20 bp, Artificial Sequence
  sgRNA
  Celsr3_13
gattcgccgtctgtagtagg

SEQ ID NO: 15080 - DNA, 20 bp, Artificial Sequence
  sgRNA
  Celsr3_14
ggccagatcctaaagagccg

SEQ ID NO: 15081 - DNA, 20 bp, Artificial Sequence
  sgRNA
  Celsr3_15
gctacagcgacaccgtgcat

SEQ ID NO: 15082 - DNA, 20 bp, Artificial Sequence
  sgRNA
  Celsr3_16
gcaccacgatccacatttcg

SEQ ID NO: 15083 - DNA, 20 bp, Artificial Sequence
  sgRNA
  Celsr3_17
ggagttccactatcgaccga

SEQ ID NO: 15084 - DNA, 20 bp, Artificial Sequence
  sgRNA
  Celsr3_18
agtgtgctcaaccattctcg

SEQ ID NO: 15085 - DNA, 20 bp, Artificial Sequence
  sgRNA
  Celsr3_19
ccatggtcgcaacttcctca

SEQ ID NO: 15086 - DNA, 20 bp, Artificial Sequence
  sgRNA
  Celsr3_20
gggcacatcagtactgcgcg

SEQ ID NO: 15087 - DNA, 20 bp, Artificial Sequence
  sgRNA
  Cfc1_1
gaaagaatgacattccggag

SEQ ID NO: 15088 - DNA, 20 bp, Artificial Sequence
  sgRNA
  Cfc1_2
ggttatcagagcgaaggaga

SEQ ID NO: 15089 - DNA, 20 bp, Artificial Sequence
  sgRNA
  Cfc1_3
tcccggggatcactggagag

SEQ ID NO: 15090 - DNA, 20 bp, Artificial Sequence
  sgRNA
  Cfc1_4
gcgacagtcaccaaaaacag

SEQ ID NO: 15091 - DNA, 20 bp, Artificial Sequence
  sgRNA
  Cfc1_5
agaaagaatgacattccgga

SEQ ID NO: 15092 - DNA, 20 bp, Artificial Sequence
  sgRNA
  Cfc1_6
gctattgcgagcacgaccag

SEQ ID NO: 15093 - DNA, 20 bp, Artificial Sequence
  sgRNA
  Cfc1_7
ggtccaagctccatgcccta

SEQ ID NO: 15094 - DNA, 20 bp, Artificial Sequence
  sgRNA
  Cfc1_8
gcagagactgtggtgcccta

SEQ ID NO: 15095 - DNA, 20 bp, Artificial Sequence
  sgRNA
  Cfc1_9
agtcaggaagggaatcccat

SEQ ID NO: 15096 - DNA, 20 bp, Artificial Sequence
  sgRNA
  Cfc1_10
agcgaccagtgaaataggca

SEQ ID NO: 15097 - DNA, 20 bp, Artificial Sequence
  sgRNA
  Cfc1_11
tgtggcaacagcgggataca

SEQ ID NO: 15098 - DNA, 20 bp, Artificial Sequence
  sgRNA
  Cfc1_12
ttctgtccagtgtcgtcccg

SEQ ID NO: 15099 - DNA, 20 bp, Artificial Sequence
  sgRNA
  Cfc1_13
agaagatgcacctgcatagg

SEQ ID NO: 15100 - DNA, 20 bp, Artificial Sequence
  sgRNA
  Cfc1_14
actgtcgcgctgcagctcat

SEQ ID NO: 15101 - DNA, 20 bp, Artificial Sequence
  sgRNA
  Cfc1_15
gcaatagcgaccagtgaaat

SEQ ID NO: 15102 - DNA, 20 bp, Artificial Sequence
  sgRNA
  Cfc1_16
gtgtgccctgcctatttcac

SEQ ID NO: 15103 - DNA, 20 bp, Artificial Sequence
  sgRNA
  Cfc1_17
agtggctgaacgtttggtgt

SEQ ID NO: 15104 - DNA, 20 bp, Artificial Sequence
  sgRNA
  Cfc1_18
gcataggcggcagctgtgca

SEQ ID NO: 15105 - DNA, 20 bp, Artificial Sequence
  sgRNA
  Cfc1_19
gtatcccgctgttgccacaa

SEQ ID NO: 15106 - DNA, 20 bp, Artificial Sequence
  sgRNA
  Cfc1_20
tcccgctgttgccacaatgg

SEQ ID NO: 15107 - DNA, 20 bp, Artificial Sequence
  sgRNA
  Chl1_1
ttgttagccgcaattatccg

SEQ ID NO: 15108 - DNA, 20 bp, Artificial Sequence
  sgRNA
  Chl1_2
tgaagaaaactacgcgacag

SEQ ID NO: 15109 - DNA, 20 bp, Artificial Sequence
  sgRNA
  Chl1_3
gtacagccaacaatttgttg

SEQ ID NO: 15110 - DNA, 20 bp, Artificial Sequence
  sgRNA
  Chl1_4
tgttgggtagacaatgccat

SEQ ID NO: 15111 - DNA, 20 bp, Artificial Sequence
  sgRNA
  Chl1_5
cagtacacggacttctaaga

SEQ ID NO: 15112 - DNA, 20 bp, Artificial Sequence
  sgRNA
  Chl1_6
agtgatgaaaaacctctcaa

SEQ ID NO: 15113 - DNA, 20 bp, Artificial Sequence
  sgRNA
  Chl1_7
gaactactgaggaggatgcg

SEQ ID NO: 15114 - DNA, 20 bp, Artificial Sequence
  sgRNA
  Chl1_8
atttaactctccaagctcgt

SEQ ID NO: 15115 - DNA, 20 bp, Artificial Sequence
  sgRNA
  Chl1_9
ccggcacaagtacctctaca

SEQ ID NO: 15116 - DNA, 20 bp, Artificial Sequence
  sgRNA
  Chl1_10
tggtgactttatgttcccca

SEQ ID NO: 15117 - DNA, 20 bp, Artificial Sequence
  sgRNA
  Chl1_11
agtacattgtagaatttgaa

SEQ ID NO: 15118 - DNA, 20 bp, Artificial Sequence
  sgRNA
  Chl1_12
agagtgccgtgtacagcacg

SEQ ID NO: 15119 - DNA, 20 bp, Artificial Sequence
  sgRNA
  Chl1_13
gccagtgacactctattcag

SEQ ID NO: 15120 - DNA, 20 bp, Artificial Sequence
  sgRNA
  Chl1_14
tcataaggagcatagacagt

SEQ ID NO: 15121 - DNA, 20 bp, Artificial Sequence
  sgRNA
  Chl1_15
tggtaccgatcaccttccag

SEQ ID NO: 15122 - DNA, 20 bp, Artificial Sequence
  sgRNA
  Chl1_16
atccacacgctggatcacag

SEQ ID NO: 15123 - DNA, 20 bp, Artificial Sequence
  sgRNA
  Chl1_17
gctggagcctagttgattga

SEQ ID NO: 15124 - DNA, 20 bp, Artificial Sequence
  sgRNA
  Chl1_18
gtcacagctgtaaacgaagt

SEQ ID NO: 15125 - DNA, 20 bp, Artificial Sequence
  sgRNA
  Chl1_19
cgaggatcagaaagatcaaa

SEQ ID NO: 15126 - DNA, 20 bp, Artificial Sequence
  sgRNA
  Chl1_20
actgctccccgtgctgtaca

SEQ ID NO: 15127 - DNA, 20 bp, Artificial Sequence
  sgRNA
  Chodl_1
ctggcttgtgaaagtgaagg

SEQ ID NO: 15128 - DNA, 20 bp, Artificial Sequence
  sgRNA
  Chodl_2
actgccaatcctggcctagg

SEQ ID NO: 15129 - DNA, 20 bp, Artificial Sequence
  sgRNA
  Chodl_3
agtcatagcttaccggaact

SEQ ID NO: 15130 - DNA, 20 bp, Artificial Sequence
  sgRNA
  Chodl_4
cttcagaacctgacaaaacc

SEQ ID NO: 15131 - DNA, 20 bp, Artificial Sequence
  sgRNA
  Chodl_5
gcccgaatcagtctacactg

SEQ ID NO: 15132 - DNA, 20 bp, Artificial Sequence
  sgRNA
  Chodl_6
acactgatgaaccttcttgt

SEQ ID NO: 15133 - DNA, 20 bp, Artificial Sequence
  sgRNA
  Chodl_7
tgtggatttcaaaaagcacg

SEQ ID NO: 15134 - DNA, 20 bp, Artificial Sequence
  sgRNA
  Chodl_8
agtaagagcagcggaatcgt

SEQ ID NO: 15135 - DNA, 20 bp, Artificial Sequence
  sgRNA
  Chodl_9
gaggtccctacctttaccag

SEQ ID NO: 15136 - DNA, 20 bp, Artificial Sequence
  sgRNA
  Chodl_10
aagcggagatggccaaacat

SEQ ID NO: 15137 - DNA, 20 bp, Artificial Sequence
  sgRNA
  Chodl_11
gcaaggcactcagatgataa

SEQ ID NO: 15138 - DNA, 20 bp, Artificial Sequence
  sgRNA
  Chodl_12
cctaggccaggattggcagt

SEQ ID NO: 15139 - DNA, 20 bp, Artificial Sequence
  sgRNA
  Chodl_13
tttaccagtggaatgacgac

SEQ ID NO: 15140 - DNA, 20 bp, Artificial Sequence
  sgRNA
  Chodl_14
gctgcgctgctctgtgccca

SEQ ID NO: 15141 - DNA, 20 bp, Artificial Sequence
  sgRNA
  Chodl_15
acttccatgaactgtctagc

SEQ ID NO: 15142 - DNA, 20 bp, Artificial Sequence
  sgRNA
  Chodl_16
ggctggcttgtgaaagtgaa

SEQ ID NO: 15143 - DNA, 20 bp, Artificial Sequence
  sgRNA
  Chodl_17
gaaacatccctgctacaaaa

SEQ ID NO: 15144 - DNA, 20 bp, Artificial Sequence
  sgRNA
  Chodl_18
ccagggagcctttgcccgaa

SEQ ID NO: 15145 - DNA, 20 bp, Artificial Sequence
  sgRNA
  Chodl_19
tgtcgtcattccactggtaa

SEQ ID NO: 15146 - DNA, 20 bp, Artificial Sequence
  sgRNA
  Chodl_20
gggtgagcttccaggaagca

SEQ ID NO: 15147 - DNA, 20 bp, Artificial Sequence
  sgRNA
  Chpt1_1
ggaggagcaccgctacaccg

SEQ ID NO: 15148 - DNA, 20 bp, Artificial Sequence
  sgRNA
  Chpt1_2
agacgatcactaaagctacc

SEQ ID NO: 15149 - DNA, 20 bp, Artificial Sequence
  sgRNA
  Chpt1_3
gtagaagatgagcactagtg

SEQ ID NO: 15150 - DNA, 20 bp, Artificial Sequence
  sgRNA
  Chpt1_4
agtcactggatgccattgat

SEQ ID NO: 15151 - DNA, 20 bp, Artificial Sequence
  sgRNA
  Chpt1_5
cctagcgcctttacccagcg

SEQ ID NO: 15152 - DNA, 20 bp, Artificial Sequence
  sgRNA
  Chpt1_6
gaacagcgactctcccaccg

SEQ ID NO: 15153 - DNA, 20 bp, Artificial Sequence
  sgRNA
  Chpt1_7
ctactgccctacagtcacgg

SEQ ID NO: 15154 - DNA, 20 bp, Artificial Sequence
  sgRNA
  Chpt1_8
ggagctgatttaaagttccg

SEQ ID NO: 15155 - DNA, 20 bp, Artificial Sequence
  sgRNA
  Chpt1_9
cattcttgccaacaccacca

SEQ ID NO: 15156 - DNA, 20 bp, Artificial Sequence
  sgRNA
  Chpt1_10
ccacctacaactccaagaac

SEQ ID NO: 15157 - DNA, 20 bp, Artificial Sequence
  sgRNA
  Chpt1_11
tgatcaaatagttcccctaa

SEQ ID NO: 15158 - DNA, 20 bp, Artificial Sequence
  sgRNA
  Chpt1_12
ggagcaccgctacaccgcgg

SEQ ID NO: 15159 - DNA, 20 bp, Artificial Sequence
  sgRNA
  Chpt1_13
tctggcttgtttcccatcaa

SEQ ID NO: 15160 - DNA, 20 bp, Artificial Sequence
  sgRNA
  Chpt1_14
tgttcctaggcgaacagcaa

SEQ ID NO: 15161 - DNA, 20 bp, Artificial Sequence
  sgRNA
  Chpt1_15
ttgtcacctggactccacat

SEQ ID NO: 15162 - DNA, 20 bp, Artificial Sequence
  sgRNA
  Chpt1_16
actctcccaccgcggtgtag

SEQ ID NO: 15163 - DNA, 20 bp, Artificial Sequence
  sgRNA
  Chpt1_17
gttgatggcgaggccgatga

SEQ ID NO: 15164 - DNA, 20 bp, Artificial Sequence
  sgRNA
  Chpt1_18
caggtccagtaaagctgcag

SEQ ID NO: 15165 - DNA, 20 bp, Artificial Sequence
  sgRNA
  Chpt1_19
ctggtagataaagagtccca

SEQ ID NO: 15166 - DNA, 20 bp, Artificial Sequence
  sgRNA
  Chpt1_20
ttgatgggaaacaagccaga

SEQ ID NO: 15167 - DNA, 20 bp, Artificial Sequence
  sgRNA
  Chrm1_1
cttctggcaatacctagttg

SEQ ID NO: 15168 - DNA, 20 bp, Artificial Sequence
  sgRNA
  Chrm1_2
gtcgggtcactgagaagtaa

SEQ ID NO: 15169 - DNA, 20 bp, Artificial Sequence
  sgRNA
  Chrm1_3
gctgtactggcgcatctacc

SEQ ID NO: 15170 - DNA, 20 bp, Artificial Sequence
  sgRNA
  Chrm1_4
tataccacatacctgctcat

SEQ ID NO: 15171 - DNA, 20 bp, Artificial Sequence
  sgRNA
  Chrm1_5
agccaagcgcactccccgca

SEQ ID NO: 15172 - DNA, 20 bp, Artificial Sequence
  sgRNA
  Chrm1_6
gcgtacacatgactgtgaca

SEQ ID NO: 15173 - DNA, 20 bp, Artificial Sequence
  sgRNA
  Chrm1_7
gctccccaaatacagtcaag

SEQ ID NO: 15174 - DNA, 20 bp, Artificial Sequence
  sgRNA
  Chrm1_8
gctgtgccaaaagtgatgat

SEQ ID NO: 15175 - DNA, 20 bp, Artificial Sequence
  sgRNA
  Chrm1_9
gctggtgtctacattctgca

SEQ ID NO: 15176 - DNA, 20 bp, Artificial Sequence
  sgRNA
  Chrm1_10
gccagttgttccttccctcg

SEQ ID NO: 15177 - DNA, 20 bp, Artificial Sequence
  sgRNA
  Chrm1_11
ctctgatgattggcctcgcg

SEQ ID NO: 15178 - DNA, 20 bp, Artificial Sequence
  sgRNA
  Chrm1_12
ggcaaaggccaaaaaccccg

SEQ ID NO: 15179 - DNA, 20 bp, Artificial Sequence
  sgRNA
  Chrm1_13
gccaggctcctcaccttcag

SEQ ID NO: 15180 - DNA, 20 bp, Artificial Sequence
  sgRNA
  Chrm1_14
accaagaaaggccgagaccg

SEQ ID NO: 15181 - DNA, 20 bp, Artificial Sequence
  sgRNA
  Chrm1_15
tgtgcctcaggatctaccat

SEQ ID NO: 15182 - DNA, 20 bp, Artificial Sequence
  sgRNA
  Chrm1_16
gcattcatcgggatcaccac

SEQ ID NO: 15183 - DNA, 20 bp, Artificial Sequence
  sgRNA
  Chrm1_17
cgaaggaaaccaaccacgcg

SEQ ID NO: 15184 - DNA, 20 bp, Artificial Sequence
  sgRNA
  Chrm1_18
gagacaccaggcaaaggtgg

SEQ ID NO: 15185 - DNA, 20 bp, Artificial Sequence
  sgRNA
  Chrm1_19
ggcaatacctagttggggag

SEQ ID NO: 15186 - DNA, 20 bp, Artificial Sequence
  sgRNA
  Chrm1_20
gagtccctcacatcctctga

SEQ ID NO: 15187 - DNA, 20 bp, Artificial Sequence
  sgRNA
  Chrm2_1
gatgagaagattcataacgg

SEQ ID NO: 15188 - DNA, 20 bp, Artificial Sequence
  sgRNA
  Chrm2_2
gtgtctccgagtctagtgca

SEQ ID NO: 15189 - DNA, 20 bp, Artificial Sequence
  sgRNA
  Chrm2_3
aagcggaccacaaaaatggc

SEQ ID NO: 15190 - DNA, 20 bp, Artificial Sequence
  sgRNA
  Chrm2_4
cttctggcagttcatcgtag

SEQ ID NO: 15191 - DNA, 20 bp, Artificial Sequence
  sgRNA
  Chrm2_5
gtagaactagtgggatcgtc

SEQ ID NO: 15192 - DNA, 20 bp, Artificial Sequence
  sgRNA
  Chrm2_6
agttaagcggaccacaaaaa

SEQ ID NO: 15193 - DNA, 20 bp, Artificial Sequence
  sgRNA
  Chrm2_7
agtaccacagtagaactagt

SEQ ID NO: 15194 - DNA, 20 bp, Artificial Sequence
  sgRNA
  Chrm2_8
gagagatgatgagataaccc

SEQ ID NO: 15195 - DNA, 20 bp, Artificial Sequence
  sgRNA
  Chrm2_9
tgttgacagtctgaaggtgg

SEQ ID NO: 15196 - DNA, 20 bp, Artificial Sequence
  sgRNA
  Chrm2_10
gcatgatgattgcagctgcg

SEQ ID NO: 15197 - DNA, 20 bp, Artificial Sequence
  sgRNA
  Chrm2_11
tgttggctttcatcatcacg

SEQ ID NO: 15198 - DNA, 20 bp, Artificial Sequence
  sgRNA
  Chrm2_12
gctctattggcacatatccc

SEQ ID NO: 15199 - DNA, 20 bp, Artificial Sequence
  sgRNA
  Chrm2_13
cgatcccactagttctactg

SEQ ID NO: 15200 - DNA, 20 bp, Artificial Sequence
  sgRNA
  Chrm2_14
gtagccaatcacagtgtaga

SEQ ID NO: 15201 - DNA, 20 bp, Artificial Sequence
  sgRNA
  Chrm2_15
aatgatggtcaccagactga

SEQ ID NO: 15202 - DNA, 20 bp, Artificial Sequence
  sgRNA
  Chrm2_16
gcactagactcggagacacc

SEQ ID NO: 15203 - DNA, 20 bp, Artificial Sequence
  sgRNA
  Chrm2_17
tccagaatggcaaggctccg

SEQ ID NO: 15204 - DNA, 20 bp, Artificial Sequence
  sgRNA
  Chrm2_18
agcacagtcatgatgatgac

SEQ ID NO: 15205 - DNA, 20 bp, Artificial Sequence
  sgRNA
  Chrm2_19
gataacccaggatgaaaaca

SEQ ID NO: 15206 - DNA, 20 bp, Artificial Sequence
  sgRNA
  Chrm2_20
acgtgatgatgaaagccaac

SEQ ID NO: 15207 - DNA, 20 bp, Artificial Sequence
  sgRNA
  Chrm3_1
ctgcgcagatctgatcatcg

SEQ ID NO: 15208 - DNA, 20 bp, Artificial Sequence
  sgRNA
  Chrm3_2
tgaatgaaacattctccggg

SEQ ID NO: 15209 - DNA, 20 bp, Artificial Sequence
  sgRNA
  Chrm3_3
tcatctaggaggaagtatgg

SEQ ID NO: 15210 - DNA, 20 bp, Artificial Sequence
  sgRNA
  Chrm3_4
agccagaccaatcatcacac

SEQ ID NO: 15211 - DNA, 20 bp, Artificial Sequence
  sgRNA
  Chrm3_5
gcacgaaacggtcatctagg

SEQ ID NO: 15212 - DNA, 20 bp, Artificial Sequence
  sgRNA
  Chrm3_6
aattgagagactgtccccaa

SEQ ID NO: 15213 - DNA, 20 bp, Artificial Sequence
  sgRNA
  Chrm3_7
gcctgcgcagatctgatcat

SEQ ID NO: 15214 - DNA, 20 bp, Artificial Sequence
  sgRNA
  Chrm3_8
tcttatgccagtgtgacaag

SEQ ID NO: 15215 - DNA, 20 bp, Artificial Sequence
  sgRNA
  Chrm3_9
gctgcatacccaaaacctat

SEQ ID NO: 15216 - DNA, 20 bp, Artificial Sequence
  sgRNA
  Chrm3_10
ccagtagcccagattccaat

SEQ ID NO: 15217 - DNA, 20 bp, Artificial Sequence
  sgRNA
  Chrm3_11
gatggcactgagtgtctggg

SEQ ID NO: 15218 - DNA, 20 bp, Artificial Sequence
  sgRNA
  Chrm3_12
tgaccgtgacaactgtcaga

SEQ ID NO: 15219 - DNA, 20 bp, Artificial Sequence
  sgRNA
  Chrm3_13
gcccaccatcaccttcggca

SEQ ID NO: 15220 - DNA, 20 bp, Artificial Sequence
  sgRNA
  Chrm3_14
tctggttcacaactaagagc

SEQ ID NO: 15221 - DNA, 20 bp, Artificial Sequence
  sgRNA
  Chrm3_15
atttgaggagaaattcccag

SEQ ID NO: 15222 - DNA, 20 bp, Artificial Sequence
  sgRNA
  Chrm3_16
gccgtgccgaaggtgatggt

SEQ ID NO: 15223 - DNA, 20 bp, Artificial Sequence
  sgRNA
  Chrm3_17
actgaatgaaacattctccg

SEQ ID NO: 15224 - DNA, 20 bp, Artificial Sequence
  sgRNA
  Chrm3_18
gcataagagaagcatcttga

SEQ ID NO: 15225 - DNA, 20 bp, Artificial Sequence
  sgRNA
  Chrm3_19
gtggcttctttgaaggacag

SEQ ID NO: 15226 - DNA, 20 bp, Artificial Sequence
  sgRNA
  Chrm3_20
tgttctggcaatactttgta

SEQ ID NO: 15227 - DNA, 20 bp, Artificial Sequence
  sgRNA
  Chrm4_1
ccagttcttgtccaacccgg

SEQ ID NO: 15228 - DNA, 20 bp, Artificial Sequence
  sgRNA
  Chrm4_2
cattaagaaacctccaccag

SEQ ID NO: 15229 - DNA, 20 bp, Artificial Sequence
  sgRNA
  Chrm4_3
tgttcacaagcatcgacccg

SEQ ID NO: 15230 - DNA, 20 bp, Artificial Sequence
  sgRNA
  Chrm4_4
ggcctgccatcttagtagtg

SEQ ID NO: 15231 - DNA, 20 bp, Artificial Sequence
  sgRNA
  Chrm4_5
gcattaagaaacctccacca

SEQ ID NO: 15232 - DNA, 20 bp, Artificial Sequence
  sgRNA
  Chrm4_6
ggtggaggtttcttaatgct

SEQ ID NO: 15233 - DNA, 20 bp, Artificial Sequence
  sgRNA
  Chrm4_7
gttcacaagcatcgacccga

SEQ ID NO: 15234 - DNA, 20 bp, Artificial Sequence
  sgRNA
  Chrm4_8
gcgtgtgcagatctcatcat

SEQ ID NO: 15235 - DNA, 20 bp, Artificial Sequence
  sgRNA
  Chrm4_9
tcacagaccacggcacccag

SEQ ID NO: 15236 - DNA, 20 bp, Artificial Sequence
  sgRNA
  Chrm4_10
gcacagcaaaaggtgccgga

SEQ ID NO: 15237 - DNA, 20 bp, Artificial Sequence
  sgRNA
  Chrm4_11
gcttggtgacgcagaaatag

SEQ ID NO: 15238 - DNA, 20 bp, Artificial Sequence
  sgRNA
  Chrm4_12
gtagcagagccagtagccga

SEQ ID NO: 15239 - DNA, 20 bp, Artificial Sequence
  sgRNA
  Chrm4_13
ctgtgccgaaggtcaccgcc

SEQ ID NO: 15240 - DNA, 20 bp, Artificial Sequence
  sgRNA
  Chrm4_14
ctgccatcttagtagtgcgg

SEQ ID NO: 15241 - DNA, 20 bp, Artificial Sequence
  sgRNA
  Chrm4_15
attgctcaccacatagtcca

SEQ ID NO: 15242 - DNA, 20 bp, Artificial Sequence
  sgRNA
  Chrm4_16
gccagagctgtatccccgaa

SEQ ID NO: 15243 - DNA, 20 bp, Artificial Sequence
  sgRNA
  Chrm4_17
gttgagggttcgtggctgca

SEQ ID NO: 15244 - DNA, 20 bp, Artificial Sequence
  sgRNA
  Chrm4_18
gatgagaaggttcatgacag

SEQ ID NO: 15245 - DNA, 20 bp, Artificial Sequence
  sgRNA
  Chrm4_19
tcctctcgagaagcgccccc

SEQ ID NO: 15246 - DNA, 20 bp, Artificial Sequence
  sgRNA
  Chrm4_20
gcatcgacccgagggcccca

SEQ ID NO: 15247 - DNA, 20 bp, Artificial Sequence
  sgRNA
  Chrm5_1
cgagaacccagcgtcccatg

SEQ ID NO: 15248 - DNA, 20 bp, Artificial Sequence
  sgRNA
  Chrm5_2
gcagtagagtatggtcatga

SEQ ID NO: 15249 - DNA, 20 bp, Artificial Sequence
  sgRNA
  Chrm5_3
tggatctggcactcatcagg

SEQ ID NO: 15250 - DNA, 20 bp, Artificial Sequence
  sgRNA
  Chrm5_4
tgttgaggtgcttctacggg

SEQ ID NO: 15251 - DNA, 20 bp, Artificial Sequence
  sgRNA
  Chrm5_5
tgttgcctataagttccgat

SEQ ID NO: 15252 - DNA, 20 bp, Artificial Sequence
  sgRNA
  Chrm5_6
agccaagcgtaccccaaaga

SEQ ID NO: 15253 - DNA, 20 bp, Artificial Sequence
  sgRNA
  Chrm5_7
gcatcatgatcggcttggca

SEQ ID NO: 15254 - DNA, 20 bp, Artificial Sequence
  sgRNA
  Chrm5_8
cgaccaagtactgccagcag

SEQ ID NO: 15255 - DNA, 20 bp, Artificial Sequence
  sgRNA
  Chrm5_9
ggtcatcagactgaccacag

SEQ ID NO: 15256 - DNA, 20 bp, Artificial Sequence
  sgRNA
  Chrm5_10
ccgtagaagcacctcaacaa

SEQ ID NO: 15257 - DNA, 20 bp, Artificial Sequence
  sgRNA
  Chrm5_11
ccagtaacccaagtgccaca

SEQ ID NO: 15258 - DNA, 20 bp, Artificial Sequence
  sgRNA
  Chrm5_12
gaatggtcctagtcaaagag

SEQ ID NO: 15259 - DNA, 20 bp, Artificial Sequence
  sgRNA
  Chrm5_13
tcatgaccatactctactgc

SEQ ID NO: 15260 - DNA, 20 bp, Artificial Sequence
  sgRNA
  Chrm5_14
gatcaaagctaatcaccaga

SEQ ID NO: 15261 - DNA, 20 bp, Artificial Sequence
  sgRNA
  Chrm5_15
gggacccaggagacaaacaa

SEQ ID NO: 15262 - DNA, 20 bp, Artificial Sequence
  sgRNA
  Chrm5_16
gtatgtcagtggtcttgtga

SEQ ID NO: 15263 - DNA, 20 bp, Artificial Sequence
  sgRNA
  Chrm5_17
gtagatccggcagtagagta

SEQ ID NO: 15264 - DNA, 20 bp, Artificial Sequence
  sgRNA
  Chrm5_18
cgtagaagcacctcaacaac

SEQ ID NO: 15265 - DNA, 20 bp, Artificial Sequence
  sgRNA
  Chrm5_19
tctacgggaggatgaccagg

SEQ ID NO: 15266 - DNA, 20 bp, Artificial Sequence
  sgRNA
  Chrm5_20
gctggtctccttcatcctct

SEQ ID NO: 15267 - DNA, 20 bp, Artificial Sequence
  sgRNA
  Chrna1_1
tgacttgtacaatctcacgg

SEQ ID NO: 15268 - DNA, 20 bp, Artificial Sequence
  sgRNA
  Chrna1_2
aaggtgctcctggactacac

SEQ ID NO: 15269 - DNA, 20 bp, Artificial Sequence
  sgRNA
  Chrna1_3
aacatatacttcccgatcag

SEQ ID NO: 15270 - DNA, 20 bp, Artificial Sequence
  sgRNA
  Chrna1_4
gagtaacttcatggagagcg

SEQ ID NO: 15271 - DNA, 20 bp, Artificial Sequence
  sgRNA
  Chrna1_5
tgagattgtacaagtcaccg

SEQ ID NO: 15272 - DNA, 20 bp, Artificial Sequence
  sgRNA
  Chrna1_6
gaaaaaaattcacatcccct

SEQ ID NO: 15273 - DNA, 20 bp, Artificial Sequence
  sgRNA
  Chrna1_7
gcacccacatcatgcccgag

SEQ ID NO: 15274 - DNA, 20 bp, Artificial Sequence
  sgRNA
  Chrna1_8
acaccagcataaagactccg

SEQ ID NO: 15275 - DNA, 20 bp, Artificial Sequence
  sgRNA
  Chrna1_9
gcgctgcatgacgaagtggt

SEQ ID NO: 15276 - DNA, 20 bp, Artificial Sequence
  sgRNA
  Chrna1_10
ttagctccacaatgaccaga

SEQ ID NO: 15277 - DNA, 20 bp, Artificial Sequence
  sgRNA
  Chrna1_11
gagattgtacaagtcaccgt

SEQ ID NO: 15278 - DNA, 20 bp, Artificial Sequence
  sgRNA
  Chrna1_12
ctggatcagctgtagaccca

SEQ ID NO: 15279 - DNA, 20 bp, Artificial Sequence
  sgRNA
  Chrna1_13
ggacgcaatgacaaagacca

SEQ ID NO: 15280 - DNA, 20 bp, Artificial Sequence
  sgRNA
  Chrna1_14
gagtgaaagcccataggtgg

SEQ ID NO: 15281 - DNA, 20 bp, Artificial Sequence
  sgRNA
  Chrna1_15
cgaacatgagacgcgtctgg

SEQ ID NO: 15282 - DNA, 20 bp, Artificial Sequence
  sgRNA
  Chrna1_16
gaggtgaaaagcgccatcga

SEQ ID NO: 15283 - DNA, 20 bp, Artificial Sequence
  sgRNA
  Chrna1_17
ggtgtagtccaggagcacct

SEQ ID NO: 15284 - DNA, 20 bp, Artificial Sequence
  sgRNA
  Chrna1_18
tgtgggtgctgggcgaacgg

SEQ ID NO: 15285 - DNA, 20 bp, Artificial Sequence
  sgRNA
  Chrna1_19
gggcaggtagaacaccaggc

SEQ ID NO: 15286 - DNA, 20 bp, Artificial Sequence
  sgRNA
  Chrna1_20
agtgggtgatcaaggaagct

SEQ ID NO: 15287 - DNA, 20 bp, Artificial Sequence
  sgRNA
  Chrna10_1
accttcggctcatggacgca

SEQ ID NO: 15288 - DNA, 20 bp, Artificial Sequence
  sgRNA
  Chrna10_2
gcagagtgaaggtcacgtct

SEQ ID NO: 15289 - DNA, 20 bp, Artificial Sequence
  sgRNA
  Chrna10_3
ccacctgcccgctgactccg

SEQ ID NO: 15290 - DNA, 20 bp, Artificial Sequence
  sgRNA
  Chrna10_4
agtggaacgctctctgcagg

SEQ ID NO: 15291 - DNA, 20 bp, Artificial Sequence
  sgRNA
  Chrna10_5
agactggcggaagtgccccg

SEQ ID NO: 15292 - DNA, 20 bp, Artificial Sequence
  sgRNA
  Chrna10_6
cacgaagtcggccagactgg

SEQ ID NO: 15293 - DNA, 20 bp, Artificial Sequence
  sgRNA
  Chrna10_7
gcagagagcgttccactcat

SEQ ID NO: 15294 - DNA, 20 bp, Artificial Sequence
  sgRNA
  Chrna10_8
aattgcatccaagtcaccgt

SEQ ID NO: 15295 - DNA, 20 bp, Artificial Sequence
  sgRNA
  Chrna10_9
acacataggcagctgcacgg

SEQ ID NO: 15296 - DNA, 20 bp, Artificial Sequence
  sgRNA
  Chrna10_10
aatggcttggactgtccaca

SEQ ID NO: 15297 - DNA, 20 bp, Artificial Sequence
  sgRNA
  Chrna10_11
aacgtggttgtgcggcacga

SEQ ID NO: 15298 - DNA, 20 bp, Artificial Sequence
  sgRNA
  Chrna10_12
tttggggtcccaatgtaggt

SEQ ID NO: 15299 - DNA, 20 bp, Artificial Sequence
  sgRNA
  Chrna10_13
tgcctcggccagcaccaacg

SEQ ID NO: 15300 - DNA, 20 bp, Artificial Sequence
  sgRNA
  Chrna10_14
cttgtacctgtggatccggc

SEQ ID NO: 15301 - DNA, 20 bp, Artificial Sequence
  sgRNA
  Chrna10_15
gatgcagaagggcttcttgg

SEQ ID NO: 15302 - DNA, 20 bp, Artificial Sequence
  sgRNA
  Chrna10_16
ttcggctcatggacgcacgg

SEQ ID NO: 15303 - DNA, 20 bp, Artificial Sequence
  sgRNA
  Chrna10_17
cctgtgtgtgcgggaacgag

SEQ ID NO: 15304 - DNA, 20 bp, Artificial Sequence
  sgRNA
  Chrna10_18
aggcgtctgtccactcctgc

SEQ ID NO: 15305 - DNA, 20 bp, Artificial Sequence
  sgRNA
  Chrna10_19
gtcgtgccgcacaaccacgt

SEQ ID NO: 15306 - DNA, 20 bp, Artificial Sequence
  sgRNA
  Chrna10_20
gcacacacaggcctttggct

SEQ ID NO: 15307 - DNA, 20 bp, Artificial Sequence
  sgRNA
  Chrna2_1
cctactacttcgttatccgc

SEQ ID NO: 15308 - DNA, 20 bp, Artificial Sequence
  sgRNA
  Chrna2_2
tggctcctggacatacgaca

SEQ ID NO: 15309 - DNA, 20 bp, Artificial Sequence
  sgRNA
  Chrna2_3
agtgcccaacacttccgatg

SEQ ID NO: 15310 - DNA, 20 bp, Artificial Sequence
  sgRNA
  Chrna2_4
tgtgcgtgctaggggaacgg

SEQ ID NO: 15311 - DNA, 20 bp, Artificial Sequence
  sgRNA
  Chrna2_5
tcactggtcatcccactcat

SEQ ID NO: 15312 - DNA, 20 bp, Artificial Sequence
  sgRNA
  Chrna2_6
gggcaagtagaacacgagca

SEQ ID NO: 15313 - DNA, 20 bp, Artificial Sequence
  sgRNA
  Chrna2_7
aaagcgcacgatgaccacat

SEQ ID NO: 15314 - DNA, 20 bp, Artificial Sequence
  sgRNA
  Chrna2_8
tgatgttgccaaactcagcc

SEQ ID NO: 15315 - DNA, 20 bp, Artificial Sequence
  sgRNA
  Chrna2_9
gatgtggtcatcgtgcgctt

SEQ ID NO: 15316 - DNA, 20 bp, Artificial Sequence
  sgRNA
  Chrna2_10
agtgcccgtgaagaagaggt

SEQ ID NO: 15317 - DNA, 20 bp, Artificial Sequence
  sgRNA
  Chrna2_11
caagaagtacgactgctgcg

SEQ ID NO: 15318 - DNA, 20 bp, Artificial Sequence
  sgRNA
  Chrna2_12
agctcagccccacttatcat

SEQ ID NO: 15319 - DNA, 20 bp, Artificial Sequence
  sgRNA
  Chrna2_13
tctgtatttgaggtgacagc

SEQ ID NO: 15320 - DNA, 20 bp, Artificial Sequence
  sgRNA
  Chrna2_14
aggctcgcacacccatgccg

SEQ ID NO: 15321 - DNA, 20 bp, Artificial Sequence
  sgRNA
  Chrna2_15
tgagcaggcacgggataatg

SEQ ID NO: 15322 - DNA, 20 bp, Artificial Sequence
  sgRNA
  Chrna2_16
cgattcatcatcagccaccg

SEQ ID NO: 15323 - DNA, 20 bp, Artificial Sequence
  sgRNA
  Chrna2_17
cctggagcagatggagcgga

SEQ ID NO: 15324 - DNA, 20 bp, Artificial Sequence
  sgRNA
  Chrna2_18
agatcatctctgaggggacg

SEQ ID NO: 15325 - DNA, 20 bp, Artificial Sequence
  sgRNA
  Chrna2_19
gcacagtgcccgtgaagaag

SEQ ID NO: 15326 - DNA, 20 bp, Artificial Sequence
  sgRNA
  Chrna2_20
agacgataatgaacagccag

SEQ ID NO: 15327 - DNA, 20 bp, Artificial Sequence
  sgRNA
  Chrna3_1
aaagctctactcaagtacac

SEQ ID NO: 15328 - DNA, 20 bp, Artificial Sequence
  sgRNA
  Chrna3_2
caacgagatcatccggccgg

SEQ ID NO: 15329 - DNA, 20 bp, Artificial Sequence
  sgRNA
  Chrna3_3
gatttcatgtttgtagcccg

SEQ ID NO: 15330 - DNA, 20 bp, Artificial Sequence
  sgRNA
  Chrna3_4
tccaccccttggtagtcaga

SEQ ID NO: 15331 - DNA, 20 bp, Artificial Sequence
  sgRNA
  Chrna3_5
gactaggccaaccagcaccg

SEQ ID NO: 15332 - DNA, 20 bp, Artificial Sequence
  sgRNA
  Chrna3_6
aggaagacgccccaaagacg

SEQ ID NO: 15333 - DNA, 20 bp, Artificial Sequence
  sgRNA
  Chrna3_7
ttacaacgagatcatccggc

SEQ ID NO: 15334 - DNA, 20 bp, Artificial Sequence
  sgRNA
  Chrna3_8
gaaaccctctgactaccaag

SEQ ID NO: 15335 - DNA, 20 bp, Artificial Sequence
  sgRNA
  Chrna3_9
agctcttaaagatggccgga

SEQ ID NO: 15336 - DNA, 20 bp, Artificial Sequence
  sgRNA
  Chrna3_10
tggctattgccaccaccgta

SEQ ID NO: 15337 - DNA, 20 bp, Artificial Sequence
  sgRNA
  Chrna3_11
ggatgggacacgttagccac

SEQ ID NO: 15338 - DNA, 20 bp, Artificial Sequence
  sgRNA
  Chrna3_12
ggaaaccctctgactaccaa

SEQ ID NO: 15339 - DNA, 20 bp, Artificial Sequence
  sgRNA
  Chrna3_13
agcatcagcatggacagcgg

SEQ ID NO: 15340 - DNA, 20 bp, Artificial Sequence
  sgRNA
  Chrna3_14
tcacgaggagaaagaccgtc

SEQ ID NO: 15341 - DNA, 20 bp, Artificial Sequence
  sgRNA
  Chrna3_15
aatcaagtacaactgctgtg

SEQ ID NO: 15342 - DNA, 20 bp, Artificial Sequence
  sgRNA
  Chrna3_16
gagacatagacacctcaaac

SEQ ID NO: 15343 - DNA, 20 bp, Artificial Sequence
  sgRNA
  Chrna3_17
actggtcatccccttgatcg

SEQ ID NO: 15344 - DNA, 20 bp, Artificial Sequence
  sgRNA
  Chrna3_18
tctcgttgtaatcttcaaac

SEQ ID NO: 15345 - DNA, 20 bp, Artificial Sequence
  sgRNA
  Chrna3_19
aggaggtactccccgatcaa

SEQ ID NO: 15346 - DNA, 20 bp, Artificial Sequence
  sgRNA
  Chrna3_20
ctcgcatgaactccacccct

SEQ ID NO: 15347 - DNA, 20 bp, Artificial Sequence
  sgRNA
  Chrna4_1
tgacattctcgtagtcacca

SEQ ID NO: 15348 - DNA, 20 bp, Artificial Sequence
  sgRNA
  Chrna4_2
ggtgagcatgcacagccgtg

SEQ ID NO: 15349 - DNA, 20 bp, Artificial Sequence
  sgRNA
  Chrna4_3
tcttctctggctacaacaag

SEQ ID NO: 15350 - DNA, 20 bp, Artificial Sequence
  sgRNA
  Chrna4_4
tgtagaacagtggcagtcgg

SEQ ID NO: 15351 - DNA, 20 bp, Artificial Sequence
  sgRNA
  Chrna4_5
ggatactccgagaccggcag

SEQ ID NO: 15352 - DNA, 20 bp, Artificial Sequence
  sgRNA
  Chrna4_6
ggatggacgggtcttcaggg

SEQ ID NO: 15353 - DNA, 20 bp, Artificial Sequence
  sgRNA
  Chrna4_7
gagaacactgtcgaagccat

SEQ ID NO: 15354 - DNA, 20 bp, Artificial Sequence
  sgRNA
  Chrna4_8
agaagtccagttggtccaca

SEQ ID NO: 15355 - DNA, 20 bp, Artificial Sequence
  sgRNA
  Chrna4_9
gagcaatcgacaagccaaag

SEQ ID NO: 15356 - DNA, 20 bp, Artificial Sequence
  sgRNA
  Chrna4_10
tgtcacccacccaatagcag

SEQ ID NO: 15357 - DNA, 20 bp, Artificial Sequence
  sgRNA
  Chrna4_11
gcatgactacaaactgcgct

SEQ ID NO: 15358 - DNA, 20 bp, Artificial Sequence
  sgRNA
  Chrna4_12
gcctccagatgagttcagat

SEQ ID NO: 15359 - DNA, 20 bp, Artificial Sequence
  sgRNA
  Chrna4_13
agatgatgacgaccaacgtg

SEQ ID NO: 15360 - DNA, 20 bp, Artificial Sequence
  sgRNA
  Chrna4_14
tcattgaccgaatcttcctc

SEQ ID NO: 15361 - DNA, 20 bp, Artificial Sequence
  sgRNA
  Chrna4_15
tctcgactgctgtgtccatg

SEQ ID NO: 15362 - DNA, 20 bp, Artificial Sequence
  sgRNA
  Chrna4_16
gctgcaggagctcttataga

SEQ ID NO: 15363 - DNA, 20 bp, Artificial Sequence
  sgRNA
  Chrna4_17
gaccttctcgccgcactccg

SEQ ID NO: 15364 - DNA, 20 bp, Artificial Sequence
  sgRNA
  Chrna4_18
aagcccacctgttctatgat

SEQ ID NO: 15365 - DNA, 20 bp, Artificial Sequence
  sgRNA
  Chrna4_19
aggctctggccagaaacgag

SEQ ID NO: 15366 - DNA, 20 bp, Artificial Sequence
  sgRNA
  Chrna4_20
agaccgtgatgacaatggag

SEQ ID NO: 15367 - DNA, 20 bp, Artificial Sequence
  sgRNA
  Chrna5_1
ccaggtcgatataatcctag

SEQ ID NO: 15368 - DNA, 20 bp, Artificial Sequence
  sgRNA
  Chrna5_2
gcagggtatgataagaaaca

SEQ ID NO: 15369 - DNA, 20 bp, Artificial Sequence
  sgRNA
  Chrna5_3
tgcagacggacgtttcgaag

SEQ ID NO: 15370 - DNA, 20 bp, Artificial Sequence
  sgRNA
  Chrna5_4
ccactaactgagatattgca

SEQ ID NO: 15371 - DNA, 20 bp, Artificial Sequence
  sgRNA
  Chrna5_5
gtagcgaatgcaatcgagcg

SEQ ID NO: 15372 - DNA, 20 bp, Artificial Sequence
  sgRNA
  Chrna5_6
tcatagcccaagttctcgat

SEQ ID NO: 15373 - DNA, 20 bp, Artificial Sequence
  sgRNA
  Chrna5_7
gaaagagaacgacgtccgcg

SEQ ID NO: 15374 - DNA, 20 bp, Artificial Sequence
  sgRNA
  Chrna5_8
agaaatatcttacgaaccca

SEQ ID NO: 15375 - DNA, 20 bp, Artificial Sequence
  sgRNA
  Chrna5_9
agaaacgagagcccgatgca

SEQ ID NO: 15376 - DNA, 20 bp, Artificial Sequence
  sgRNA
  Chrna5_10
aggcagccgtttgatcacga

SEQ ID NO: 15377 - DNA, 20 bp, Artificial Sequence
  sgRNA
  Chrna5_11
cctactccttcgtgatcaaa

SEQ ID NO: 15378 - DNA, 20 bp, Artificial Sequence
  sgRNA
  Chrna5_12
gcatgagaagtcatgccgat

SEQ ID NO: 15379 - DNA, 20 bp, Artificial Sequence
  sgRNA
  Chrna5_13
ggtacaatggcactgtcact

SEQ ID NO: 15380 - DNA, 20 bp, Artificial Sequence
  sgRNA
  Chrna5_14
gcagctgcaccatcaagagc

SEQ ID NO: 15381 - DNA, 20 bp, Artificial Sequence
  sgRNA
  Chrna5_15
gggaaatcatgagcgcaatg

SEQ ID NO: 15382 - DNA, 20 bp, Artificial Sequence
  sgRNA
  Chrna5_16
aagacggtggacctaaatct

SEQ ID NO: 15383 - DNA, 20 bp, Artificial Sequence
  sgRNA
  Chrna5_17
accaagtactccccgatcag

SEQ ID NO: 15384 - DNA, 20 bp, Artificial Sequence
  sgRNA
  Chrna5_18
ggtatgactttggaagatga

SEQ ID NO: 15385 - DNA, 20 bp, Artificial Sequence
  sgRNA
  Chrna5_19
ggggagcaaggggaaccgga

SEQ ID NO: 15386 - DNA, 20 bp, Artificial Sequence
  sgRNA
  Chrna5_20
tttgcagcagaggatagctc

SEQ ID NO: 15387 - DNA, 20 bp, Artificial Sequence
  sgRNA
  Chrna6_1
aggttgatggtgtaaaacat

SEQ ID NO: 15388 - DNA, 20 bp, Artificial Sequence
  sgRNA
  Chrna6_2
gtagatactcacccaccagt

SEQ ID NO: 15389 - DNA, 20 bp, Artificial Sequence
  sgRNA
  Chrna6_3
gaatgtctccgatcccgtca

SEQ ID NO: 15390 - DNA, 20 bp, Artificial Sequence
  sgRNA
  Chrna6_4
gatgtcatgcttatagccag

SEQ ID NO: 15391 - DNA, 20 bp, Artificial Sequence
  sgRNA
  Chrna6_5
ctacaaccgcttcatccggc

SEQ ID NO: 15392 - DNA, 20 bp, Artificial Sequence
  sgRNA
  Chrna6_6
ggtaaaaaaccagcaccgtg

SEQ ID NO: 15393 - DNA, 20 bp, Artificial Sequence
  sgRNA
  Chrna6_7
agacaattataaatacccaa

SEQ ID NO: 15394 - DNA, 20 bp, Artificial Sequence
  sgRNA
  Chrna6_8
actttctcgccacagtcgga

SEQ ID NO: 15395 - DNA, 20 bp, Artificial Sequence
  sgRNA
  Chrna6_9
cctactccttctacatcagg

SEQ ID NO: 15396 - DNA, 20 bp, Artificial Sequence
  sgRNA
  Chrna6_10
ctttaagagctcctgcccaa

SEQ ID NO: 15397 - DNA, 20 bp, Artificial Sequence
  sgRNA
  Chrna6_11
ggaaggactacagattgcgt

SEQ ID NO: 15398 - DNA, 20 bp, Artificial Sequence
  sgRNA
  Chrna6_12
cagattgcgttgggatccaa

SEQ ID NO: 15399 - DNA, 20 bp, Artificial Sequence
  sgRNA
  Chrna6_13
gaaggactacagattgcgtt

SEQ ID NO: 15400 - DNA, 20 bp, Artificial Sequence
  sgRNA
  Chrna6_14
gagccacaatgaaacaaacg

SEQ ID NO: 15401 - DNA, 20 bp, Artificial Sequence
  sgRNA
  Chrna6_15
acagacataaaccggagtgc

SEQ ID NO: 15402 - DNA, 20 bp, Artificial Sequence
  sgRNA
  Chrna6_16
ggatcggagacattctccac

SEQ ID NO: 15403 - DNA, 20 bp, Artificial Sequence
  sgRNA
  Chrna6_17
tcgatgagtaaatttgacct

SEQ ID NO: 15404 - DNA, 20 bp, Artificial Sequence
  sgRNA
  Chrna6_18
ctcgatgacatcttcaacat

SEQ ID NO: 15405 - DNA, 20 bp, Artificial Sequence
  sgRNA
  Chrna6_19
gggcatggtatgcgttgctg

SEQ ID NO: 15406 - DNA, 20 bp, Artificial Sequence
  sgRNA
  Chrna6_20
agtccaggaaccaaacttca

SEQ ID NO: 15407 - DNA, 20 bp, Artificial Sequence
  sgRNA
  Chrna7_1
agatgcattcaccaagacgt

SEQ ID NO: 15408 - DNA, 20 bp, Artificial Sequence
  sgRNA
  Chrna7_2
acacagtaaccatgcgccgt

SEQ ID NO: 15409 - DNA, 20 bp, Artificial Sequence
  sgRNA
  Chrna7_3
tggaacatgtctgagtaccc

SEQ ID NO: 15410 - DNA, 20 bp, Artificial Sequence
  sgRNA
  Chrna7_4
aatggagaatgggatctcat

SEQ ID NO: 15411 - DNA, 20 bp, Artificial Sequence
  sgRNA
  Chrna7_5
ggtcaagaactacaacccgc

SEQ ID NO: 15412 - DNA, 20 bp, Artificial Sequence
  sgRNA
  Chrna7_6
ggtcggggtccccatcagag

SEQ ID NO: 15413 - DNA, 20 bp, Artificial Sequence
  sgRNA
  Chrna7_7
cctgctacatcgatgtacgc

SEQ ID NO: 15414 - DNA, 20 bp, Artificial Sequence
  sgRNA
  Chrna7_8
ggccatagtagagtgtccta

SEQ ID NO: 15415 - DNA, 20 bp, Artificial Sequence
  sgRNA
  Chrna7_9
gatcatcgtgggcctctcag

SEQ ID NO: 15416 - DNA, 20 bp, Artificial Sequence
  sgRNA
  Chrna7_10
ggacagatcactatttgcag

SEQ ID NO: 15417 - DNA, 20 bp, Artificial Sequence
  sgRNA
  Chrna7_11
gtagagtgtcctacggcgca

SEQ ID NO: 15418 - DNA, 20 bp, Artificial Sequence
  sgRNA
  Chrna7_12
gccagcaccatgatcatcgt

SEQ ID NO: 15419 - DNA, 20 bp, Artificial Sequence
  sgRNA
  Chrna7_13
ggaagcggttggcgatgtag

SEQ ID NO: 15420 - DNA, 20 bp, Artificial Sequence
  sgRNA
  Chrna7_14
gccagtgtggagctgagcgc

SEQ ID NO: 15421 - DNA, 20 bp, Artificial Sequence
  sgRNA
  Chrna7_15
gtttctgcgcatgaagaggc

SEQ ID NO: 15422 - DNA, 20 bp, Artificial Sequence
  sgRNA
  Chrna7_16
gcacaagcggtccaccacac

SEQ ID NO: 15423 - DNA, 20 bp, Artificial Sequence
  sgRNA
  Chrna7_17
cggcttgtcagcacaagcct

SEQ ID NO: 15424 - DNA, 20 bp, Artificial Sequence
  sgRNA
  Chrna7_18
catgatgagcacctcatgca

SEQ ID NO: 15425 - DNA, 20 bp, Artificial Sequence
  sgRNA
  Chrna7_19
gtgaggtgatctgcagtgag

SEQ ID NO: 15426 - DNA, 20 bp, Artificial Sequence
  sgRNA
  Chrna7_20
cctggccaagatcctggagg

SEQ ID NO: 15427 - DNA, 20 bp, Artificial Sequence
  sgRNA
  Chrna9_1
gcacgatgcgtacctcacgt

SEQ ID NO: 15428 - DNA, 20 bp, Artificial Sequence
  sgRNA
  Chrna9_2
agagccggtgaacaccaacg

SEQ ID NO: 15429 - DNA, 20 bp, Artificial Sequence
  sgRNA
  Chrna9_3
tccagtagaagatacggacg

SEQ ID NO: 15430 - DNA, 20 bp, Artificial Sequence
  sgRNA
  Chrna9_4
gactgtatttcagctaatgg

SEQ ID NO: 15431 - DNA, 20 bp, Artificial Sequence
  sgRNA
  Chrna9_5
ggaacgatatgaggacgcaa

SEQ ID NO: 15432 - DNA, 20 bp, Artificial Sequence
  sgRNA
  Chrna9_6
ggagccagaacaaatcacga

SEQ ID NO: 15433 - DNA, 20 bp, Artificial Sequence
  sgRNA
  Chrna9_7
ttgcactgctggctgtcgaa

SEQ ID NO: 15434 - DNA, 20 bp, Artificial Sequence
  sgRNA
  Chrna9_8
actggtctcgatcccacgtg

SEQ ID NO: 15435 - DNA, 20 bp, Artificial Sequence
  sgRNA
  Chrna9_9
agtttggcggatccacaggt

SEQ ID NO: 15436 - DNA, 20 bp, Artificial Sequence
  sgRNA
  Chrna9_10
aagaatgacctagggtacca

SEQ ID NO: 15437 - DNA, 20 bp, Artificial Sequence
  sgRNA
  Chrna9_11
ccaactccaagggcagcgag

SEQ ID NO: 15438 - DNA, 20 bp, Artificial Sequence
  sgRNA
  Chrna9_12
gcggagcgaggaacgatatg

SEQ ID NO: 15439 - DNA, 20 bp, Artificial Sequence
  sgRNA
  Chrna9_13
gtttctggatgctttcaggt

SEQ ID NO: 15440 - DNA, 20 bp, Artificial Sequence
  sgRNA
  Chrna9_14
ggtagaaactcagcggagcg

SEQ ID NO: 15441 - DNA, 20 bp, Artificial Sequence
  sgRNA
  Chrna9_15
agagaggtcaccactgtcca

SEQ ID NO: 15442 - DNA, 20 bp, Artificial Sequence
  sgRNA
  Chrna9_16
acgcatcgtgccaagtttgg

SEQ ID NO: 15443 - DNA, 20 bp, Artificial Sequence
  sgRNA
  Chrna9_17
aggtttatggcaaacttcca

SEQ ID NO: 15444 - DNA, 20 bp, Artificial Sequence
  sgRNA
  Chrna9_18
catctcctacggctgctgct

SEQ ID NO: 15445 - DNA, 20 bp, Artificial Sequence
  sgRNA
  Chrna9_19
agtagctgtcagtattctgg

SEQ ID NO: 15446 - DNA, 20 bp, Artificial Sequence
  sgRNA
  Chrna9_20
acgtggtcctgcggtacgat

SEQ ID NO: 15447 - DNA, 20 bp, Artificial Sequence
  sgRNA
  Chrnb1_1
ccaactatgatagctcggtg

SEQ ID NO: 15448 - DNA, 20 bp, Artificial Sequence
  sgRNA
  Chrnb1_2
tcttctatctcattattcgg

SEQ ID NO: 15449 - DNA, 20 bp, Artificial Sequence
  sgRNA
  Chrnb1_3
caaggaccatggtaaacatg

SEQ ID NO: 15450 - DNA, 20 bp, Artificial Sequence
  sgRNA
  Chrnb1_4
aggaagtctacattcatgaa

SEQ ID NO: 15451 - DNA, 20 bp, Artificial Sequence
  sgRNA
  Chrnb1_5
gataaatcgtcgcaggtccg

SEQ ID NO: 15452 - DNA, 20 bp, Artificial Sequence
  sgRNA
  Chrnb1_6
gcatcactgctgaatccgtt

SEQ ID NO: 15453 - DNA, 20 bp, Artificial Sequence
  sgRNA
  Chrnb1_7
agtgcctgagacctccctgg

SEQ ID NO: 15454 - DNA, 20 bp, Artificial Sequence
  sgRNA
  Chrnb1_8
gacctgcgacgatttatcga

SEQ ID NO: 15455 - DNA, 20 bp, Artificial Sequence
  sgRNA
  Chrnb1_9
cgatgccatcatgttctgcg

SEQ ID NO: 15456 - DNA, 20 bp, Artificial Sequence
  sgRNA
  Chrnb1_10
acgttgaccaggtagaagag

SEQ ID NO: 15457 - DNA, 20 bp, Artificial Sequence
  sgRNA
  Chrnb1_11
gaacacagtgagcgtcagca

SEQ ID NO: 15458 - DNA, 20 bp, Artificial Sequence
  sgRNA
  Chrnb1_12
atttatcgatggtccaaccc

SEQ ID NO: 15459 - DNA, 20 bp, Artificial Sequence
  sgRNA
  Chrnb1_13
tcttcagacccaggtatgga

SEQ ID NO: 15460 - DNA, 20 bp, Artificial Sequence
  sgRNA
  Chrnb1_14
tgataatgatgggcaccgcc

SEQ ID NO: 15461 - DNA, 20 bp, Artificial Sequence
  sgRNA
  Chrnb1_15
ggcatctaggaaaatgacta

SEQ ID NO: 15462 - DNA, 20 bp, Artificial Sequence
  sgRNA
  Chrnb1_16
gtttgtggataatctcccat

SEQ ID NO: 15463 - DNA, 20 bp, Artificial Sequence
  sgRNA
  Chrnb1_17
tctgaggtcagcctgaagac

SEQ ID NO: 15464 - DNA, 20 bp, Artificial Sequence
  sgRNA
  Chrnb1_18
gaccgcgtcggggtcagcat

SEQ ID NO: 15465 - DNA, 20 bp, Artificial Sequence
  sgRNA
  Chrnb1_19
aatgttgtggtatctttcga

SEQ ID NO: 15466 - DNA, 20 bp, Artificial Sequence
  sgRNA
  Chrnb1_20
tctgcctcaggagctacgag

SEQ ID NO: 15467 - DNA, 20 bp, Artificial Sequence
  sgRNA
  Chrnb2_1
tgtgcgtggtaggcgaacgg

SEQ ID NO: 15468 - DNA, 20 bp, Artificial Sequence
  sgRNA
  Chrnb2_2
cgtctgggttctcgttgcgt

SEQ ID NO: 15469 - DNA, 20 bp, Artificial Sequence
  sgRNA
  Chrnb2_3
tccctcgacgtaccgctggt

SEQ ID NO: 15470 - DNA, 20 bp, Artificial Sequence
  sgRNA
  Chrnb2_4
ggagccagatgtgcttagaa

SEQ ID NO: 15471 - DNA, 20 bp, Artificial Sequence
  sgRNA
  Chrnb2_5
gcgacgaatgatgaagtcgt

SEQ ID NO: 15472 - DNA, 20 bp, Artificial Sequence
  sgRNA
  Chrnb2_6
ggacggtgtacgcttcattg

SEQ ID NO: 15473 - DNA, 20 bp, Artificial Sequence
  sgRNA
  Chrnb2_7
ggggctatagtacaggtcgg

SEQ ID NO: 15474 - DNA, 20 bp, Artificial Sequence
  sgRNA
  Chrnb2_8
gtgaggagacatgcacgcga

SEQ ID NO: 15475 - DNA, 20 bp, Artificial Sequence
  sgRNA
  Chrnb2_9
ggcacactattcttccgcga

SEQ ID NO: 15476 - DNA, 20 bp, Artificial Sequence
  sgRNA
  Chrnb2_10
aggaagaccaccttgaccca

SEQ ID NO: 15477 - DNA, 20 bp, Artificial Sequence
  sgRNA
  Chrnb2_11
tggtgtgcgtggtaggcgaa

SEQ ID NO: 15478 - DNA, 20 bp, Artificial Sequence
  sgRNA
  Chrnb2_12
gcgataatcttcccactcct

SEQ ID NO: 15479 - DNA, 20 bp, Artificial Sequence
  sgRNA
  Chrnb2_13
gctggcgccttcgcaagcgc

SEQ ID NO: 15480 - DNA, 20 bp, Artificial Sequence
  sgRNA
  Chrnb2_14
tgacgtgcacagcggtggcg

SEQ ID NO: 15481 - DNA, 20 bp, Artificial Sequence
  sgRNA
  Chrnb2_15
gtcaatcctgcatcaatgca

SEQ ID NO: 15482 - DNA, 20 bp, Artificial Sequence
  sgRNA
  Chrnb2_16
tgaggagacatgcacgcgag

SEQ ID NO: 15483 - DNA, 20 bp, Artificial Sequence
  sgRNA
  Chrnb2_17
ggtcagctgcaggaccttcg

SEQ ID NO: 15484 - DNA, 20 bp, Artificial Sequence
  sgRNA
  Chrnb2_18
ccatttgccatcaatgccaa

SEQ ID NO: 15485 - DNA, 20 bp, Artificial Sequence
  sgRNA
  Chrnb2_19
gcgaggtgatgagtacgcag

SEQ ID NO: 15486 - DNA, 20 bp, Artificial Sequence
  sgRNA
  Chrnb2_20
gcgggactctgtgctttcca

SEQ ID NO: 15487 - DNA, 20 bp, Artificial Sequence
  sgRNA
  Chrnb3_1
gggagatactaaatgcaaag

SEQ ID NO: 15488 - DNA, 20 bp, Artificial Sequence
  sgRNA
  Chrnb3_2
cactggaattcaacacaggg

SEQ ID NO: 15489 - DNA, 20 bp, Artificial Sequence
  sgRNA
  Chrnb3_3
agctgatgacaacaaacgtg

SEQ ID NO: 15490 - DNA, 20 bp, Artificial Sequence
  sgRNA
  Chrnb3_4
ctggacttacgatggtacca

SEQ ID NO: 15491 - DNA, 20 bp, Artificial Sequence
  sgRNA
  Chrnb3_5
gagcagttctgcttatcgaa

SEQ ID NO: 15492 - DNA, 20 bp, Artificial Sequence
  sgRNA
  Chrnb3_6
ggacagaccaaaaattacga

SEQ ID NO: 15493 - DNA, 20 bp, Artificial Sequence
  sgRNA
  Chrnb3_7
gatcagaatgaggtcgacca

SEQ ID NO: 15494 - DNA, 20 bp, Artificial Sequence
  sgRNA
  Chrnb3_8
tgagagccaagaagacccgt

SEQ ID NO: 15495 - DNA, 20 bp, Artificial Sequence
  sgRNA
  Chrnb3_9
ggaggtactccccaatgaga

SEQ ID NO: 15496 - DNA, 20 bp, Artificial Sequence
  sgRNA
  Chrnb3_10
gctttgcatgaaggacccca

SEQ ID NO: 15497 - DNA, 20 bp, Artificial Sequence
  sgRNA
  Chrnb3_11
agaaacagcctcttcaccca

SEQ ID NO: 15498 - DNA, 20 bp, Artificial Sequence
  sgRNA
  Chrnb3_12
ctacaaaagttcctgtacca

SEQ ID NO: 15499 - DNA, 20 bp, Artificial Sequence
  sgRNA
  Chrnb3_13
ggcaggggattatcaaaaag

SEQ ID NO: 15500 - DNA, 20 bp, Artificial Sequence
  sgRNA
  Chrnb3_14
tctacctaccctccgacgaa

SEQ ID NO: 15501 - DNA, 20 bp, Artificial Sequence
  sgRNA
  Chrnb3_15
ggttccgctggatttcacaa

SEQ ID NO: 15502 - DNA, 20 bp, Artificial Sequence
  sgRNA
  Chrnb3_16
aagctgtcagaaagagccag

SEQ ID NO: 15503 - DNA, 20 bp, Artificial Sequence
  sgRNA
  Chrnb3_17
agtccatcagatacatctcg

SEQ ID NO: 15504 - DNA, 20 bp, Artificial Sequence
  sgRNA
  Chrnb3_18
aatccagcggaaccgtcagt

SEQ ID NO: 15505 - DNA, 20 bp, Artificial Sequence
  sgRNA
  Chrnb3_19
ggaaagagaagcggtccctg

SEQ ID NO: 15506 - DNA, 20 bp, Artificial Sequence
  sgRNA
  Chrnb3_20
tgtcaaagaaaccaaaaccg

SEQ ID NO: 15507 - DNA, 20 bp, Artificial Sequence
  sgRNA
  Chrnb4_1
gttggaacgcacgatcacgt

SEQ ID NO: 15508 - DNA, 20 bp, Artificial Sequence
  sgRNA
  Chrnb4_2
atggatgactttacccccag

SEQ ID NO: 15509 - DNA, 20 bp, Artificial Sequence
  sgRNA
  Chrnb4_3
gcgacgtgatgagcacacaa

SEQ ID NO: 15510 - DNA, 20 bp, Artificial Sequence
  sgRNA
  Chrnb4_4
ggaatggactgactaccgcc

SEQ ID NO: 15511 - DNA, 20 bp, Artificial Sequence
  sgRNA
  Chrnb4_5
aacgtgatcgtgcgttccaa

SEQ ID NO: 15512 - DNA, 20 bp, Artificial Sequence
  sgRNA
  Chrnb4_6
gggacagtgatagctccagg

SEQ ID NO: 15513 - DNA, 20 bp, Artificial Sequence
  sgRNA
  Chrnb4_7
ggtccaggagcgaaatttga

SEQ ID NO: 15514 - DNA, 20 bp, Artificial Sequence
  sgRNA
  Chrnb4_8
tctggaagtcagccccgcca

SEQ ID NO: 15515 - DNA, 20 bp, Artificial Sequence
  sgRNA
  Chrnb4_9
ggactggaaattcgtcgcaa

SEQ ID NO: 15516 - DNA, 20 bp, Artificial Sequence
  sgRNA
  Chrnb4_10
ggaaaaggtgaccagcacca

SEQ ID NO: 15517 - DNA, 20 bp, Artificial Sequence
  sgRNA
  Chrnb4_11
atcttgccggaacctcccag

SEQ ID NO: 15518 - DNA, 20 bp, Artificial Sequence
  sgRNA
  Chrnb4_12
cgaacacccacaggaacagg

SEQ ID NO: 15519 - DNA, 20 bp, Artificial Sequence
  sgRNA
  Chrnb4_13
aggtcacgtccacatagctg

SEQ ID NO: 15520 - DNA, 20 bp, Artificial Sequence
  sgRNA
  Chrnb4_14
cgtcgaccgcctgttcctgt

SEQ ID NO: 15521 - DNA, 20 bp, Artificial Sequence
  sgRNA
  Chrnb4_15
tcactgtccttcgacccggg

SEQ ID NO: 15522 - DNA, 20 bp, Artificial Sequence
  sgRNA
  Chrnb4_16
ggaacagctcctgctatgaa

SEQ ID NO: 15523 - DNA, 20 bp, Artificial Sequence
  sgRNA
  Chrnb4_17
gggttcactgtccttcgacc

SEQ ID NO: 15524 - DNA, 20 bp, Artificial Sequence
  sgRNA
  Chrnb4_18
acaatgtcccattcaccgct

SEQ ID NO: 15525 - DNA, 20 bp, Artificial Sequence
  sgRNA
  Chrnb4_19
gcagcccatccaacctctat

SEQ ID NO: 15526 - DNA, 20 bp, Artificial Sequence
  sgRNA
  Chrnb4_20
gcactcttgtagatggcagg

SEQ ID NO: 15527 - DNA, 20 bp, Artificial Sequence
  sgRNA
  Chrnd_1
tacatgatctatccacacgt

SEQ ID NO: 15528 - DNA, 20 bp, Artificial Sequence
  sgRNA
  Chrnd_2
agggctacgacaaagacctg

SEQ ID NO: 15529 - DNA, 20 bp, Artificial Sequence
  sgRNA
  Chrnd_3
tcgggcagccaagctcaatg

SEQ ID NO: 15530 - DNA, 20 bp, Artificial Sequence
  sgRNA
  Chrnd_4
ggtagccacaccatgtcagg

SEQ ID NO: 15531 - DNA, 20 bp, Artificial Sequence
  sgRNA
  Chrnd_5
tccactcgatggggtaagag

SEQ ID NO: 15532 - DNA, 20 bp, Artificial Sequence
  sgRNA
  Chrnd_6
gctggttgtagacaccctgc

SEQ ID NO: 15533 - DNA, 20 bp, Artificial Sequence
  sgRNA
  Chrnd_7
ggtagacagccgtctacagt

SEQ ID NO: 15534 - DNA, 20 bp, Artificial Sequence
  sgRNA
  Chrnd_8
catgtgcaggagcttgggca

SEQ ID NO: 15535 - DNA, 20 bp, Artificial Sequence
  sgRNA
  Chrnd_9
agaccctcaccaccaacgtg

SEQ ID NO: 15536 - DNA, 20 bp, Artificial Sequence
  sgRNA
  Chrnd_10
tcctgctgcttatctccaag

SEQ ID NO: 15537 - DNA, 20 bp, Artificial Sequence
  sgRNA
  Chrnd_11
atgaaggagatgagcacgca

SEQ ID NO: 15538 - DNA, 20 bp, Artificial Sequence
  sgRNA
  Chrnd_12
tcacctacttccctttcgac

SEQ ID NO: 15539 - DNA, 20 bp, Artificial Sequence
  sgRNA
  Chrnd_13
tgtagaagaggggcttgcgg

SEQ ID NO: 15540 - DNA, 20 bp, Artificial Sequence
  sgRNA
  Chrnd_14
gagcactgagatggccacgg

SEQ ID NO: 15541 - DNA, 20 bp, Artificial Sequence
  sgRNA
  Chrnd_15
ctacgacaaagacctgcggc

SEQ ID NO: 15542 - DNA, 20 bp, Artificial Sequence
  sgRNA
  Chrnd_16
gactccctcagacagcacat

SEQ ID NO: 15543 - DNA, 20 bp, Artificial Sequence
  sgRNA
  Chrnd_17
gcggccggtggctcgaaagg

SEQ ID NO: 15544 - DNA, 20 bp, Artificial Sequence
  sgRNA
  Chrnd_18
ttctccggatgagagccctg

SEQ ID NO: 15545 - DNA, 20 bp, Artificial Sequence
  sgRNA
  Chrnd_19
accgctcttaccccatcgag

SEQ ID NO: 15546 - DNA, 20 bp, Artificial Sequence
  sgRNA
  Chrnd_20
cgttggcatcccactgtaga

SEQ ID NO: 15547 - DNA, 20 bp, Artificial Sequence
  sgRNA
  Chrne_1
ctatcggctcaactacagca

SEQ ID NO: 15548 - DNA, 20 bp, Artificial Sequence
  sgRNA
  Chrne_2
atgattcgccgctatgaggg

SEQ ID NO: 15549 - DNA, 20 bp, Artificial Sequence
  sgRNA
  Chrne_3
aatgttctagtctatgaggg

SEQ ID NO: 15550 - DNA, 20 bp, Artificial Sequence
  sgRNA
  Chrne_4
cctaaccaacctcatctcac

SEQ ID NO: 15551 - DNA, 20 bp, Artificial Sequence
  sgRNA
  Chrne_5
tcaaacacgagttcgctccg

SEQ ID NO: 15552 - DNA, 20 bp, Artificial Sequence
  sgRNA
  Chrne_6
catagcggcgaatcatgcct

SEQ ID NO: 15553 - DNA, 20 bp, Artificial Sequence
  sgRNA
  Chrne_7
tctatacgctcatcatccgc

SEQ ID NO: 15554 - DNA, 20 bp, Artificial Sequence
  sgRNA
  Chrne_8
cgactcatgctacatcccct

SEQ ID NO: 15555 - DNA, 20 bp, Artificial Sequence
  sgRNA
  Chrne_9
ccaaaaacagacattgtcca

SEQ ID NO: 15556 - DNA, 20 bp, Artificial Sequence
  sgRNA
  Chrne_10
ggtattgccgtcgtcatcca

SEQ ID NO: 15557 - DNA, 20 bp, Artificial Sequence
  sgRNA
  Chrne_11
gcagccctctgccagaacct

SEQ ID NO: 15558 - DNA, 20 bp, Artificial Sequence
  sgRNA
  Chrne_12
gcagccatacatgttctgaa

SEQ ID NO: 15559 - DNA, 20 bp, Artificial Sequence
  sgRNA
  Chrne_13
ctaccgcagcacctgcgcag

SEQ ID NO: 15560 - DNA, 20 bp, Artificial Sequence
  sgRNA
  Chrne_14
tctctgagcgtgccactgct

SEQ ID NO: 15561 - DNA, 20 bp, Artificial Sequence
  sgRNA
  Chrne_15
gcaattcatgacaatgagcg

SEQ ID NO: 15562 - DNA, 20 bp, Artificial Sequence
  sgRNA
  Chrne_16
cctcaggtctcctaactggc

SEQ ID NO: 15563 - DNA, 20 bp, Artificial Sequence
  sgRNA
  Chrne_17
gtatcttatattcgtcatgg

SEQ ID NO: 15564 - DNA, 20 bp, Artificial Sequence
  sgRNA
  Chrne_18
atctttgccgtggatgacga

SEQ ID NO: 15565 - DNA, 20 bp, Artificial Sequence
  sgRNA
  Chrne_19
tcgtgctcaacgtatctttg

SEQ ID NO: 15566 - DNA, 20 bp, Artificial Sequence
  sgRNA
  Chrne_20
atgttaatgacgtaaaaaag

SEQ ID NO: 15567 - DNA, 20 bp, Artificial Sequence
  sgRNA
  Chrng_1
ccagtagatacaaccgtcgg

SEQ ID NO: 15568 - DNA, 20 bp, Artificial Sequence
  sgRNA
  Chrng_2
tgaggatggtcaccaccatg

SEQ ID NO: 15569 - DNA, 20 bp, Artificial Sequence
  sgRNA
  Chrng_3
tgtaccccagaatgaacgag

SEQ ID NO: 15570 - DNA, 20 bp, Artificial Sequence
  sgRNA
  Chrng_4
gggcgggcagaaatgcacag

SEQ ID NO: 15571 - DNA, 20 bp, Artificial Sequence
  sgRNA
  Chrng_5
ggaatgatggatatcacaca

SEQ ID NO: 15572 - DNA, 20 bp, Artificial Sequence
  sgRNA
  Chrng_6
aatgtcctcgtgtcccccga

SEQ ID NO: 15573 - DNA, 20 bp, Artificial Sequence
  sgRNA
  Chrng_7
cgcacctcgtcgtagcccca

SEQ ID NO: 15574 - DNA, 20 bp, Artificial Sequence
  sgRNA
  Chrng_8
tcacctacttccccttcgat

SEQ ID NO: 15575 - DNA, 20 bp, Artificial Sequence
  sgRNA
  Chrng_9
gttcgcttcgaggcagacag

SEQ ID NO: 15576 - DNA, 20 bp, Artificial Sequence
  sgRNA
  Chrng_10
gcacctcgtcgtagccccag

SEQ ID NO: 15577 - DNA, 20 bp, Artificial Sequence
  sgRNA
  Chrng_11
gcagcgcaatggattagtgc

SEQ ID NO: 15578 - DNA, 20 bp, Artificial Sequence
  sgRNA
  Chrng_12
gaacagttctgccaatcgaa

SEQ ID NO: 15579 - DNA, 20 bp, Artificial Sequence
  sgRNA
  Chrng_13
cagccagtagatacaaccgt

SEQ ID NO: 15580 - DNA, 20 bp, Artificial Sequence
  sgRNA
  Chrng_14
ggcccagagccgcaaccaag

SEQ ID NO: 15581 - DNA, 20 bp, Artificial Sequence
  sgRNA
  Chrng_15
ggggatctaaccctagcact

SEQ ID NO: 15582 - DNA, 20 bp, Artificial Sequence
  sgRNA
  Chrng_16
agagttcacgacgatgagga

SEQ ID NO: 15583 - DNA, 20 bp, Artificial Sequence
  sgRNA
  Chrng_17
gcagacgctcctcttggttg

SEQ ID NO: 15584 - DNA, 20 bp, Artificial Sequence
  sgRNA
  Chrng_18
gtgcgactatcgcctgcgct

SEQ ID NO: 15585 - DNA, 20 bp, Artificial Sequence
  sgRNA
  Chrng_19
ggacagcagctggagctagt

SEQ ID NO: 15586 - DNA, 20 bp, Artificial Sequence
  sgRNA
  Chrng_20
aaacccctggggctacgacg

SEQ ID NO: 15587 - DNA, 20 bp, Artificial Sequence
  sgRNA
  Clca2_1
attgcattattggatcctag

SEQ ID NO: 15588 - DNA, 20 bp, Artificial Sequence
  sgRNA
  Clca2_2
actgtaaatttgctgcagcg

SEQ ID NO: 15589 - DNA, 20 bp, Artificial Sequence
  sgRNA
  Clca2_3
gtaattatgatccgtccaag

SEQ ID NO: 15590 - DNA, 20 bp, Artificial Sequence
  sgRNA
  Clca2_4
ctgctcacctcgatgaacag

SEQ ID NO: 15591 - DNA, 20 bp, Artificial Sequence
  sgRNA
  Clca2_5
gctggcggatactatgactg

SEQ ID NO: 15592 - DNA, 20 bp, Artificial Sequence
  sgRNA
  Clca2_6
gcgtcagtggacacggcggt

SEQ ID NO: 15593 - DNA, 20 bp, Artificial Sequence
  sgRNA
  Clca2_7
ttccgtccattcacgtagaa

SEQ ID NO: 15594 - DNA, 20 bp, Artificial Sequence
  sgRNA
  Clca2_8
ttatgatccgtccaagtggc

SEQ ID NO: 15595 - DNA, 20 bp, Artificial Sequence
  sgRNA
  Clca2_9
gtcctgatattagtgaccag

SEQ ID NO: 15596 - DNA, 20 bp, Artificial Sequence
  sgRNA
  Clca2_10
ccatggatagaagctccctc

SEQ ID NO: 15597 - DNA, 20 bp, Artificial Sequence
  sgRNA
  Clca2_11
ggtggatccactgttcatcg

SEQ ID NO: 15598 - DNA, 20 bp, Artificial Sequence
  sgRNA
  Clca2_12
gccgcaggctatggtgcgcg

SEQ ID NO: 15599 - DNA, 20 bp, Artificial Sequence
  sgRNA
  Clca2_13
catcaatccccgggtacccg

SEQ ID NO: 15600 - DNA, 20 bp, Artificial Sequence
  sgRNA
  Clca2_14
ttctgcgtcagtggacacgg

SEQ ID NO: 15601 - DNA, 20 bp, Artificial Sequence
  sgRNA
  Clca2_15
cagccagccttaagattcca

SEQ ID NO: 15602 - DNA, 20 bp, Artificial Sequence
  sgRNA
  Clca2_16
ttcagatcctcgggtacccg

SEQ ID NO: 15603 - DNA, 20 bp, Artificial Sequence
  sgRNA
  Clca2_17
gaagtccaaccccatgcacg

SEQ ID NO: 15604 - DNA, 20 bp, Artificial Sequence
  sgRNA
  Clca2_18
tgacctggaagccatgaaag

SEQ ID NO: 15605 - DNA, 20 bp, Artificial Sequence
  sgRNA
  Clca2_19
gtttgacacagctgacctga

SEQ ID NO: 15606 - DNA, 20 bp, Artificial Sequence
  sgRNA
  Clca2_20
gcaaccccagcaccagctgg

SEQ ID NO: 15607 - DNA, 20 bp, Artificial Sequence
  sgRNA
  Clca4a_1
ttacctacaagtgccaatgg

SEQ ID NO: 15608 - DNA, 20 bp, Artificial Sequence
  sgRNA
  Clca4a_2
agagtctatgcatgccaagg

SEQ ID NO: 15609 - DNA, 20 bp, Artificial Sequence
  sgRNA
  Clca4a_3
aaaggaaaaccataatcgag

SEQ ID NO: 15610 - DNA, 20 bp, Artificial Sequence
  sgRNA
  Clca4a_4
attgatgaggtgaaagacag

SEQ ID NO: 15611 - DNA, 20 bp, Artificial Sequence
  sgRNA
  Clca4a_5
tacctacaagtgccaatgga

SEQ ID NO: 15612 - DNA, 20 bp, Artificial Sequence
  sgRNA
  Clca4a_6
ggtgctccacaggtatcacg

SEQ ID NO: 15613 - DNA, 20 bp, Artificial Sequence
  sgRNA
  Clca4a_7
tcatctctgccctcaacggt

SEQ ID NO: 15614 - DNA, 20 bp, Artificial Sequence
  sgRNA
  Clca4a_8
aattgacagcaccttgggaa

SEQ ID NO: 15615 - DNA, 20 bp, Artificial Sequence
  sgRNA
  Clca4a_9
tctctgccctcaacggtggg

SEQ ID NO: 15616 - DNA, 20 bp, Artificial Sequence
  sgRNA
  Clca4a_10
ggtgggtatacatcaggcaa

SEQ ID NO: 15617 - DNA, 20 bp, Artificial Sequence
  sgRNA
  Clca4a_11
aagacagtccccagtacagg

SEQ ID NO: 15618 - DNA, 20 bp, Artificial Sequence
  sgRNA
  Clca4a_12
tttctgattgaactttatca

SEQ ID NO: 15619 - DNA, 20 bp, Artificial Sequence
  sgRNA
  Clca4a_13
aatttcttcctccatctgca

SEQ ID NO: 15620 - DNA, 20 bp, Artificial Sequence
  sgRNA
  Clca4a_14
ttagcatttacagtgattgg

SEQ ID NO: 15621 - DNA, 20 bp, Artificial Sequence
  sgRNA
  Clca4a_15
gcagatggacgtccctccat

SEQ ID NO: 15622 - DNA, 20 bp, Artificial Sequence
  sgRNA
  Clca4a_16
gttgtaattgacagcacctt

SEQ ID NO: 15623 - DNA, 20 bp, Artificial Sequence
  sgRNA
  Clca4a_17
gggctcatctctgccctcaa

SEQ ID NO: 15624 - DNA, 20 bp, Artificial Sequence
  sgRNA
  Clca4a_18
ataaacttggactttcatca

SEQ ID NO: 15625 - DNA, 20 bp, Artificial Sequence
  sgRNA
  Clca4a_19
atggaggaagaaattctgcg

SEQ ID NO: 15626 - DNA, 20 bp, Artificial Sequence
  sgRNA
  Clca4a_20
ggaagtaatcagcacttctg

SEQ ID NO: 15627 - DNA, 20 bp, Artificial Sequence
  sgRNA
  Clca4b_1
tgttgtaattgacagcaccg

SEQ ID NO: 15628 - DNA, 20 bp, Artificial Sequence
  sgRNA
  Clca4b_2
ggggcagctgtataaccaga

SEQ ID NO: 15629 - DNA, 20 bp, Artificial Sequence
  sgRNA
  Clca4b_3
tctctgccctcgaaggcggg

SEQ ID NO: 15630 - DNA, 20 bp, Artificial Sequence
  sgRNA
  Clca4b_4
ggaagtaatcagcagttctg

SEQ ID NO: 15631 - DNA, 20 bp, Artificial Sequence
  sgRNA
  Clca4b_5
attcatacccgtgatacctg

SEQ ID NO: 15632 - DNA, 20 bp, Artificial Sequence
  sgRNA
  Clca4b_6
atactaactcctgatgaacg

SEQ ID NO: 15633 - DNA, 20 bp, Artificial Sequence
  sgRNA
  Clca4b_7
atgaacgtggactttcatca

SEQ ID NO: 15634 - DNA, 20 bp, Artificial Sequence
  sgRNA
  Clca4b_8
gtggcacctcccgccttcga

SEQ ID NO: 15635 - DNA, 20 bp, Artificial Sequence
  sgRNA
  Clca4b_9
cttggttcattctattcaga

SEQ ID NO: 15636 - DNA, 20 bp, Artificial Sequence
  sgRNA
  Clca4b_10
ttacctacaagtgccattgg

SEQ ID NO: 15637 - DNA, 20 bp, Artificial Sequence
  sgRNA
  Clca4b_11
gttgtaattgacagcaccgt

SEQ ID NO: 15638 - DNA, 20 bp, Artificial Sequence
  sgRNA
  Clca4b_12
gagctagtcctgctggacaa

SEQ ID NO: 15639 - DNA, 20 bp, Artificial Sequence
  sgRNA
  Clca4b_13
tgtatgctgaagttctacaa

SEQ ID NO: 15640 - DNA, 20 bp, Artificial Sequence
  sgRNA
  Clca4b_14
ttagcatttacagagattgg

SEQ ID NO: 15641 - DNA, 20 bp, Artificial Sequence
  sgRNA
  Clca4b_15
acccagacccgaaatgactg

SEQ ID NO: 15642 - DNA, 20 bp, Artificial Sequence
  sgRNA
  Clca4b_16
gatgaaagtccacgttcatc

SEQ ID NO: 15643 - DNA, 20 bp, Artificial Sequence
  sgRNA
  Clca4b_17
acccccaaagcaggtacaag

SEQ ID NO: 15644 - DNA, 20 bp, Artificial Sequence
  sgRNA
  Clca4b_18
agtggcaatgttcacccctc

SEQ ID NO: 15645 - DNA, 20 bp, Artificial Sequence
  sgRNA
  Clca4b_19
tcatctctgccctcgaaggc

SEQ ID NO: 15646 - DNA, 20 bp, Artificial Sequence
  sgRNA
  Clca4b_20
gtgccaatggagaagcactt

SEQ ID NO: 15647 - DNA, 20 bp, Artificial Sequence
  sgRNA
  Clcnka_1
agaacaggtaaacgcaactg

SEQ ID NO: 15648 - DNA, 20 bp, Artificial Sequence
  sgRNA
  Clcnka_2
gtcccaaagatggtgaaccg

SEQ ID NO: 15649 - DNA, 20 bp, Artificial Sequence
  sgRNA
  Clcnka_3
caaagccgtcggggatactg

SEQ ID NO: 15650 - DNA, 20 bp, Artificial Sequence
  sgRNA
  Clcnka_4
atgaaacggcccacaccagg

SEQ ID NO: 15651 - DNA, 20 bp, Artificial Sequence
  sgRNA
  Clcnka_5
ctacaagaccagattccgag

SEQ ID NO: 15652 - DNA, 20 bp, Artificial Sequence
  sgRNA
  Clcnka_6
gttcactgttgaagaccgcc

SEQ ID NO: 15653 - DNA, 20 bp, Artificial Sequence
  sgRNA
  Clcnka_7
ggaagttgaaatgctgtcgg

SEQ ID NO: 15654 - DNA, 20 bp, Artificial Sequence
  sgRNA
  Clcnka_8
gggtcgggctcagaaggcca

SEQ ID NO: 15655 - DNA, 20 bp, Artificial Sequence
  sgRNA
  Clcnka_9
ccgtgtccacgcatccgccg

SEQ ID NO: 15656 - DNA, 20 bp, Artificial Sequence
  sgRNA
  Clcnka_10
agtaccagtcctcacgcgca

SEQ ID NO: 15657 - DNA, 20 bp, Artificial Sequence
  sgRNA
  Clcnka_11
tctgtttgacaacaactcgt

SEQ ID NO: 15658 - DNA, 20 bp, Artificial Sequence
  sgRNA
  Clcnka_12
gcttcagtcacctatcctcc

SEQ ID NO: 15659 - DNA, 20 bp, Artificial Sequence
  sgRNA
  Clcnka_13
tgaaatgctgtcggcggcag

SEQ ID NO: 15660 - DNA, 20 bp, Artificial Sequence
  sgRNA
  Clcnka_14
gtctatcccatcatgcctgg

SEQ ID NO: 15661 - DNA, 20 bp, Artificial Sequence
  sgRNA
  Clcnka_15
gcccctccagtaattccaga

SEQ ID NO: 15662 - DNA, 20 bp, Artificial Sequence
  sgRNA
  Clcnka_16
ctgatgcctcggcggatgcg

SEQ ID NO: 15663 - DNA, 20 bp, Artificial Sequence
  sgRNA
  Clcnka_17
ttacagccctctttctacga

SEQ ID NO: 15664 - DNA, 20 bp, Artificial Sequence
  sgRNA
  Clcnka_18
gtgactctgcaagagctatg

SEQ ID NO: 15665 - DNA, 20 bp, Artificial Sequence
  sgRNA
  Clcnka_19
agatgtgtctcagtatccct

SEQ ID NO: 15666 - DNA, 20 bp, Artificial Sequence
  sgRNA
  Clcnka_20
cgtcacgaacagcgcctgaa

SEQ ID NO: 15667 - DNA, 20 bp, Artificial Sequence
  sgRNA
  Clcnkb_1
gaagaccatcttgaccggag

SEQ ID NO: 15668 - DNA, 20 bp, Artificial Sequence
  sgRNA
  Clcnkb_2
cgtgcgcaccaagaccgtcg

SEQ ID NO: 15669 - DNA, 20 bp, Artificial Sequence
  sgRNA
  Clcnkb_3
ggaaaaataagaaagtccgc

SEQ ID NO: 15670 - DNA, 20 bp, Artificial Sequence
  sgRNA
  Clcnkb_4
ggacatctctagcacacaag

SEQ ID NO: 15671 - DNA, 20 bp, Artificial Sequence
  sgRNA
  Clcnkb_5
ggtcaatcccatcatgcccg

SEQ ID NO: 15672 - DNA, 20 bp, Artificial Sequence
  sgRNA
  Clcnkb_6
agaaggacagaagagccacg

SEQ ID NO: 15673 - DNA, 20 bp, Artificial Sequence
  sgRNA
  Clcnkb_7
gcttccatcacgtatccccc

SEQ ID NO: 15674 - DNA, 20 bp, Artificial Sequence
  sgRNA
  Clcnkb_8
ggatcaggctccgctgccca

SEQ ID NO: 15675 - DNA, 20 bp, Artificial Sequence
  sgRNA
  Clcnkb_9
gaattagtggggcttcgtga

SEQ ID NO: 15676 - DNA, 20 bp, Artificial Sequence
  sgRNA
  Clcnkb_10
gatgggagctgcgaagaccg

SEQ ID NO: 15677 - DNA, 20 bp, Artificial Sequence
  sgRNA
  Clcnkb_11
tgatccccagaagctgtggt

SEQ ID NO: 15678 - DNA, 20 bp, Artificial Sequence
  sgRNA
  Clcnkb_12
ggtgacccacaccctctcca

SEQ ID NO: 15679 - DNA, 20 bp, Artificial Sequence
  sgRNA
  Clcnkb_13
gcgggtacaactacagccag

SEQ ID NO: 15680 - DNA, 20 bp, Artificial Sequence
  sgRNA
  Clcnkb_14
ctcaaaggccagcagtgccg

SEQ ID NO: 15681 - DNA, 20 bp, Artificial Sequence
  sgRNA
  Clcnkb_15
ggatgtttctgcggatgcgt

SEQ ID NO: 15682 - DNA, 20 bp, Artificial Sequence
  sgRNA
  Clcnkb_16
cattgttgaagactgccagg

SEQ ID NO: 15683 - DNA, 20 bp, Artificial Sequence
  sgRNA
  Clcnkb_17
gcccctccagtaatcccaga

SEQ ID NO: 15684 - DNA, 20 bp, Artificial Sequence
  sgRNA
  Clcnkb_18
ccatgaagtggcccacacca

SEQ ID NO: 15685 - DNA, 20 bp, Artificial Sequence
  sgRNA
  Clcnkb_19
tctatctgtcgccttcccag

SEQ ID NO: 15686 - DNA, 20 bp, Artificial Sequence
  sgRNA
  Clcnkb_20
gtgccactgcaagaactctg

SEQ ID NO: 15687 - DNA, 20 bp, Artificial Sequence
  sgRNA
  Cldn1_1
gaccgctcaggccatctacg

SEQ ID NO: 15688 - DNA, 20 bp, Artificial Sequence
  sgRNA
  Cldn1_2
gaagatttactcctatgctg

SEQ ID NO: 15689 - DNA, 20 bp, Artificial Sequence
  sgRNA
  Cldn1_3
tctgtttccataccatgctg

SEQ ID NO: 15690 - DNA, 20 bp, Artificial Sequence
  sgRNA
  Cldn1_4
ctcactgttcagattcagca

SEQ ID NO: 15691 - DNA, 20 bp, Artificial Sequence
  sgRNA
  Cldn1_5
gttggcttgggataaggccg

SEQ ID NO: 15692 - DNA, 20 bp, Artificial Sequence
  sgRNA
  Cldn1_6
ccattggcatgaagtgcatg

SEQ ID NO: 15693 - DNA, 20 bp, Artificial Sequence
  sgRNA
  Cldn1_7
ccttgacccccatcaatgcc

SEQ ID NO: 15694 - DNA, 20 bp, Artificial Sequence
  sgRNA
  Cldn1_8
gtaaatcttccactggggca

SEQ ID NO: 15695 - DNA, 20 bp, Artificial Sequence
  sgRNA
  Cldn1_9
tcagcactgccctgccccag

SEQ ID NO: 15696 - DNA, 20 bp, Artificial Sequence
  sgRNA
  Cldn1_10
cgatccatcccagagaagcc

SEQ ID NO: 15697 - DNA, 20 bp, Artificial Sequence
  sgRNA
  Cldn1_11
gactttgcactgtatctgcc

SEQ ID NO: 15698 - DNA, 20 bp, Artificial Sequence
  sgRNA
  Cldn1_12
ataggagtaaatcttccact

SEQ ID NO: 15699 - DNA, 20 bp, Artificial Sequence
  sgRNA
  Cldn1_13
ggacacctcccagaaggcag

SEQ ID NO: 15700 - DNA, 20 bp, Artificial Sequence
  sgRNA
  Cldn1_14
tcctgcgtttcgcaaagcac

SEQ ID NO: 15701 - DNA, 20 bp, Artificial Sequence
  sgRNA
  Cldn1_15
gcctccctctgccttctggg

SEQ ID NO: 15702 - DNA, 20 bp, Artificial Sequence
  sgRNA
  Cldn1_16
tggcattgatgggggtcaag

SEQ ID NO: 15703 - DNA, 20 bp, Artificial Sequence
  sgRNA
  Cldn1_17
tgccaattaccatcaaggct

SEQ ID NO: 15704 - DNA, 20 bp, Artificial Sequence
  sgRNA
  Cldn1_18
gcaatctttgtgtccaccat

SEQ ID NO: 15705 - DNA, 20 bp, Artificial Sequence
  sgRNA
  Cldn1_19
tgaggtgcagaagatgtgga

SEQ ID NO: 15706 - DNA, 20 bp, Artificial Sequence
  sgRNA
  Cldn1_20
tggtaattggcatcctgctg

SEQ ID NO: 15707 - DNA, 20 bp, Artificial Sequence
  sgRNA
  Cldn10_1
gcccgagatggagactacga

SEQ ID NO: 15708 - DNA, 20 bp, Artificial Sequence
  sgRNA
  Cldn10_2
cagaccatccaacgccagca

SEQ ID NO: 15709 - DNA, 20 bp, Artificial Sequence
  sgRNA
  Cldn10_3
tagaggactaatgatcgctg

SEQ ID NO: 15710 - DNA, 20 bp, Artificial Sequence
  sgRNA
  Cldn10_4
atctgcgttaccgattccac

SEQ ID NO: 15711 - DNA, 20 bp, Artificial Sequence
  sgRNA
  Cldn10_5
gagaccttccagtagtcggt

SEQ ID NO: 15712 - DNA, 20 bp, Artificial Sequence
  sgRNA
  Cldn10_6
tctcggaccaagtatcaagg

SEQ ID NO: 15713 - DNA, 20 bp, Artificial Sequence
  sgRNA
  Cldn10_7
ggtggtcactttccattcgt

SEQ ID NO: 15714 - DNA, 20 bp, Artificial Sequence
  sgRNA
  Cldn10_8
accgccacctgggtttacca

SEQ ID NO: 15715 - DNA, 20 bp, Artificial Sequence
  sgRNA
  Cldn10_9
ctgccaccacatccaacgaa

SEQ ID NO: 15716 - DNA, 20 bp, Artificial Sequence
  sgRNA
  Cldn10_10
cggtaatcacagacgacgct

SEQ ID NO: 15717 - DNA, 20 bp, Artificial Sequence
  sgRNA
  Cldn10_11
agaatgggctacacatacaa

SEQ ID NO: 15718 - DNA, 20 bp, Artificial Sequence
  sgRNA
  Cldn10_12
ggttacatccaggcatgtag

SEQ ID NO: 15719 - DNA, 20 bp, Artificial Sequence
  sgRNA
  Cldn10_13
tacgaaggcgacgatttcca

SEQ ID NO: 15720 - DNA, 20 bp, Artificial Sequence
  sgRNA
  Cldn10_14
gttcccctccatgctggcgt

SEQ ID NO: 15721 - DNA, 20 bp, Artificial Sequence
  sgRNA
  Cldn10_15
atgaaatgtaccaaagtcgg

SEQ ID NO: 15722 - DNA, 20 bp, Artificial Sequence
  sgRNA
  Cldn10_16
atacttggtccgagaagaca

SEQ ID NO: 15723 - DNA, 20 bp, Artificial Sequence
  sgRNA
  Cldn10_17
ccacagaccctggtaaaccc

SEQ ID NO: 15724 - DNA, 20 bp, Artificial Sequence
  sgRNA
  Cldn10_18
ccacaggttggcaaaataag

SEQ ID NO: 15725 - DNA, 20 bp, Artificial Sequence
  sgRNA
  Cldn10_19
gcttctctctgcatcattgg

SEQ ID NO: 15726 - DNA, 20 bp, Artificial Sequence
  sgRNA
  Cldn10_20
aatcacagacgacgctcggg

SEQ ID NO: 15727 - DNA, 20 bp, Artificial Sequence
  sgRNA
  Cldn11_1
aacgtccaccaatgactggg

SEQ ID NO: 15728 - DNA, 20 bp, Artificial Sequence
  sgRNA
  Cldn11_2
tgccgaaaaatggacgaact

SEQ ID NO: 15729 - DNA, 20 bp, Artificial Sequence
  sgRNA
  Cldn11_3
ggcgggcaggcccagaacgg

SEQ ID NO: 15730 - DNA, 20 bp, Artificial Sequence
  sgRNA
  Cldn11_4
cctgtgggctgactgcgtca

SEQ ID NO: 15731 - DNA, 20 bp, Artificial Sequence
  sgRNA
  Cldn11_5
tttggctactcgctgtacgc

SEQ ID NO: 15732 - DNA, 20 bp, Artificial Sequence
  sgRNA
  Cldn11_6
gctactcgctgtacgcaggt

SEQ ID NO: 15733 - DNA, 20 bp, Artificial Sequence
  sgRNA
  Cldn11_7
tgtcatcgtctgctgctccg

SEQ ID NO: 15734 - DNA, 20 bp, Artificial Sequence
  sgRNA
  Cldn11_8
agttctcccctgcatccgaa

SEQ ID NO: 15735 - DNA, 20 bp, Artificial Sequence
  sgRNA
  Cldn11_9
cgagtagccaaagctcacga

SEQ ID NO: 15736 - DNA, 20 bp, Artificial Sequence
  sgRNA
  Cldn11_10
ctaccactgcaaacccctgg

SEQ ID NO: 15737 - DNA, 20 bp, Artificial Sequence
  sgRNA
  Cldn11_11
gcgccattgtcgccaccatc

SEQ ID NO: 15738 - DNA, 20 bp, Artificial Sequence
  sgRNA
  Cldn11_12
ggtttcgtcacgagcttcgt

SEQ ID NO: 15739 - DNA, 20 bp, Artificial Sequence
  sgRNA
  Cldn11_13
ctacaagcctgcacgtagcc

SEQ ID NO: 15740 - DNA, 20 bp, Artificial Sequence
  sgRNA
  Cldn11_14
cacgatggtgatctcgcggt

SEQ ID NO: 15741 - DNA, 20 bp, Artificial Sequence
  sgRNA
  Cldn11_15
tttgcagtggtagagaccag

SEQ ID NO: 15742 - DNA, 20 bp, Artificial Sequence
  sgRNA
  Cldn11_16
tcgtggcccattcggatgca

SEQ ID NO: 15743 - DNA, 20 bp, Artificial Sequence
  sgRNA
  Cldn11_17
tgacgaaacccaccacctga

SEQ ID NO: 15744 - DNA, 20 bp, Artificial Sequence
  sgRNA
  Cldn11_18
actgggctccaagggcctgt

SEQ ID NO: 15745 - DNA, 20 bp, Artificial Sequence
  sgRNA
  Cldn11_19
gagatcaccatcgtgagctt

SEQ ID NO: 15746 - DNA, 20 bp, Artificial Sequence
  sgRNA
  Cldn11_20
gcaggtcaccacccagtcat

SEQ ID NO: 15747 - DNA, 20 bp, Artificial Sequence
  sgRNA
  Cldn12_1
aagaacctgacgatttacac

SEQ ID NO: 15748 - DNA, 20 bp, Artificial Sequence
  sgRNA
  Cldn12_2
ttcctaactggaggaaactg

SEQ ID NO: 15749 - DNA, 20 bp, Artificial Sequence
  sgRNA
  Cldn12_3
gcctgatgtacgaccgtacg

SEQ ID NO: 15750 - DNA, 20 bp, Artificial Sequence
  sgRNA
  Cldn12_4
tccaatcaggcagagtagca

SEQ ID NO: 15751 - DNA, 20 bp, Artificial Sequence
  sgRNA
  Cldn12_5
ggtccagctggtcaaccgac

SEQ ID NO: 15752 - DNA, 20 bp, Artificial Sequence
  sgRNA
  Cldn12_6
ccgggagcgtgagagtacag

SEQ ID NO: 15753 - DNA, 20 bp, Artificial Sequence
  sgRNA
  Cldn12_7
gacgatttacacgggcctgt

SEQ ID NO: 15754 - DNA, 20 bp, Artificial Sequence
  sgRNA
  Cldn12_8
gcatagtcaaaggtaaagac

SEQ ID NO: 15755 - DNA, 20 bp, Artificial Sequence
  sgRNA
  Cldn12_9
attgcgatcacgatgctgag

SEQ ID NO: 15756 - DNA, 20 bp, Artificial Sequence
  sgRNA
  Cldn12_10
ctcagcatcgtgatcgcaat

SEQ ID NO: 15757 - DNA, 20 bp, Artificial Sequence
  sgRNA
  Cldn12_11
cggtacctgccagaaaaaac

SEQ ID NO: 15758 - DNA, 20 bp, Artificial Sequence
  sgRNA
  Cldn12_12
cgatttcaatggcagagagg

SEQ ID NO: 15759 - DNA, 20 bp, Artificial Sequence
  sgRNA
  Cldn12_13
tctcagcatcgtgatcgcaa

SEQ ID NO: 15760 - DNA, 20 bp, Artificial Sequence
  sgRNA
  Cldn12_14
tgtcactattgctagctcag

SEQ ID NO: 15761 - DNA, 20 bp, Artificial Sequence
  sgRNA
  Cldn12_15
taaaagatggcccagatgga

SEQ ID NO: 15762 - DNA, 20 bp, Artificial Sequence
  sgRNA
  Cldn12_16
caaccgacaggtaccacgta

SEQ ID NO: 15763 - DNA, 20 bp, Artificial Sequence
  sgRNA
  Cldn12_17
tgagaggcagggcaaactgg

SEQ ID NO: 15764 - DNA, 20 bp, Artificial Sequence
  sgRNA
  Cldn12_18
actcacagccctattcatca

SEQ ID NO: 15765 - DNA, 20 bp, Artificial Sequence
  sgRNA
  Cldn12_19
gggcaaactggaggacacgc

SEQ ID NO: 15766 - DNA, 20 bp, Artificial Sequence
  sgRNA
  Cldn12_20
ggccagtttgatgttaggca

SEQ ID NO: 15767 - DNA, 20 bp, Artificial Sequence
  sgRNA
  Cldn13_1
agtgtacactgtatgacacc

SEQ ID NO: 15768 - DNA, 20 bp, Artificial Sequence
  sgRNA
  Cldn13_2
aacactaagaaacatcccac

SEQ ID NO: 15769 - DNA, 20 bp, Artificial Sequence
  sgRNA
  Cldn13_3
gttgtgtgttacccaggaca

SEQ ID NO: 15770 - DNA, 20 bp, Artificial Sequence
  sgRNA
  Cldn13_4
ccacagaccctcccaaatgg

SEQ ID NO: 15771 - DNA, 20 bp, Artificial Sequence
  sgRNA
  Cldn13_5
tggaaaggtcaccctccaaa

SEQ ID NO: 15772 - DNA, 20 bp, Artificial Sequence
  sgRNA
  Cldn13_6
acctcttgaaagtagccggt

SEQ ID NO: 15773 - DNA, 20 bp, Artificial Sequence
  sgRNA
  Cldn13_7
gtatcgttgttggctcctga

SEQ ID NO: 15774 - DNA, 20 bp, Artificial Sequence
  sgRNA
  Cldn13_8
gtaacacacaacatcatcca

SEQ ID NO: 15775 - DNA, 20 bp, Artificial Sequence
  sgRNA
  Cldn13_9
tcatctgtaccattggaacc

SEQ ID NO: 15776 - DNA, 20 bp, Artificial Sequence
  sgRNA
  Cldn13_10
tcttcgagaagccaagcaat

SEQ ID NO: 15777 - DNA, 20 bp, Artificial Sequence
  sgRNA
  Cldn13_11
gatgggctcttcactctccc

SEQ ID NO: 15778 - DNA, 20 bp, Artificial Sequence
  sgRNA
  Cldn13_12
gagaacctcttgaaagtagc

SEQ ID NO: 15779 - DNA, 20 bp, Artificial Sequence
  sgRNA
  Cldn13_13
ggaaaggtcaccctccaaac

SEQ ID NO: 15780 - DNA, 20 bp, Artificial Sequence
  sgRNA
  Cldn13_14
gatgctggtacccctgtcct

SEQ ID NO: 15781 - DNA, 20 bp, Artificial Sequence
  sgRNA
  Cldn13_15
ggtgggatgtttcttagtgt

SEQ ID NO: 15782 - DNA, 20 bp, Artificial Sequence
  sgRNA
  Cldn13_16
gcaatgggttaaagaagcca

SEQ ID NO: 15783 - DNA, 20 bp, Artificial Sequence
  sgRNA
  Cldn13_17
ccagatgccaccatttggga

SEQ ID NO: 15784 - DNA, 20 bp, Artificial Sequence
  sgRNA
  Cldn13_18
tgtcctgtgctaccagtatc

SEQ ID NO: 15785 - DNA, 20 bp, Artificial Sequence
  sgRNA
  Cldn13_19
actaggggtctcaatgcaac

SEQ ID NO: 15786 - DNA, 20 bp, Artificial Sequence
  sgRNA
  Cldn13_20
gcctcccagcaacagcagca

SEQ ID NO: 15787 - DNA, 20 bp, Artificial Sequence
  sgRNA
  Cldn15_1
ggactccgctgcaccaacgt

SEQ ID NO: 15788 - DNA, 20 bp, Artificial Sequence
  sgRNA
  Cldn15_2
gtgggatggtggctatctcg

SEQ ID NO: 15789 - DNA, 20 bp, Artificial Sequence
  sgRNA
  Cldn15_3
tggagagtgtctacggtcca

SEQ ID NO: 15790 - DNA, 20 bp, Artificial Sequence
  sgRNA
  Cldn15_4
ccctcaccccataccagaga

SEQ ID NO: 15791 - DNA, 20 bp, Artificial Sequence
  sgRNA
  Cldn15_5
gctgatgtcactctcatccg

SEQ ID NO: 15792 - DNA, 20 bp, Artificial Sequence
  sgRNA
  Cldn15_6
ctctcatccgaggtggcacg

SEQ ID NO: 15793 - DNA, 20 bp, Artificial Sequence
  sgRNA
  Cldn15_7
actccagcccaagtagaggg

SEQ ID NO: 15794 - DNA, 20 bp, Artificial Sequence
  sgRNA
  Cldn15_8
gtaccacaggttctcaaaga

SEQ ID NO: 15795 - DNA, 20 bp, Artificial Sequence
  sgRNA
  Cldn15_9
acaccatctttgagaacctg

SEQ ID NO: 15796 - DNA, 20 bp, Artificial Sequence
  sgRNA
  Cldn15_10
tgttgcccacgttggtgcag

SEQ ID NO: 15797 - DNA, 20 bp, Artificial Sequence
  sgRNA
  Cldn15_11
cgagatagccaccatcccac

SEQ ID NO: 15798 - DNA, 20 bp, Artificial Sequence
  sgRNA
  Cldn15_12
ggctgacatgaagaagccga

SEQ ID NO: 15799 - DNA, 20 bp, Artificial Sequence
  sgRNA
  Cldn15_13
acaaccgtagaaggcttgta

SEQ ID NO: 15800 - DNA, 20 bp, Artificial Sequence
  sgRNA
  Cldn15_14
ccatgcctagaaagaggccc

SEQ ID NO: 15801 - DNA, 20 bp, Artificial Sequence
  sgRNA
  Cldn15_15
gggactccgctgcaccaacg

SEQ ID NO: 15802 - DNA, 20 bp, Artificial Sequence
  sgRNA
  Cldn15_16
gatgtcactctcatccgagg

SEQ ID NO: 15803 - DNA, 20 bp, Artificial Sequence
  sgRNA
  Cldn15_17
gcttccctacaagccttcta

SEQ ID NO: 15804 - DNA, 20 bp, Artificial Sequence
  sgRNA
  Cldn15_18
ggcactccagcccaagtaga

SEQ ID NO: 15805 - DNA, 20 bp, Artificial Sequence
  sgRNA
  Cldn15_19
ccccagcatcagcagtccca

SEQ ID NO: 15806 - DNA, 20 bp, Artificial Sequence
  sgRNA
  Cldn15_20
ccaagctgctggccattgca

SEQ ID NO: 15807 - DNA, 20 bp, Artificial Sequence
  sgRNA
  Cldn16_1
ggccacgatcaaaaacccag

SEQ ID NO: 15808 - DNA, 20 bp, Artificial Sequence
  sgRNA
  Cldn16_2
gaacgctgatgactccctgg

SEQ ID NO: 15809 - DNA, 20 bp, Artificial Sequence
  sgRNA
  Cldn16_3
agtacctgcaatgagtaatg

SEQ ID NO: 15810 - DNA, 20 bp, Artificial Sequence
  sgRNA
  Cldn16_4
tatattgtgtaaaacgagag

SEQ ID NO: 15811 - DNA, 20 bp, Artificial Sequence
  sgRNA
  Cldn16_5
tatggagtcgtactcatcgc

SEQ ID NO: 15812 - DNA, 20 bp, Artificial Sequence
  sgRNA
  Cldn16_6
agttgaatagggcttcctca

SEQ ID NO: 15813 - DNA, 20 bp, Artificial Sequence
  sgRNA
  Cldn16_7
tggtccctgcaacaaagcaa

SEQ ID NO: 15814 - DNA, 20 bp, Artificial Sequence
  sgRNA
  Cldn16_8
ggccttgtaggacttggcca

SEQ ID NO: 15815 - DNA, 20 bp, Artificial Sequence
  sgRNA
  Cldn16_9
tcttggccatattctccact

SEQ ID NO: 15816 - DNA, 20 bp, Artificial Sequence
  sgRNA
  Cldn16_10
ggaactacccttatgccatg

SEQ ID NO: 15817 - DNA, 20 bp, Artificial Sequence
  sgRNA
  Cldn16_11
catccaacagtctgtccagg

SEQ ID NO: 15818 - DNA, 20 bp, Artificial Sequence
  sgRNA
  Cldn16_12
cttgggatccaatataaatt

SEQ ID NO: 15819 - DNA, 20 bp, Artificial Sequence
  sgRNA
  Cldn16_13
caggaatcatcggttctgtg

SEQ ID NO: 15820 - DNA, 20 bp, Artificial Sequence
  sgRNA
  Cldn16_14
gacacacctgcagttgaata

SEQ ID NO: 15821 - DNA, 20 bp, Artificial Sequence
  sgRNA
  Cldn16_15
tggccacctggacagactgt

SEQ ID NO: 15822 - DNA, 20 bp, Artificial Sequence
  sgRNA
  Cldn16_16
gggaccacattactcattgc

SEQ ID NO: 15823 - DNA, 20 bp, Artificial Sequence
  sgRNA
  Cldn16_17
agggcttcctcatggcataa

SEQ ID NO: 15824 - DNA, 20 bp, Artificial Sequence
  sgRNA
  Cldn16_18
tttggctgtctctgtccgag

SEQ ID NO: 15825 - DNA, 20 bp, Artificial Sequence
  sgRNA
  Cldn16_19
tttgaagaggtacaaacagc

SEQ ID NO: 15826 - DNA, 20 bp, Artificial Sequence
  sgRNA
  Cldn16_20
acttcacacagtccagacca

SEQ ID NO: 15827 - DNA, 20 bp, Artificial Sequence
  sgRNA
  Cldn18_1
tccacagctaacatgtacag

SEQ ID NO: 15828 - DNA, 20 bp, Artificial Sequence
  sgRNA
  Cldn18_2
gtacgagccctgatgatcgt

SEQ ID NO: 15829 - DNA, 20 bp, Artificial Sequence
  sgRNA
  Cldn18_3
gttgcgtgcaacagagctcg

SEQ ID NO: 15830 - DNA, 20 bp, Artificial Sequence
  sgRNA
  Cldn18_4
tggtgcagaccgttcagacc

SEQ ID NO: 15831 - DNA, 20 bp, Artificial Sequence
  sgRNA
  Cldn18_5
gctccactggtccatacaag

SEQ ID NO: 15832 - DNA, 20 bp, Artificial Sequence
  sgRNA
  Cldn18_6
ccgctgtattcaactaccaa

SEQ ID NO: 15833 - DNA, 20 bp, Artificial Sequence
  sgRNA
  Cldn18_7
agttgaatacagcggtcacc

SEQ ID NO: 15834 - DNA, 20 bp, Artificial Sequence
  sgRNA
  Cldn18_8
tgtcatctggtgtcaggcca

SEQ ID NO: 15835 - DNA, 20 bp, Artificial Sequence
  sgRNA
  Cldn18_9
tctggcttcaccgagtgccg

SEQ ID NO: 15836 - DNA, 20 bp, Artificial Sequence
  sgRNA
  Cldn18_10
gctccacatgtccatcccag

SEQ ID NO: 15837 - DNA, 20 bp, Artificial Sequence
  sgRNA
  Cldn18_11
ccgccgtgttccagtatgaa

SEQ ID NO: 15838 - DNA, 20 bp, Artificial Sequence
  sgRNA
  Cldn18_12
ccggctgcatagccgccact

SEQ ID NO: 15839 - DNA, 20 bp, Artificial Sequence
  sgRNA
  Cldn18_13
gctaacatgtacagcggcat

SEQ ID NO: 15840 - DNA, 20 bp, Artificial Sequence
  sgRNA
  Cldn18_14
aatgttgcctacaggcctgg

SEQ ID NO: 15841 - DNA, 20 bp, Artificial Sequence
  sgRNA
  Cldn18_15
gaaacaagaagatctacgat

SEQ ID NO: 15842 - DNA, 20 bp, Artificial Sequence
  sgRNA
  Cldn18_16
gccctgaagtgcattcgcat

SEQ ID NO: 15843 - DNA, 20 bp, Artificial Sequence
  sgRNA
  Cldn18_17
tcactcccccaatcagggtg

SEQ ID NO: 15844 - DNA, 20 bp, Artificial Sequence
  sgRNA
  Cldn18_18
cccttcatactggaacacgg

SEQ ID NO: 15845 - DNA, 20 bp, Artificial Sequence
  sgRNA
  Cldn18_19
tcagggcgaagatggacacg

SEQ ID NO: 15846 - DNA, 20 bp, Artificial Sequence
  sgRNA
  Cldn18_20
tagcatggatgactctgcca

SEQ ID NO: 15847 - DNA, 20 bp, Artificial Sequence
  sgRNA
  Cldn19_1
ccacacggctcttggcagtg

SEQ ID NO: 15848 - DNA, 20 bp, Artificial Sequence
  sgRNA
  Cldn19_2
ctgggcactcacctgccaag

SEQ ID NO: 15849 - DNA, 20 bp, Artificial Sequence
  sgRNA
  Cldn19_3
tgctgactggatatgacctg

SEQ ID NO: 15850 - DNA, 20 bp, Artificial Sequence
  sgRNA
  Cldn19_4
acatccacagcccttcgtag

SEQ ID NO: 15851 - DNA, 20 bp, Artificial Sequence
  sgRNA
  Cldn19_5
gttgagggtccagagcgata

SEQ ID NO: 15852 - DNA, 20 bp, Artificial Sequence
  sgRNA
  Cldn19_6
cgtgggcatgaagtgcactc

SEQ ID NO: 15853 - DNA, 20 bp, Artificial Sequence
  sgRNA
  Cldn19_7
gtatgctaccctggtaacac

SEQ ID NO: 15854 - DNA, 20 bp, Artificial Sequence
  sgRNA
  Cldn19_8
gatgccatcatcactgccgt

SEQ ID NO: 15855 - DNA, 20 bp, Artificial Sequence
  sgRNA
  Cldn19_9
gatgatggcatcgcctgcat

SEQ ID NO: 15856 - DNA, 20 bp, Artificial Sequence
  sgRNA
  Cldn19_10
ccaaggctaggaagtagccc

SEQ ID NO: 15857 - DNA, 20 bp, Artificial Sequence
  sgRNA
  Cldn19_11
tgttgttaagttgcccgcct

SEQ ID NO: 15858 - DNA, 20 bp, Artificial Sequence
  sgRNA
  Cldn19_12
tttggcccagctctgttcgt

SEQ ID NO: 15859 - DNA, 20 bp, Artificial Sequence
  sgRNA
  Cldn19_13
gcaccatggccacaaagccc

SEQ ID NO: 15860 - DNA, 20 bp, Artificial Sequence
  sgRNA
  Cldn19_14
ggtgctctcttcctcttggc

SEQ ID NO: 15861 - DNA, 20 bp, Artificial Sequence
  sgRNA
  Cldn19_15
gattcactcctggccctgga

SEQ ID NO: 15862 - DNA, 20 bp, Artificial Sequence
  sgRNA
  Cldn19_16
ggctacttcctagccttggg

SEQ ID NO: 15863 - DNA, 20 bp, Artificial Sequence
  sgRNA
  Cldn19_17
tcttgcgcctctcagagcac

SEQ ID NO: 15864 - DNA, 20 bp, Artificial Sequence
  sgRNA
  Cldn19_18
tctgttcgtcggctgggcct

SEQ ID NO: 15865 - DNA, 20 bp, Artificial Sequence
  sgRNA
  Cldn19_19
cagcccttcgtagaggccca

SEQ ID NO: 15866 - DNA, 20 bp, Artificial Sequence
  sgRNA
  Cldn19_20
ctgccgtgggcctctacgaa

SEQ ID NO: 15867 - DNA, 20 bp, Artificial Sequence
  sgRNA
  Cldn2_1
ggtactgtagatatcgcact

SEQ ID NO: 15868 - DNA, 20 bp, Artificial Sequence
  sgRNA
  Cldn2_2
agagataatacaagccagcg

SEQ ID NO: 15869 - DNA, 20 bp, Artificial Sequence
  sgRNA
  Cldn2_3
tggcgaacgagttcctatgt

SEQ ID NO: 15870 - DNA, 20 bp, Artificial Sequence
  sgRNA
  Cldn2_4
ctgccaggattctcgagcta

SEQ ID NO: 15871 - DNA, 20 bp, Artificial Sequence
  sgRNA
  Cldn2_5
gcggcgagtagaagtcccga

SEQ ID NO: 15872 - DNA, 20 bp, Artificial Sequence
  sgRNA
  Cldn2_6
tagttggtacgattgccctg

SEQ ID NO: 15873 - DNA, 20 bp, Artificial Sequence
  sgRNA
  Cldn2_7
ctaacagccccaaaaggcct

SEQ ID NO: 15874 - DNA, 20 bp, Artificial Sequence
  sgRNA
  Cldn2_8
gctggcttgtattatctctg

SEQ ID NO: 15875 - DNA, 20 bp, Artificial Sequence
  sgRNA
  Cldn2_9
ctaggatgtagcccaccagt

SEQ ID NO: 15876 - DNA, 20 bp, Artificial Sequence
  sgRNA
  Cldn2_10
tcgagaatcctggcagaaca

SEQ ID NO: 15877 - DNA, 20 bp, Artificial Sequence
  sgRNA
  Cldn2_11
ggagagctcctagtggcaag

SEQ ID NO: 15878 - DNA, 20 bp, Artificial Sequence
  sgRNA
  Cldn2_12
tgttggtgccagcattgtga

SEQ ID NO: 15879 - DNA, 20 bp, Artificial Sequence
  sgRNA
  Cldn2_13
gttgggaagcagcatggcaa

SEQ ID NO: 15880 - DNA, 20 bp, Artificial Sequence
  sgRNA
  Cldn2_14
tggtgccagcattgtgacgg

SEQ ID NO: 15881 - DNA, 20 bp, Artificial Sequence
  sgRNA
  Cldn2_15
gtagttggtacgattgccct

SEQ ID NO: 15882 - DNA, 20 bp, Artificial Sequence
  sgRNA
  Cldn2_16
ggggcgagcaggaaaagcaa

SEQ ID NO: 15883 - DNA, 20 bp, Artificial Sequence
  sgRNA
  Cldn2_17
ggacgtcaccatcatggcct

SEQ ID NO: 15884 - DNA, 20 bp, Artificial Sequence
  sgRNA
  Cldn2_18
agatcttggagagctcctag

SEQ ID NO: 15885 - DNA, 20 bp, Artificial Sequence
  sgRNA
  Cldn2_19
gagtgtgcgacacacagcac

SEQ ID NO: 15886 - DNA, 20 bp, Artificial Sequence
  sgRNA
  Cldn2_20
tcccttggcgtccaactggt

SEQ ID NO: 15887 - DNA, 20 bp, Artificial Sequence
  sgRNA
  Cldn20_1
tggaaggttaatgcatacgc

SEQ ID NO: 15888 - DNA, 20 bp, Artificial Sequence
  sgRNA
  Cldn20_2
cccaacagtgtggtacacca

SEQ ID NO: 15889 - DNA, 20 bp, Artificial Sequence
  sgRNA
  Cldn20_3
cgtccatgtgcagactgcga

SEQ ID NO: 15890 - DNA, 20 bp, Artificial Sequence
  sgRNA
  Cldn20_4
atgaactgcactcacttagg

SEQ ID NO: 15891 - DNA, 20 bp, Artificial Sequence
  sgRNA
  Cldn20_5
gcgatgctactacttatctc

SEQ ID NO: 15892 - DNA, 20 bp, Artificial Sequence
  sgRNA
  Cldn20_6
tcgcagtctgcacatggacg

SEQ ID NO: 15893 - DNA, 20 bp, Artificial Sequence
  sgRNA
  Cldn20_7
ctacctggcagccaaagaac

SEQ ID NO: 15894 - DNA, 20 bp, Artificial Sequence
  sgRNA
  Cldn20_8
gagtctgcttcatcactgca

SEQ ID NO: 15895 - DNA, 20 bp, Artificial Sequence
  sgRNA
  Cldn20_9
gcagactgcgagggccacca

SEQ ID NO: 15896 - DNA, 20 bp, Artificial Sequence
  sgRNA
  Cldn20_10
actgcacgtggtacagcact

SEQ ID NO: 15897 - DNA, 20 bp, Artificial Sequence
  sgRNA
  Cldn20_11
ggtagtggaaagtttctgct

SEQ ID NO: 15898 - DNA, 20 bp, Artificial Sequence
  sgRNA
  Cldn20_12
cgaaataaacccaatgtaca

SEQ ID NO: 15899 - DNA, 20 bp, Artificial Sequence
  sgRNA
  Cldn20_13
ggaatgaactgcactcactt

SEQ ID NO: 15900 - DNA, 20 bp, Artificial Sequence
  sgRNA
  Cldn20_14
cctcgcagtctgcacatgga

SEQ ID NO: 15901 - DNA, 20 bp, Artificial Sequence
  sgRNA
  Cldn20_15
ccgtccatgtgcagactgcg

SEQ ID NO: 15902 - DNA, 20 bp, Artificial Sequence
  sgRNA
  Cldn20_16
ttatgtgctcgcctgttctt

SEQ ID NO: 15903 - DNA, 20 bp, Artificial Sequence
  sgRNA
  Cldn20_17
tttcatcctggccgtgtctg

SEQ ID NO: 15904 - DNA, 20 bp, Artificial Sequence
  sgRNA
  Cldn20_18
tgcttgggagggtagatcca

SEQ ID NO: 15905 - DNA, 20 bp, Artificial Sequence
  sgRNA
  Cldn20_19
gggatttgtacttcgatagc

SEQ ID NO: 15906 - DNA, 20 bp, Artificial Sequence
  sgRNA
  Cldn20_20
tatgcattaaccttccagtt

SEQ ID NO: 15907 - DNA, 20 bp, Artificial Sequence
  sgRNA
  Cldn3_1
gaaaagcactcccgccacga

SEQ ID NO: 15908 - DNA, 20 bp, Artificial Sequence
  sgRNA
  Cldn3_2
tgtgctgcgcccttcccatg

SEQ ID NO: 15909 - DNA, 20 bp, Artificial Sequence
  sgRNA
  Cldn3_3
ttgtacgcagttggtacact

SEQ ID NO: 15910 - DNA, 20 bp, Artificial Sequence
  sgRNA
  Cldn3_4
catcacggcgcagatcacct

SEQ ID NO: 15911 - DNA, 20 bp, Artificial Sequence
  sgRNA
  Cldn3_5
gtgggtgcatacttgtcgcg

SEQ ID NO: 15912 - DNA, 20 bp, Artificial Sequence
  sgRNA
  Cldn3_6
gccgcgctgcagttgctagg

SEQ ID NO: 15913 - DNA, 20 bp, Artificial Sequence
  sgRNA
  Cldn3_7
aggtgagcagagccgccaac

SEQ ID NO: 15914 - DNA, 20 bp, Artificial Sequence
  sgRNA
  Cldn3_8
cgaaacgcgccacatgggaa

SEQ ID NO: 15915 - DNA, 20 bp, Artificial Sequence
  sgRNA
  Cldn3_9
atgggagctgggttgtacgt

SEQ ID NO: 15916 - DNA, 20 bp, Artificial Sequence
  sgRNA
  Cldn3_10
gcaccacgcagttcatccac

SEQ ID NO: 15917 - DNA, 20 bp, Artificial Sequence
  sgRNA
  Cldn3_11
gtagtccttgcggtcgtagg

SEQ ID NO: 15918 - DNA, 20 bp, Artificial Sequence
  sgRNA
  Cldn3_12
tattctgcgccgcgatccac

SEQ ID NO: 15919 - DNA, 20 bp, Artificial Sequence
  sgRNA
  Cldn3_13
tctgggcctcgggcaccaac

SEQ ID NO: 15920 - DNA, 20 bp, Artificial Sequence
  sgRNA
  Cldn3_14
gccccctagcaactgcagcg

SEQ ID NO: 15921 - DNA, 20 bp, Artificial Sequence
  sgRNA
  Cldn3_15
ctataacccgttggtgcccg

SEQ ID NO: 15922 - DNA, 20 bp, Artificial Sequence
  sgRNA
  Cldn3_16
cgtacaagacgagacggcca

SEQ ID NO: 15923 - DNA, 20 bp, Artificial Sequence
  sgRNA
  Cldn3_17
ggctctgctcaccttagtac

SEQ ID NO: 15924 - DNA, 20 bp, Artificial Sequence
  sgRNA
  Cldn3_18
cgcagaatagaggatcttgg

SEQ ID NO: 15925 - DNA, 20 bp, Artificial Sequence
  sgRNA
  Cldn3_19
gatgggagctgggttgtacg

SEQ ID NO: 15926 - DNA, 20 bp, Artificial Sequence
  sgRNA
  Cldn3_20
gcagaatagaggatcttggt

SEQ ID NO: 15927 - DNA, 20 bp, Artificial Sequence
  sgRNA
  Cldn6_1
gaagtcctggatgatagagt

SEQ ID NO: 15928 - DNA, 20 bp, Artificial Sequence
  sgRNA
  Cldn6_2
gccagtgctctgaaccacac

SEQ ID NO: 15929 - DNA, 20 bp, Artificial Sequence
  sgRNA
  Cldn6_3
catcggcaacagcatcgtcg

SEQ ID NO: 15930 - DNA, 20 bp, Artificial Sequence
  sgRNA
  Cldn6_4
tgaggagggtgacaacacag

SEQ ID NO: 15931 - DNA, 20 bp, Artificial Sequence
  sgRNA
  Cldn6_5
gccaagcaggacaatgagga

SEQ ID NO: 15932 - DNA, 20 bp, Artificial Sequence
  sgRNA
  Cldn6_6
acatctgtcccacattctcg

SEQ ID NO: 15933 - DNA, 20 bp, Artificial Sequence
  sgRNA
  Cldn6_7
gctgcgcctgctcttctgga

SEQ ID NO: 15934 - DNA, 20 bp, Artificial Sequence
  sgRNA
  Cldn6_8
aaggcggtcaccttccacat

SEQ ID NO: 15935 - DNA, 20 bp, Artificial Sequence
  sgRNA
  Cldn6_9
tttgagcatcagccaccaag

SEQ ID NO: 15936 - DNA, 20 bp, Artificial Sequence
  sgRNA
  Cldn6_10
tggtggctgatgctcaaaag

SEQ ID NO: 15937 - DNA, 20 bp, Artificial Sequence
  sgRNA
  Cldn6_11
gcttggctgggtcaacgccc

SEQ ID NO: 15938 - DNA, 20 bp, Artificial Sequence
  sgRNA
  Cldn6_12
ttcttggtgggatattcgga

SEQ ID NO: 15939 - DNA, 20 bp, Artificial Sequence
  sgRNA
  Cldn6_13
attcttggtgggatattcgg

SEQ ID NO: 15940 - DNA, 20 bp, Artificial Sequence
  sgRNA
  Cldn6_14
ggacttctacaaccccttgg

SEQ ID NO: 15941 - DNA, 20 bp, Artificial Sequence
  sgRNA
  Cldn6_15
ctactggtctgcaaatcttg

SEQ ID NO: 15942 - DNA, 20 bp, Artificial Sequence
  sgRNA
  Cldn6_16
gcactacctgtgtggaagat

SEQ ID NO: 15943 - DNA, 20 bp, Artificial Sequence
  sgRNA
  Cldn6_17
ggcgttgacccagccaagca

SEQ ID NO: 15944 - DNA, 20 bp, Artificial Sequence
  sgRNA
  Cldn6_18
tgacgctcattcctgtctgc

SEQ ID NO: 15945 - DNA, 20 bp, Artificial Sequence
  sgRNA
  Cldn6_19
ggagttcctatcttccacac

SEQ ID NO: 15946 - DNA, 20 bp, Artificial Sequence
  sgRNA
  Cldn6_20
aggctgcccagcccaggtag

SEQ ID NO: 15947 - DNA, 20 bp, Artificial Sequence
  sgRNA
  Cldn7_1
ggccactcgagccttaatgg

SEQ ID NO: 15948 - DNA, 20 bp, Artificial Sequence
  sgRNA
  Cldn7_2
gcccgaatagctatgactgg

SEQ ID NO: 15949 - DNA, 20 bp, Artificial Sequence
  sgRNA
  Cldn7_3
gagctgcaaaatgtacgact

SEQ ID NO: 15950 - DNA, 20 bp, Artificial Sequence
  sgRNA
  Cldn7_4
acagcccaggccatgtacaa

SEQ ID NO: 15951 - DNA, 20 bp, Artificial Sequence
  sgRNA
  Cldn7_5
gagtgcgtcacgcagagcac

SEQ ID NO: 15952 - DNA, 20 bp, Artificial Sequence
  sgRNA
  Cldn7_6
ttggacttggggtaagagcg

SEQ ID NO: 15953 - DNA, 20 bp, Artificial Sequence
  sgRNA
  Cldn7_7
gatgatgttgtcgcccgcat

SEQ ID NO: 15954 - DNA, 20 bp, Artificial Sequence
  sgRNA
  Cldn7_8
aatccaggaacatgctacca

SEQ ID NO: 15955 - DNA, 20 bp, Artificial Sequence
  sgRNA
  Cldn7_9
gcccagccgataaagatggc

SEQ ID NO: 15956 - DNA, 20 bp, Artificial Sequence
  sgRNA
  Cldn7_10
tggacaggagcaagagagca

SEQ ID NO: 15957 - DNA, 20 bp, Artificial Sequence
  sgRNA
  Cldn7_11
ttaacgttcatgggcgtcaa

SEQ ID NO: 15958 - DNA, 20 bp, Artificial Sequence
  sgRNA
  Cldn7_12
taacgttcatgggcgtcaag

SEQ ID NO: 15959 - DNA, 20 bp, Artificial Sequence
  sgRNA
  Cldn7_13
cgagcactgccatccctcag

SEQ ID NO: 15960 - DNA, 20 bp, Artificial Sequence
  sgRNA
  Cldn7_14
gctcatctgccactgaggga

SEQ ID NO: 15961 - DNA, 20 bp, Artificial Sequence
  sgRNA
  Cldn7_15
gccatgtttgtcgccacgat

SEQ ID NO: 15962 - DNA, 20 bp, Artificial Sequence
  sgRNA
  Cldn7_16
aggagctcatctgccactga

SEQ ID NO: 15963 - DNA, 20 bp, Artificial Sequence
  sgRNA
  Cldn7_17
ttaaggctcgagtggcctgc

SEQ ID NO: 15964 - DNA, 20 bp, Artificial Sequence
  sgRNA
  Cldn7_18
catccagagccccttgtaca

SEQ ID NO: 15965 - DNA, 20 bp, Artificial Sequence
  sgRNA
  Cldn7_19
gtggcagatgagctcctatg

SEQ ID NO: 15966 - DNA, 20 bp, Artificial Sequence
  sgRNA
  Cldn7_20
ccatctttatcggctgggca

SEQ ID NO: 15967 - DNA, 20 bp, Artificial Sequence
  sgRNA
  Cldn8_1
gaagtgcaccagatgcacgg

SEQ ID NO: 15968 - DNA, 20 bp, Artificial Sequence
  sgRNA
  Cldn8_2
aaggcagacactctccactg

SEQ ID NO: 15969 - DNA, 20 bp, Artificial Sequence
  sgRNA
  Cldn8_3
gtctggactaagagccagca

SEQ ID NO: 15970 - DNA, 20 bp, Artificial Sequence
  sgRNA
  Cldn8_4
gtgtttgagaaccgctggga

SEQ ID NO: 15971 - DNA, 20 bp, Artificial Sequence
  sgRNA
  Cldn8_5
ttagggccacatccaccagt

SEQ ID NO: 15972 - DNA, 20 bp, Artificial Sequence
  sgRNA
  Cldn8_6
tcatccacaagccttcccag

SEQ ID NO: 15973 - DNA, 20 bp, Artificial Sequence
  sgRNA
  Cldn8_7
gctttcatgacagccatcct

SEQ ID NO: 15974 - DNA, 20 bp, Artificial Sequence
  sgRNA
  Cldn8_8
agccgcatcttgctgacagc

SEQ ID NO: 15975 - DNA, 20 bp, Artificial Sequence
  sgRNA
  Cldn8_9
catcccatcgcaccactcaa

SEQ ID NO: 15976 - DNA, 20 bp, Artificial Sequence
  sgRNA
  Cldn8_10
aattggcaacccagctgaca

SEQ ID NO: 15977 - DNA, 20 bp, Artificial Sequence
  sgRNA
  Cldn8_11
atctggtgcacttcattccg

SEQ ID NO: 15978 - DNA, 20 bp, Artificial Sequence
  sgRNA
  Cldn8_12
gcgctggtgctgatcgctgg

SEQ ID NO: 15979 - DNA, 20 bp, Artificial Sequence
  sgRNA
  Cldn8_13
gcttgtggatgaattgtatg

SEQ ID NO: 15980 - DNA, 20 bp, Artificial Sequence
  sgRNA
  Cldn8_14
ggtctggactaagagccagc

SEQ ID NO: 15981 - DNA, 20 bp, Artificial Sequence
  sgRNA
  Cldn8_15
agacttctacaacccactgg

SEQ ID NO: 15982 - DNA, 20 bp, Artificial Sequence
  sgRNA
  Cldn8_16
actccgttgagtggtgcgat

SEQ ID NO: 15983 - DNA, 20 bp, Artificial Sequence
  sgRNA
  Cldn8_17
ggaatcatcttcttcatcac

SEQ ID NO: 15984 - DNA, 20 bp, Artificial Sequence
  sgRNA
  Cldn8_18
tcagtcctcgggatgcctgg

SEQ ID NO: 15985 - DNA, 20 bp, Artificial Sequence
  sgRNA
  Cldn8_19
ggtgcacttcattccgagga

SEQ ID NO: 15986 - DNA, 20 bp, Artificial Sequence
  sgRNA
  Cldn8_20
cataggctggaccacagcgc

SEQ ID NO: 15987 - DNA, 20 bp, Artificial Sequence
  sgRNA
  Cldn9_1
tgagcaccaaaatgcccgag

SEQ ID NO: 15988 - DNA, 20 bp, Artificial Sequence
  sgRNA
  Cldn9_2
cagcccctcccataccactt

SEQ ID NO: 15989 - DNA, 20 bp, Artificial Sequence
  sgRNA
  Cldn9_3
accttcgtcctccacacacg

SEQ ID NO: 15990 - DNA, 20 bp, Artificial Sequence
  sgRNA
  Cldn9_4
caaagtatacgactcactgc

SEQ ID NO: 15991 - DNA, 20 bp, Artificial Sequence
  sgRNA
  Cldn9_5
cccgtatcgtactcaccgca

SEQ ID NO: 15992 - DNA, 20 bp, Artificial Sequence
  sgRNA
  Cldn9_6
tcacactttgagcgtccccg

SEQ ID NO: 15993 - DNA, 20 bp, Artificial Sequence
  sgRNA
  Cldn9_7
gggacgctcaaagtgtgacg

SEQ ID NO: 15994 - DNA, 20 bp, Artificial Sequence
  sgRNA
  Cldn9_8
tagccagcctagcacagcca

SEQ ID NO: 15995 - DNA, 20 bp, Artificial Sequence
  sgRNA
  Cldn9_9
tgaactcctcggcatgaccc

SEQ ID NO: 15996 - DNA, 20 bp, Artificial Sequence
  sgRNA
  Cldn9_10
ggacgctcaaagtgtgacgg

SEQ ID NO: 15997 - DNA, 20 bp, Artificial Sequence
  sgRNA
  Cldn9_11
catgggctgtccagcagaca

SEQ ID NO: 15998 - DNA, 20 bp, Artificial Sequence
  sgRNA
  Cldn9_12
ccgtatcgtactcaccgcag

SEQ ID NO: 15999 - DNA, 20 bp, Artificial Sequence
  sgRNA
  Cldn9_13
ccagtcccgaagcacctgaa

SEQ ID NO: 16000 - DNA, 20 bp, Artificial Sequence
  sgRNA
  Cldn9_14
agccctcaagagagaactgg

SEQ ID NO: 16001 - DNA, 20 bp, Artificial Sequence
  sgRNA
  Cldn9_15
gcaggcccagcaaagccagc

SEQ ID NO: 16002 - DNA, 20 bp, Artificial Sequence
  sgRNA
  Cldn9_16
gctgccctgctcatgctagg

SEQ ID NO: 16003 - DNA, 20 bp, Artificial Sequence
  sgRNA
  Cldn9_17
catcggcaacagcatcgttg

SEQ ID NO: 16004 - DNA, 20 bp, Artificial Sequence
  sgRNA
  Cldn9_18
ccctccccctagcatgagca

SEQ ID NO: 16005 - DNA, 20 bp, Artificial Sequence
  sgRNA
  Cldn9_19
gcccagcaaagccagcagga

SEQ ID NO: 16006 - DNA, 20 bp, Artificial Sequence
  sgRNA
  Cldn9_20
ggatggagtagcccagcctg

SEQ ID NO: 16007 - DNA, 20 bp, Artificial Sequence
  sgRNA
  Cldnd1_1
tgactcgaataaaatcgcct

SEQ ID NO: 16008 - DNA, 20 bp, Artificial Sequence
  sgRNA
  Cldnd1_2
tgccgctattgtggttgccg

SEQ ID NO: 16009 - DNA, 20 bp, Artificial Sequence
  sgRNA
  Cldnd1_3
atctacatggcggcctccat

SEQ ID NO: 16010 - DNA, 20 bp, Artificial Sequence
  sgRNA
  Cldnd1_4
actggtatgcgccaccggaa

SEQ ID NO: 16011 - DNA, 20 bp, Artificial Sequence
  sgRNA
  Cldnd1_5
tctcatccgcctcgtcaccg

SEQ ID NO: 16012 - DNA, 20 bp, Artificial Sequence
  sgRNA
  Cldnd1_6
tctgggctgcccacaccaac

SEQ ID NO: 16013 - DNA, 20 bp, Artificial Sequence
  sgRNA
  Cldnd1_7
gatgttctgttccgatacaa

SEQ ID NO: 16014 - DNA, 20 bp, Artificial Sequence
  sgRNA
  Cldnd1_8
atcaagcccaagctgacgaa

SEQ ID NO: 16015 - DNA, 20 bp, Artificial Sequence
  sgRNA
  Cldnd1_9
taaggtgtactctttccggt

SEQ ID NO: 16016 - DNA, 20 bp, Artificial Sequence
  sgRNA
  Cldnd1_10
gttccgatacaacggcagct

SEQ ID NO: 16017 - DNA, 20 bp, Artificial Sequence
  sgRNA
  Cldnd1_11
gccccaagctgccgttgtat

SEQ ID NO: 16018 - DNA, 20 bp, Artificial Sequence
  sgRNA
  Cldnd1_12
gcggccgccatgaactgtaa

SEQ ID NO: 16019 - DNA, 20 bp, Artificial Sequence
  sgRNA
  Cldnd1_13
ccatacccaaaaacactcac

SEQ ID NO: 16020 - DNA, 20 bp, Artificial Sequence
  sgRNA
  Cldnd1_14
gtactctttccggttggtgt

SEQ ID NO: 16021 - DNA, 20 bp, Artificial Sequence
  sgRNA
  Cldnd1_15
tcagaaagtagagctgccca

SEQ ID NO: 16022 - DNA, 20 bp, Artificial Sequence
  sgRNA
  Cldnd1_16
gtgactcgaataaaatcgcc

SEQ ID NO: 16023 - DNA, 20 bp, Artificial Sequence
  sgRNA
  Cldnd1_17
tatgcgccaccggaaaggac

SEQ ID NO: 16024 - DNA, 20 bp, Artificial Sequence
  sgRNA
  Cldnd1_18
tcacaaacgcagtagcaaaa

SEQ ID NO: 16025 - DNA, 20 bp, Artificial Sequence
  sgRNA
  Cldnd1_19
aattctccagatacatcctt

SEQ ID NO: 16026 - DNA, 20 bp, Artificial Sequence
  sgRNA
  Cldnd1_20
ggctcccttacagttcatgg

SEQ ID NO: 16027 - DNA, 20 bp, Artificial Sequence
  sgRNA
  Clec12a_1
aactcaatcagtatggaaca

SEQ ID NO: 16028 - DNA, 20 bp, Artificial Sequence
  sgRNA
  Clec12a_2
gagattgtgcttcagctgta

SEQ ID NO: 16029 - DNA, 20 bp, Artificial Sequence
  sgRNA
  Clec12a_3
cagaagtctgacaaatgtgg

SEQ ID NO: 16030 - DNA, 20 bp, Artificial Sequence
  sgRNA
  Clec12a_4
gagctgtatagcaaagaacc

SEQ ID NO: 16031 - DNA, 20 bp, Artificial Sequence
  sgRNA
  Clec12a_5
ctgtgaatgggaagcatcgg

SEQ ID NO: 16032 - DNA, 20 bp, Artificial Sequence
  sgRNA
  Clec12a_6
gtactgcggatatatagaca

SEQ ID NO: 16033 - DNA, 20 bp, Artificial Sequence
  sgRNA
  Clec12a_7
atacagctctcggcacagct

SEQ ID NO: 16034 - DNA, 20 bp, Artificial Sequence
  sgRNA
  Clec12a_8
gacatagataagaagtactg

SEQ ID NO: 16035 - DNA, 20 bp, Artificial Sequence
  sgRNA
  Clec12a_9
agtactgcggatatatagac

SEQ ID NO: 16036 - DNA, 20 bp, Artificial Sequence
  sgRNA
  Clec12a_10
attggaatgggggtcttagg

SEQ ID NO: 16037 - DNA, 20 bp, Artificial Sequence
  sgRNA
  Clec12a_11
ggtggctgtgctttgcagca

SEQ ID NO: 16038 - DNA, 20 bp, Artificial Sequence
  sgRNA
  Clec12a_12
ttgctgtgaatgggaagcat

SEQ ID NO: 16039 - DNA, 20 bp, Artificial Sequence
  sgRNA
  Clec12a_13
tgtgttgaatggcctcccag

SEQ ID NO: 16040 - DNA, 20 bp, Artificial Sequence
  sgRNA
  Clec12a_14
cagctctcggcacagctggg

SEQ ID NO: 16041 - DNA, 20 bp, Artificial Sequence
  sgRNA
  Clec12a_15
tattctcaactcaatcagta

SEQ ID NO: 16042 - DNA, 20 bp, Artificial Sequence
  sgRNA
  Clec12a_16
ccagaagtctgacaaatgtg

SEQ ID NO: 16043 - DNA, 20 bp, Artificial Sequence
  sgRNA
  Clec12a_17
catgtccaaagggttcagaa

SEQ ID NO: 16044 - DNA, 20 bp, Artificial Sequence
  sgRNA
  Clec12a_18
ccattccaatgaacagcaga

SEQ ID NO: 16045 - DNA, 20 bp, Artificial Sequence
  sgRNA
  Clec12a_19
cattctgaaccctttggaca

SEQ ID NO: 16046 - DNA, 20 bp, Artificial Sequence
  sgRNA
  Clec12a_20
cctcctgaaggttaagaaca

SEQ ID NO: 16047 - DNA, 20 bp, Artificial Sequence
  sgRNA
  Clec12b_1
aagtcaaattaccagaagcg

SEQ ID NO: 16048 - DNA, 20 bp, Artificial Sequence
  sgRNA
  Clec12b_2
gctgtcaatcttcaccagag

SEQ ID NO: 16049 - DNA, 20 bp, Artificial Sequence
  sgRNA
  Clec12b_3
ggcagcgcctcgccaaagtg

SEQ ID NO: 16050 - DNA, 20 bp, Artificial Sequence
  sgRNA
  Clec12b_4
aggactctgcaagagtgagg

SEQ ID NO: 16051 - DNA, 20 bp, Artificial Sequence
  sgRNA
  Clec12b_5
gctcaatcctcactttggcg

SEQ ID NO: 16052 - DNA, 20 bp, Artificial Sequence
  sgRNA
  Clec12b_6
tgttaccagcaccaaacaga

SEQ ID NO: 16053 - DNA, 20 bp, Artificial Sequence
  sgRNA
  Clec12b_7
ctccagaaagagtctgacgg

SEQ ID NO: 16054 - DNA, 20 bp, Artificial Sequence
  sgRNA
  Clec12b_8
agatctctgccctactggag

SEQ ID NO: 16055 - DNA, 20 bp, Artificial Sequence
  sgRNA
  Clec12b_9
tcaggactctgcaagagtga

SEQ ID NO: 16056 - DNA, 20 bp, Artificial Sequence
  sgRNA
  Clec12b_10
cttgtcccaagacatggcaa

SEQ ID NO: 16057 - DNA, 20 bp, Artificial Sequence
  sgRNA
  Clec12b_11
caaatcttcaatcttcacca

SEQ ID NO: 16058 - DNA, 20 bp, Artificial Sequence
  sgRNA
  Clec12b_12
gattgacagcaccgaagaaa

SEQ ID NO: 16059 - DNA, 20 bp, Artificial Sequence
  sgRNA
  Clec12b_13
ctctcttctcacaaatccaa

SEQ ID NO: 16060 - DNA, 20 bp, Artificial Sequence
  sgRNA
  Clec12b_14
gcaacccttgtcccaagaca

SEQ ID NO: 16061 - DNA, 20 bp, Artificial Sequence
  sgRNA
  Clec12b_15
tctgctcctgcctctccagt

SEQ ID NO: 16062 - DNA, 20 bp, Artificial Sequence
  sgRNA
  Clec12b_16
ctgttaccagcaccaaacag

SEQ ID NO: 16063 - DNA, 20 bp, Artificial Sequence
  sgRNA
  Clec12b_17
gagtttgatgaccctctgtt

SEQ ID NO: 16064 - DNA, 20 bp, Artificial Sequence
  sgRNA
  Clec12b_18
gatggctaccaaactctgca

SEQ ID NO: 16065 - DNA, 20 bp, Artificial Sequence
  sgRNA
  Clec12b_19
gctctcttctcacaaatcca

SEQ ID NO: 16066 - DNA, 20 bp, Artificial Sequence
  sgRNA
  Clec12b_20
gctgtcgtgctgaaatccct

SEQ ID NO: 16067 - DNA, 20 bp, Artificial Sequence
  sgRNA
  Clec14a_1
aagaacagctaaccctcgag

SEQ ID NO: 16068 - DNA, 20 bp, Artificial Sequence
  sgRNA
  Clec14a_2
cctgactgtctagatcactt

SEQ ID NO: 16069 - DNA, 20 bp, Artificial Sequence
  sgRNA
  Clec14a_3
ttggaaactcaaattagagg

SEQ ID NO: 16070 - DNA, 20 bp, Artificial Sequence
  sgRNA
  Clec14a_4
agaggacagcccactaccgt

SEQ ID NO: 16071 - DNA, 20 bp, Artificial Sequence
  sgRNA
  Clec14a_5
agatctttggagcctccgcc

SEQ ID NO: 16072 - DNA, 20 bp, Artificial Sequence
  sgRNA
  Clec14a_6
cccttctcttgaaggtagcg

SEQ ID NO: 16073 - DNA, 20 bp, Artificial Sequence
  sgRNA
  Clec14a_7
gactttcgacacctcttcca

SEQ ID NO: 16074 - DNA, 20 bp, Artificial Sequence
  sgRNA
  Clec14a_8
tgctctgcccctgttccggg

SEQ ID NO: 16075 - DNA, 20 bp, Artificial Sequence
  sgRNA
  Clec14a_9
gtacttgcataggtagccat

SEQ ID NO: 16076 - DNA, 20 bp, Artificial Sequence
  sgRNA
  Clec14a_10
tcttgaccattacagtgctg

SEQ ID NO: 16077 - DNA, 20 bp, Artificial Sequence
  sgRNA
  Clec14a_11
tgtagaactgtggtgcaaag

SEQ ID NO: 16078 - DNA, 20 bp, Artificial Sequence
  sgRNA
  Clec14a_12
ttcaggaccacgcttcctga

SEQ ID NO: 16079 - DNA, 20 bp, Artificial Sequence
  sgRNA
  Clec14a_13
ggtgagtgcgatgtgtcctg

SEQ ID NO: 16080 - DNA, 20 bp, Artificial Sequence
  sgRNA
  Clec14a_14
aaggctgtagcaagcccccg

SEQ ID NO: 16081 - DNA, 20 bp, Artificial Sequence
  sgRNA
  Clec14a_15
cagaggacagcccactaccg

SEQ ID NO: 16082 - DNA, 20 bp, Artificial Sequence
  sgRNA
  Clec14a_16
tcgaaagtcagagaaacagg

SEQ ID NO: 16083 - DNA, 20 bp, Artificial Sequence
  sgRNA
  Clec14a_17
tgtcgaaagtcagagaaaca

SEQ ID NO: 16084 - DNA, 20 bp, Artificial Sequence
  sgRNA
  Clec14a_18
acaagctgcgcgatcggccg

SEQ ID NO: 16085 - DNA, 20 bp, Artificial Sequence
  sgRNA
  Clec14a_19
ggaggtacctcccggaacag

SEQ ID NO: 16086 - DNA, 20 bp, Artificial Sequence
  sgRNA
  Clec14a_20
cgttgtggctcttccaccca

SEQ ID NO: 16087 - DNA, 20 bp, Artificial Sequence
  sgRNA
  Clec1a_1
agaatgcagacttacacaca

SEQ ID NO: 16088 - DNA, 20 bp, Artificial Sequence
  sgRNA
  Clec1a_2
tccagaatacaggcttatgg

SEQ ID NO: 16089 - DNA, 20 bp, Artificial Sequence
  sgRNA
  Clec1a_3
actcattgaaactctacagc

SEQ ID NO: 16090 - DNA, 20 bp, Artificial Sequence
  sgRNA
  Clec1a_4
gaactttacaacaaaagtgg

SEQ ID NO: 16091 - DNA, 20 bp, Artificial Sequence
  sgRNA
  Clec1a_5
gtaagcctttccattgaaga

SEQ ID NO: 16092 - DNA, 20 bp, Artificial Sequence
  sgRNA
  Clec1a_6
ctcttcagtttggcgcccag

SEQ ID NO: 16093 - DNA, 20 bp, Artificial Sequence
  sgRNA
  Clec1a_7
caccaaacacaaggtcagca

SEQ ID NO: 16094 - DNA, 20 bp, Artificial Sequence
  sgRNA
  Clec1a_8
cttgctggatattagacagc

SEQ ID NO: 16095 - DNA, 20 bp, Artificial Sequence
  sgRNA
  Clec1a_9
tcccaccaacctaagaaaca

SEQ ID NO: 16096 - DNA, 20 bp, Artificial Sequence
  sgRNA
  Clec1a_10
tgtcccatctgtccacagcc

SEQ ID NO: 16097 - DNA, 20 bp, Artificial Sequence
  sgRNA
  Clec1a_11
gtgcctgtgagaggatagca

SEQ ID NO: 16098 - DNA, 20 bp, Artificial Sequence
  sgRNA
  Clec1a_12
ctaaggactgcaaagagctg

SEQ ID NO: 16099 - DNA, 20 bp, Artificial Sequence
  sgRNA
  Clec1a_13
gcagtggcaaagcctggctg

SEQ ID NO: 16100 - DNA, 20 bp, Artificial Sequence
  sgRNA
  Clec1a_14
gagttgtgaatacttctgcc

SEQ ID NO: 16101 - DNA, 20 bp, Artificial Sequence
  sgRNA
  Clec1a_15
tcaccagacgtgcagagccc

SEQ ID NO: 16102 - DNA, 20 bp, Artificial Sequence
  sgRNA
  Clec1a_16
catgctgaagataagcacac

SEQ ID NO: 16103 - DNA, 20 bp, Artificial Sequence
  sgRNA
  Clec1a_17
actgggcgccaaactgaaga

SEQ ID NO: 16104 - DNA, 20 bp, Artificial Sequence
  sgRNA
  Clec1a_18
gactgtatgaccatcttcaa

SEQ ID NO: 16105 - DNA, 20 bp, Artificial Sequence
  sgRNA
  Clec1a_19
gcagtccttgcccagaaaaa

SEQ ID NO: 16106 - DNA, 20 bp, Artificial Sequence
  sgRNA
  Clec1a_20
tgtgcctgtgagaggatagc

SEQ ID NO: 16107 - DNA, 20 bp, Artificial Sequence
  sgRNA
  Clec1b_1
cttcaggcgtaacctaacat

SEQ ID NO: 16108 - DNA, 20 bp, Artificial Sequence
  sgRNA
  Clec1b_2
gccacgaagtggagatacca

SEQ ID NO: 16109 - DNA, 20 bp, Artificial Sequence
  sgRNA
  Clec1b_3
acagcaaaagtatctactgg

SEQ ID NO: 16110 - DNA, 20 bp, Artificial Sequence
  sgRNA
  Clec1b_4
catcacacgccaccaagaag

SEQ ID NO: 16111 - DNA, 20 bp, Artificial Sequence
  sgRNA
  Clec1b_5
ggcgtgataatccaatccaa

SEQ ID NO: 16112 - DNA, 20 bp, Artificial Sequence
  sgRNA
  Clec1b_6
gctcagttcttcgcaagaac

SEQ ID NO: 16113 - DNA, 20 bp, Artificial Sequence
  sgRNA
  Clec1b_7
gagtccaacaaccagcccca

SEQ ID NO: 16114 - DNA, 20 bp, Artificial Sequence
  sgRNA
  Clec1b_8
gctgatctcatccatggggc

SEQ ID NO: 16115 - DNA, 20 bp, Artificial Sequence
  sgRNA
  Clec1b_9
acccgtagcaactatctcca

SEQ ID NO: 16116 - DNA, 20 bp, Artificial Sequence
  sgRNA
  Clec1b_10
gttctgctgatctcatccat

SEQ ID NO: 16117 - DNA, 20 bp, Artificial Sequence
  sgRNA
  Clec1b_11
tcactttaaacatcaagccc

SEQ ID NO: 16118 - DNA, 20 bp, Artificial Sequence
  sgRNA
  Clec1b_12
agttctgctgatctcatcca

SEQ ID NO: 16119 - DNA, 20 bp, Artificial Sequence
  sgRNA
  Clec1b_13
gtatctccacttcgtggcgc

SEQ ID NO: 16120 - DNA, 20 bp, Artificial Sequence
  sgRNA
  Clec1b_14
atctccacttcgtggcgcag

SEQ ID NO: 16121 - DNA, 20 bp, Artificial Sequence
  sgRNA
  Clec1b_15
acacgccaccaagaagaggc

SEQ ID NO: 16122 - DNA, 20 bp, Artificial Sequence
  sgRNA
  Clec1b_16
ttctgctgatctcatccatg

SEQ ID NO: 16123 - DNA, 20 bp, Artificial Sequence
  sgRNA
  Clec1b_17
gagctgagagcttgtttccg

SEQ ID NO: 16124 - DNA, 20 bp, Artificial Sequence
  sgRNA
  Clec1b_18
cggaacctgcctcttcttgg

SEQ ID NO: 16125 - DNA, 20 bp, Artificial Sequence
  sgRNA
  Clec1b_19
gcttgctctcttcccatgtt

SEQ ID NO: 16126 - DNA, 20 bp, Artificial Sequence
  sgRNA
  Clec1b_20
tatctccacttcgtggcgca

SEQ ID NO: 16127 - DNA, 20 bp, Artificial Sequence
  sgRNA
  Clec2d_1
aagcttagcacaagactcag

SEQ ID NO: 16128 - DNA, 20 bp, Artificial Sequence
  sgRNA
  Clec2d_2
gggcgaatgtccagttactt

SEQ ID NO: 16129 - DNA, 20 bp, Artificial Sequence
  sgRNA
  Clec2d_3
actagctcggtttgacaacc

SEQ ID NO: 16130 - DNA, 20 bp, Artificial Sequence
  sgRNA
  Clec2d_4
ttacccacttctacctcctg

SEQ ID NO: 16131 - DNA, 20 bp, Artificial Sequence
  sgRNA
  Clec2d_5
ctacctatgcttagtcccac

SEQ ID NO: 16132 - DNA, 20 bp, Artificial Sequence
  sgRNA
  Clec2d_6
gtaccaggatctattcactt

SEQ ID NO: 16133 - DNA, 20 bp, Artificial Sequence
  sgRNA
  Clec2d_7
aggcaaatctttcctctccc

SEQ ID NO: 16134 - DNA, 20 bp, Artificial Sequence
  sgRNA
  Clec2d_8
aagtaactggacattcgccc

SEQ ID NO: 16135 - DNA, 20 bp, Artificial Sequence
  sgRNA
  Clec2d_9
gatcccgttgttgttcaggt

SEQ ID NO: 16136 - DNA, 20 bp, Artificial Sequence
  sgRNA
  Clec2d_10
tttgcctacctgaacaacaa

SEQ ID NO: 16137 - DNA, 20 bp, Artificial Sequence
  sgRNA
  Clec2d_11
ctgcctgtgggactaagcat

SEQ ID NO: 16138 - DNA, 20 bp, Artificial Sequence
  sgRNA
  Clec2d_12
tgtgggactaagcataggta

SEQ ID NO: 16139 - DNA, 20 bp, Artificial Sequence
  sgRNA
  Clec2d_13
aaatctttcctctccccgga

SEQ ID NO: 16140 - DNA, 20 bp, Artificial Sequence
  sgRNA
  Clec2d_14
attctccaaggaaaaaggca

SEQ ID NO: 16141 - DNA, 20 bp, Artificial Sequence
  sgRNA
  Clec2d_15
ttgcctacctgaacaacaac

SEQ ID NO: 16142 - DNA, 20 bp, Artificial Sequence
  sgRNA
  Clec2d_16
gaaaaaaaggagtttggcag

SEQ ID NO: 16143 - DNA, 20 bp, Artificial Sequence
  sgRNA
  Clec2d_17
gtaaaattctccaaggaaaa

SEQ ID NO: 16144 - DNA, 20 bp, Artificial Sequence
  sgRNA
  Clec2d_18
gcagcataggtcttgttgac

SEQ ID NO: 16145 - DNA, 20 bp, Artificial Sequence
  sgRNA
  Clec2d_19
tacccacttctacctcctgc

SEQ ID NO: 16146 - DNA, 20 bp, Artificial Sequence
  sgRNA
  Clec2d_20
aaagcttagcacaagactca

SEQ ID NO: 16147 - DNA, 20 bp, Artificial Sequence
  sgRNA
  Clec2e_1
aagtttaacacaagatgcag

SEQ ID NO: 16148 - DNA, 20 bp, Artificial Sequence
  sgRNA
  Clec2e_2
ggcatctagtgctatgcagg

SEQ ID NO: 16149 - DNA, 20 bp, Artificial Sequence
  sgRNA
  Clec2e_3
cttgagcatacagcatagca

SEQ ID NO: 16150 - DNA, 20 bp, Artificial Sequence
  sgRNA
  Clec2e_4
agctctatttgacagcttgg

SEQ ID NO: 16151 - DNA, 20 bp, Artificial Sequence
  sgRNA
  Clec2e_5
ggggatctacaacagcagtg

SEQ ID NO: 16152 - DNA, 20 bp, Artificial Sequence
  sgRNA
  Clec2e_6
gtgcctacttgagtaacagg

SEQ ID NO: 16153 - DNA, 20 bp, Artificial Sequence
  sgRNA
  Clec2e_7
gtggggatatacataaaaaa

SEQ ID NO: 16154 - DNA, 20 bp, Artificial Sequence
  sgRNA
  Clec2e_8
gatccccctgttactcaagt

SEQ ID NO: 16155 - DNA, 20 bp, Artificial Sequence
  sgRNA
  Clec2e_9
atgtgcctacttgagtaaca

SEQ ID NO: 16156 - DNA, 20 bp, Artificial Sequence
  sgRNA
  Clec2e_10
tgtgcctacttgagtaacag

SEQ ID NO: 16157 - DNA, 20 bp, Artificial Sequence
  sgRNA
  Clec2e_11
gctgtcaaatagagctagat

SEQ ID NO: 16158 - DNA, 20 bp, Artificial Sequence
  sgRNA
  Clec2e_12
gccccagactgcctgcagga

SEQ ID NO: 16159 - DNA, 20 bp, Artificial Sequence
  sgRNA
  Clec2e_13
gggggatctacaacagcagt

SEQ ID NO: 16160 - DNA, 20 bp, Artificial Sequence
  sgRNA
  Clec2e_14
tgctatgctgtatgctcaag

SEQ ID NO: 16161 - DNA, 20 bp, Artificial Sequence
  sgRNA
  Clec2e_15
gagcaactacagctacagta

SEQ ID NO: 16162 - DNA, 20 bp, Artificial Sequence
  sgRNA
  Clec2e_16
agggggatctacaacagcag

SEQ ID NO: 16163 - DNA, 20 bp, Artificial Sequence
  sgRNA
  Clec2e_17
gcaggcagtctggggcagtg

SEQ ID NO: 16164 - DNA, 20 bp, Artificial Sequence
  sgRNA
  Clec2e_18
aaggttgaagaggcttccat

SEQ ID NO: 16165 - DNA, 20 bp, Artificial Sequence
  sgRNA
  Clec2e_19
cactgccccagactgcctgc

SEQ ID NO: 16166 - DNA, 20 bp, Artificial Sequence
  sgRNA
  Clec2e_20
aggcacattctcctcctcct

SEQ ID NO: 16167 - DNA, 20 bp, Artificial Sequence
  sgRNA
  Clec2g_1
atttcctagggagatacgag

SEQ ID NO: 16168 - DNA, 20 bp, Artificial Sequence
  sgRNA
  Clec2g_2
aagcttagcagaagactcag

SEQ ID NO: 16169 - DNA, 20 bp, Artificial Sequence
  sgRNA
  Clec2g_3
gaaagctcccccggaactgg

SEQ ID NO: 16170 - DNA, 20 bp, Artificial Sequence
  sgRNA
  Clec2g_4
attcgcccagaccttctgca

SEQ ID NO: 16171 - DNA, 20 bp, Artificial Sequence
  sgRNA
  Clec2g_5
ttgctacagatccatatccg

SEQ ID NO: 16172 - DNA, 20 bp, Artificial Sequence
  sgRNA
  Clec2g_6
gttccaggcactatatacct

SEQ ID NO: 16173 - DNA, 20 bp, Artificial Sequence
  sgRNA
  Clec2g_7
aatttcctagggagatacga

SEQ ID NO: 16174 - DNA, 20 bp, Artificial Sequence
  sgRNA
  Clec2g_8
aatgtacacctccagttccg

SEQ ID NO: 16175 - DNA, 20 bp, Artificial Sequence
  sgRNA
  Clec2g_9
gcttagacgacgctctgtgc

SEQ ID NO: 16176 - DNA, 20 bp, Artificial Sequence
  sgRNA
  Clec2g_10
tgttgtctgtccacatccaa

SEQ ID NO: 16177 - DNA, 20 bp, Artificial Sequence
  sgRNA
  Clec2g_11
caccacttgcagctgcagga

SEQ ID NO: 16178 - DNA, 20 bp, Artificial Sequence
  sgRNA
  Clec2g_12
atgtacacctccagttccgg

SEQ ID NO: 16179 - DNA, 20 bp, Artificial Sequence
  sgRNA
  Clec2g_13
ctgcaagtggtgttgagcat

SEQ ID NO: 16180 - DNA, 20 bp, Artificial Sequence
  sgRNA
  Clec2g_14
gtgttgtctgtccacatcca

SEQ ID NO: 16181 - DNA, 20 bp, Artificial Sequence
  sgRNA
  Clec2g_15
gcttgcccgaaaaactggat

SEQ ID NO: 16182 - DNA, 20 bp, Artificial Sequence
  sgRNA
  Clec2g_16
gagcgtcgtctaagcaccct

SEQ ID NO: 16183 - DNA, 20 bp, Artificial Sequence
  sgRNA
  Clec2g_17
gaagaaggcgaaagctcccc

SEQ ID NO: 16184 - DNA, 20 bp, Artificial Sequence
  sgRNA
  Clec2g_18
gtgcctacctgagcggcaat

SEQ ID NO: 16185 - DNA, 20 bp, Artificial Sequence
  sgRNA
  Clec2g_19
agtggtgttgagcataggta

SEQ ID NO: 16186 - DNA, 20 bp, Artificial Sequence
  sgRNA
  Clec2g_20
gatcccattgccgctcaggt

SEQ ID NO: 16187 - DNA, 20 bp, Artificial Sequence
  sgRNA
  Clec2h_1
ggaatttgatgctacgcagg

SEQ ID NO: 16188 - DNA, 20 bp, Artificial Sequence
  sgRNA
  Clec2h_2
tgctacaccgcatgcccaag

SEQ ID NO: 16189 - DNA, 20 bp, Artificial Sequence
  sgRNA
  Clec2h_3
agcactgtttcacagcctgg

SEQ ID NO: 16190 - DNA, 20 bp, Artificial Sequence
  sgRNA
  Clec2h_4
gctgcagactgcctgcagga

SEQ ID NO: 16191 - DNA, 20 bp, Artificial Sequence
  sgRNA
  Clec2h_5
agtgataatgggatcagcag

SEQ ID NO: 16192 - DNA, 20 bp, Artificial Sequence
  sgRNA
  Clec2h_6
ccagagtaggaagtgtacca

SEQ ID NO: 16193 - DNA, 20 bp, Artificial Sequence
  sgRNA
  Clec2h_7
ggagctacacacataggaag

SEQ ID NO: 16194 - DNA, 20 bp, Artificial Sequence
  sgRNA
  Clec2h_8
gctgtgttgatgctctgtgc

SEQ ID NO: 16195 - DNA, 20 bp, Artificial Sequence
  sgRNA
  Clec2h_9
gcaaggttcacggtcttcca

SEQ ID NO: 16196 - DNA, 20 bp, Artificial Sequence
  sgRNA
  Clec2h_10
ccaaatccaatccagccact

SEQ ID NO: 16197 - DNA, 20 bp, Artificial Sequence
  sgRNA
  Clec2h_11
ggctgtgaaacagtgctaga

SEQ ID NO: 16198 - DNA, 20 bp, Artificial Sequence
  sgRNA
  Clec2h_12
gcaggcagtctgcagcagtg

SEQ ID NO: 16199 - DNA, 20 bp, Artificial Sequence
  sgRNA
  Clec2h_13
tacgcaggaggactgactga

SEQ ID NO: 16200 - DNA, 20 bp, Artificial Sequence
  sgRNA
  Clec2h_14
tgctgatcccattatcactc

SEQ ID NO: 16201 - DNA, 20 bp, Artificial Sequence
  sgRNA
  Clec2h_15
gagaaataaaatcccagcca

SEQ ID NO: 16202 - DNA, 20 bp, Artificial Sequence
  sgRNA
  Clec2h_16
cttgggcatgcggtgtagca

SEQ ID NO: 16203 - DNA, 20 bp, Artificial Sequence
  sgRNA
  Clec2h_17
ctctgtgcaggccaatccag

SEQ ID NO: 16204 - DNA, 20 bp, Artificial Sequence
  sgRNA
  Clec2h_18
gctgtgaaacagtgctagat

SEQ ID NO: 16205 - DNA, 20 bp, Artificial Sequence
  sgRNA
  Clec2h_19
cactgctgcagactgcctgc

SEQ ID NO: 16206 - DNA, 20 bp, Artificial Sequence
  sgRNA
  Clec2h_20
gtggcaggagctacacacat

SEQ ID NO: 16207 - DNA, 20 bp, Artificial Sequence
  sgRNA
  Clec2i_1
gggcaaatgtccagttacgt

SEQ ID NO: 16208 - DNA, 20 bp, Artificial Sequence
  sgRNA
  Clec2i_2
tgcacacctccagttccaag

SEQ ID NO: 16209 - DNA, 20 bp, Artificial Sequence
  sgRNA
  Clec2i_3
gcttgctcaaaaaactggac

SEQ ID NO: 16210 - DNA, 20 bp, Artificial Sequence
  sgRNA
  Clec2i_4
agctcggtttgacaacgagg

SEQ ID NO: 16211 - DNA, 20 bp, Artificial Sequence
  sgRNA
  Clec2i_5
tttcctaaagagattcaagg

SEQ ID NO: 16212 - DNA, 20 bp, Artificial Sequence
  sgRNA
  Clec2i_6
aggcatatcttcccactcct

SEQ ID NO: 16213 - DNA, 20 bp, Artificial Sequence
  sgRNA
  Clec2i_7
gagaaattccaaaagcttgg

SEQ ID NO: 16214 - DNA, 20 bp, Artificial Sequence
  sgRNA
  Clec2i_8
tgttgtttgtccacttccaa

SEQ ID NO: 16215 - DNA, 20 bp, Artificial Sequence
  sgRNA
  Clec2i_9
ggagctatataaatcggatg

SEQ ID NO: 16216 - DNA, 20 bp, Artificial Sequence
  sgRNA
  Clec2i_10
ttgcacacctccagttccaa

SEQ ID NO: 16217 - DNA, 20 bp, Artificial Sequence
  sgRNA
  Clec2i_11
atgcctacctgagcagcgat

SEQ ID NO: 16218 - DNA, 20 bp, Artificial Sequence
  sgRNA
  Clec2i_12
acgtaactggacatttgccc

SEQ ID NO: 16219 - DNA, 20 bp, Artificial Sequence
  sgRNA
  Clec2i_13
tgggcaaatgtccagttacg

SEQ ID NO: 16220 - DNA, 20 bp, Artificial Sequence
  sgRNA
  Clec2i_14
tatcttcccactcctaggat

SEQ ID NO: 16221 - DNA, 20 bp, Artificial Sequence
  sgRNA
  Clec2i_15
atatcttcccactcctagga

SEQ ID NO: 16222 - DNA, 20 bp, Artificial Sequence
  sgRNA
  Clec2i_16
gttcgaggagctatataaat

SEQ ID NO: 16223 - DNA, 20 bp, Artificial Sequence
  sgRNA
  Clec2i_17
aatggaccccttggaactgg

SEQ ID NO: 16224 - DNA, 20 bp, Artificial Sequence
  sgRNA
  Clec2i_18
gatcctatcgctgctcaggt

SEQ ID NO: 16225 - DNA, 20 bp, Artificial Sequence
  sgRNA
  Clec2i_19
gcgataggatcagcagttcg

SEQ ID NO: 16226 - DNA, 20 bp, Artificial Sequence
  sgRNA
  Clec2i_20
tcaaaaaactggactggagt

SEQ ID NO: 16227 - DNA, 20 bp, Artificial Sequence
  sgRNA
  Clec4g_1
gctttgtgctgtatcccatg

SEQ ID NO: 16228 - DNA, 20 bp, Artificial Sequence
  sgRNA
  Clec4g_2
aatgagagcccatagaactg

SEQ ID NO: 16229 - DNA, 20 bp, Artificial Sequence
  sgRNA
  Clec4g_3
gtccttaaactccgccagtg

SEQ ID NO: 16230 - DNA, 20 bp, Artificial Sequence
  sgRNA
  Clec4g_4
ctgaaagaactgcaagagcg

SEQ ID NO: 16231 - DNA, 20 bp, Artificial Sequence
  sgRNA
  Clec4g_5
agtcagcacacacgtggccg

SEQ ID NO: 16232 - DNA, 20 bp, Artificial Sequence
  sgRNA
  Clec4g_6
tcagacccaaccaatagccc

SEQ ID NO: 16233 - DNA, 20 bp, Artificial Sequence
  sgRNA
  Clec4g_7
atgagaaaagaacccccgag

SEQ ID NO: 16234 - DNA, 20 bp, Artificial Sequence
  sgRNA
  Clec4g_8
gtgaggctccatctacccac

SEQ ID NO: 16235 - DNA, 20 bp, Artificial Sequence
  sgRNA
  Clec4g_9
caagattcaaggctaccggt

SEQ ID NO: 16236 - DNA, 20 bp, Artificial Sequence
  sgRNA
  Clec4g_10
acaagattcaaggctaccgg

SEQ ID NO: 16237 - DNA, 20 bp, Artificial Sequence
  sgRNA
  Clec4g_11
tctatgctagggctcctgag

SEQ ID NO: 16238 - DNA, 20 bp, Artificial Sequence
  sgRNA
  Clec4g_12
gtatcatgatgctgcactcg

SEQ ID NO: 16239 - DNA, 20 bp, Artificial Sequence
  sgRNA
  Clec4g_13
tgtctcagagaaatagtagc

SEQ ID NO: 16240 - DNA, 20 bp, Artificial Sequence
  sgRNA
  Clec4g_14
ctatctcaaggccatttcca

SEQ ID NO: 16241 - DNA, 20 bp, Artificial Sequence
  sgRNA
  Clec4g_15
aatcagagatatctatgcta

SEQ ID NO: 16242 - DNA, 20 bp, Artificial Sequence
  sgRNA
  Clec4g_16
gtaccaatgagagagatggc

SEQ ID NO: 16243 - DNA, 20 bp, Artificial Sequence
  sgRNA
  Clec4g_17
gcaattgaagaggtctccag

SEQ ID NO: 16244 - DNA, 20 bp, Artificial Sequence
  sgRNA
  Clec4g_18
gcagttgcaaaccacactgg

SEQ ID NO: 16245 - DNA, 20 bp, Artificial Sequence
  sgRNA
  Clec4g_19
ggagagcccaatgattccag

SEQ ID NO: 16246 - DNA, 20 bp, Artificial Sequence
  sgRNA
  Clec4g_20
ggctacatgcacacagccag

SEQ ID NO: 16247 - DNA, 20 bp, Artificial Sequence
  sgRNA
  Clec5a_1
agtggttccgtagctctccg

SEQ ID NO: 16248 - DNA, 20 bp, Artificial Sequence
  sgRNA
  Clec5a_2
acgaaagtaccatgcctaca

SEQ ID NO: 16249 - DNA, 20 bp, Artificial Sequence
  sgRNA
  Clec5a_3
agtgttgacaattgccagtg

SEQ ID NO: 16250 - DNA, 20 bp, Artificial Sequence
  sgRNA
  Clec5a_4
tccagtctgtcccagaaact

SEQ ID NO: 16251 - DNA, 20 bp, Artificial Sequence
  sgRNA
  Clec5a_5
tggttccgtagctctccgtg

SEQ ID NO: 16252 - DNA, 20 bp, Artificial Sequence
  sgRNA
  Clec5a_6
attggtttggtacgtcagcc

SEQ ID NO: 16253 - DNA, 20 bp, Artificial Sequence
  sgRNA
  Clec5a_7
gtagtagtgatcaaagttgt

SEQ ID NO: 16254 - DNA, 20 bp, Artificial Sequence
  sgRNA
  Clec5a_8
atcaccttggaaagacagca

SEQ ID NO: 16255 - DNA, 20 bp, Artificial Sequence
  sgRNA
  Clec5a_9
taatgatggcttcgtcccca

SEQ ID NO: 16256 - DNA, 20 bp, Artificial Sequence
  sgRNA
  Clec5a_10
tctccttctccgaatcacct

SEQ ID NO: 16257 - DNA, 20 bp, Artificial Sequence
  sgRNA
  Clec5a_11
ttcgtccccacggagagcta

SEQ ID NO: 16258 - DNA, 20 bp, Artificial Sequence
  sgRNA
  Clec5a_12
accatgcctacaaggagcta

SEQ ID NO: 16259 - DNA, 20 bp, Artificial Sequence
  sgRNA
  Clec5a_13
gtcagcctggagagaaaaag

SEQ ID NO: 16260 - DNA, 20 bp, Artificial Sequence
  sgRNA
  Clec5a_14
tgcaacacaaggatccacac

SEQ ID NO: 16261 - DNA, 20 bp, Artificial Sequence
  sgRNA
  Clec5a_15
gtggttccgtagctctccgt

SEQ ID NO: 16262 - DNA, 20 bp, Artificial Sequence
  sgRNA
  Clec5a_16
catgtgaagtcagctatcgc

SEQ ID NO: 16263 - DNA, 20 bp, Artificial Sequence
  sgRNA
  Clec5a_17
ctggagagaaaaagtggcgc

SEQ ID NO: 16264 - DNA, 20 bp, Artificial Sequence
  sgRNA
  Clec5a_18
gtcgaagttctggtcctgat

SEQ ID NO: 16265 - DNA, 20 bp, Artificial Sequence
  sgRNA
  Clec5a_19
taatccatgctgtctttcca

SEQ ID NO: 16266 - DNA, 20 bp, Artificial Sequence
  sgRNA
  Clec5a_20
aagtatcttcaggacatagc

SEQ ID NO: 16267 - DNA, 20 bp, Artificial Sequence
  sgRNA
  Clec7a_1
catgcatgatccaattagga

SEQ ID NO: 16268 - DNA, 20 bp, Artificial Sequence
  sgRNA
  Clec7a_2
gacatccataaaaggcccag

SEQ ID NO: 16269 - DNA, 20 bp, Artificial Sequence
  sgRNA
  Clec7a_3
cagtagatgagcacctagct

SEQ ID NO: 16270 - DNA, 20 bp, Artificial Sequence
  sgRNA
  Clec7a_4
ccactactaccacaaagcac

SEQ ID NO: 16271 - DNA, 20 bp, Artificial Sequence
  sgRNA
  Clec7a_5
gatccatcctcccagaacca

SEQ ID NO: 16272 - DNA, 20 bp, Artificial Sequence
  sgRNA
  Clec7a_6
agacatccataaaaggccca

SEQ ID NO: 16273 - DNA, 20 bp, Artificial Sequence
  sgRNA
  Clec7a_7
tttcccgcaatcagagtgaa

SEQ ID NO: 16274 - DNA, 20 bp, Artificial Sequence
  sgRNA
  Clec7a_8
tgaagggccatggttctggg

SEQ ID NO: 16275 - DNA, 20 bp, Artificial Sequence
  sgRNA
  Clec7a_9
gcaatcagagtgaagggcca

SEQ ID NO: 16276 - DNA, 20 bp, Artificial Sequence
  sgRNA
  Clec7a_10
gcactcaagacatccataaa

SEQ ID NO: 16277 - DNA, 20 bp, Artificial Sequence
  sgRNA
  Clec7a_11
gtagtttgggatgccttgga

SEQ ID NO: 16278 - DNA, 20 bp, Artificial Sequence
  sgRNA
  Clec7a_12
tgtatggattcatggatcag

SEQ ID NO: 16279 - DNA, 20 bp, Artificial Sequence
  sgRNA
  Clec7a_13
tggcccttcactctgattgc

SEQ ID NO: 16280 - DNA, 20 bp, Artificial Sequence
  sgRNA
  Clec7a_14
cctgtgctttgtggtagtag

SEQ ID NO: 16281 - DNA, 20 bp, Artificial Sequence
  sgRNA
  Clec7a_15
attcctaaacccactgcaat

SEQ ID NO: 16282 - DNA, 20 bp, Artificial Sequence
  sgRNA
  Clec7a_16
tccaaggcatcccaaactac

SEQ ID NO: 16283 - DNA, 20 bp, Artificial Sequence
  sgRNA
  Clec7a_17
aagacatccataaaaggccc

SEQ ID NO: 16284 - DNA, 20 bp, Artificial Sequence
  sgRNA
  Clec7a_18
aatttcctgagaagctaaat

SEQ ID NO: 16285 - DNA, 20 bp, Artificial Sequence
  sgRNA
  Clec7a_19
gccaggctccatcttcacct

SEQ ID NO: 16286 - DNA, 20 bp, Artificial Sequence
  sgRNA
  Clec7a_20
ccttggaggcccattgcagt

SEQ ID NO: 16287 - DNA, 20 bp, Artificial Sequence
  sgRNA
  Clec9a_1
cattggtgaaccttacacag

SEQ ID NO: 16288 - DNA, 20 bp, Artificial Sequence
  sgRNA
  Clec9a_2
attacctgaacatttgctag

SEQ ID NO: 16289 - DNA, 20 bp, Artificial Sequence
  sgRNA
  Clec9a_3
caagcccatacagaccacac

SEQ ID NO: 16290 - DNA, 20 bp, Artificial Sequence
  sgRNA
  Clec9a_4
gttactatgtctttgaacgc

SEQ ID NO: 16291 - DNA, 20 bp, Artificial Sequence
  sgRNA
  Clec9a_5
gcagaaagacagcgatcagc

SEQ ID NO: 16292 - DNA, 20 bp, Artificial Sequence
  sgRNA
  Clec9a_6
catccaacaggacacagcat

SEQ ID NO: 16293 - DNA, 20 bp, Artificial Sequence
  sgRNA
  Clec9a_7
gcaggaaagactcatccaac

SEQ ID NO: 16294 - DNA, 20 bp, Artificial Sequence
  sgRNA
  Clec9a_8
aggaatgtcccactgaagag

SEQ ID NO: 16295 - DNA, 20 bp, Artificial Sequence
  sgRNA
  Clec9a_9
gaggtatccacagatctggc

SEQ ID NO: 16296 - DNA, 20 bp, Artificial Sequence
  sgRNA
  Clec9a_10
agcagtatagggaaactcaa

SEQ ID NO: 16297 - DNA, 20 bp, Artificial Sequence
  sgRNA
  Clec9a_11
tcaccaatgctgtgtcctgt

SEQ ID NO: 16298 - DNA, 20 bp, Artificial Sequence
  sgRNA
  Clec9a_12
tctcagataagtgcgatagc

SEQ ID NO: 16299 - DNA, 20 bp, Artificial Sequence
  sgRNA
  Clec9a_13
ttactatgtctttgaacgct

SEQ ID NO: 16300 - DNA, 20 bp, Artificial Sequence
  sgRNA
  Clec9a_14
tgaaccttacacagtggcag

SEQ ID NO: 16301 - DNA, 20 bp, Artificial Sequence
  sgRNA
  Clec9a_15
gtggcagaggaaatacacac

SEQ ID NO: 16302 - DNA, 20 bp, Artificial Sequence
  sgRNA
  Clec9a_16
gctgatcgctgtctttctgc

SEQ ID NO: 16303 - DNA, 20 bp, Artificial Sequence
  sgRNA
  Clec9a_17
ctgctgctccaagacaagag

SEQ ID NO: 16304 - DNA, 20 bp, Artificial Sequence
  sgRNA
  Clec9a_18
ccacacaactggattcagaa

SEQ ID NO: 16305 - DNA, 20 bp, Artificial Sequence
  sgRNA
  Clec9a_19
gcagcccttgtccacacaac

SEQ ID NO: 16306 - DNA, 20 bp, Artificial Sequence
  sgRNA
  Clec9a_20
gagatctctgcagtaaggct

SEQ ID NO: 16307 - DNA, 20 bp, Artificial Sequence
  sgRNA
  Clmp_1
tgtctacaataacttgaccg

SEQ ID NO: 16308 - DNA, 20 bp, Artificial Sequence
  sgRNA
  Clmp_2
cctacagattacaacaaccc

SEQ ID NO: 16309 - DNA, 20 bp, Artificial Sequence
  sgRNA
  Clmp_3
ccagtgcacagcaggcaacg

SEQ ID NO: 16310 - DNA, 20 bp, Artificial Sequence
  sgRNA
  Clmp_4
tgtgcagagcattggcatgg

SEQ ID NO: 16311 - DNA, 20 bp, Artificial Sequence
  sgRNA
  Clmp_5
gttattgtagacatgacggc

SEQ ID NO: 16312 - DNA, 20 bp, Artificial Sequence
  sgRNA
  Clmp_6
tgtgcactggtaaagcccag

SEQ ID NO: 16313 - DNA, 20 bp, Artificial Sequence
  sgRNA
  Clmp_7
gagcagccattcaatgtcca

SEQ ID NO: 16314 - DNA, 20 bp, Artificial Sequence
  sgRNA
  Clmp_8
tgatatggctgctaatacga

SEQ ID NO: 16315 - DNA, 20 bp, Artificial Sequence
  sgRNA
  Clmp_9
gtattagcagccatatcagg

SEQ ID NO: 16316 - DNA, 20 bp, Artificial Sequence
  sgRNA
  Clmp_10
tatgaggctgtatgcctgcg

SEQ ID NO: 16317 - DNA, 20 bp, Artificial Sequence
  sgRNA
  Clmp_11
cagcgaatccgggagaagga

SEQ ID NO: 16318 - DNA, 20 bp, Artificial Sequence
  sgRNA
  Clmp_12
agttggaagcgaaggccact

SEQ ID NO: 16319 - DNA, 20 bp, Artificial Sequence
  sgRNA
  Clmp_13
gctgctgcagaatctcacca

SEQ ID NO: 16320 - DNA, 20 bp, Artificial Sequence
  sgRNA
  Clmp_14
tctgcagcagcactcggcca

SEQ ID NO: 16321 - DNA, 20 bp, Artificial Sequence
  sgRNA
  Clmp_15
ctttggtcagggtcgtatgg

SEQ ID NO: 16322 - DNA, 20 bp, Artificial Sequence
  sgRNA
  Clmp_16
gtcaggtcacttccttcggt

SEQ ID NO: 16323 - DNA, 20 bp, Artificial Sequence
  sgRNA
  Clmp_17
gaaaagcaaagacagatacg

SEQ ID NO: 16324 - DNA, 20 bp, Artificial Sequence
  sgRNA
  Clmp_18
ggctgctcaccgataatgaa

SEQ ID NO: 16325 - DNA, 20 bp, Artificial Sequence
  sgRNA
  Clmp_19
tctggaggcactgttcccgg

SEQ ID NO: 16326 - DNA, 20 bp, Artificial Sequence
  sgRNA
  Clmp_20
tcccagcgttccaacataat

SEQ ID NO: 16327 - DNA, 20 bp, Artificial Sequence
  sgRNA
  Cln3_1
acactccgactatccaaccg

SEQ ID NO: 16328 - DNA, 20 bp, Artificial Sequence
  sgRNA
  Cln3_2
aatcgagatgagctgttgtg

SEQ ID NO: 16329 - DNA, 20 bp, Artificial Sequence
  sgRNA
  Cln3_3
ggaccctggaggggaaaacg

SEQ ID NO: 16330 - DNA, 20 bp, Artificial Sequence
  sgRNA
  Cln3_4
caggagtttgatgacaaggg

SEQ ID NO: 16331 - DNA, 20 bp, Artificial Sequence
  sgRNA
  Cln3_5
actccgactatccaaccgag

SEQ ID NO: 16332 - DNA, 20 bp, Artificial Sequence
  sgRNA
  Cln3_6
cttgtggtacatcatccctc

SEQ ID NO: 16333 - DNA, 20 bp, Artificial Sequence
  sgRNA
  Cln3_7
ttgccgaatacggttcacct

SEQ ID NO: 16334 - DNA, 20 bp, Artificial Sequence
  sgRNA
  Cln3_8
tggtggtcttcgggtaccgg

SEQ ID NO: 16335 - DNA, 20 bp, Artificial Sequence
  sgRNA
  Cln3_9
acattggagagaagagcggg

SEQ ID NO: 16336 - DNA, 20 bp, Artificial Sequence
  sgRNA
  Cln3_10
atggtggtcttcgggtaccg

SEQ ID NO: 16337 - DNA, 20 bp, Artificial Sequence
  sgRNA
  Cln3_11
cttggatcgctgtcttacct

SEQ ID NO: 16338 - DNA, 20 bp, Artificial Sequence
  sgRNA
  Cln3_12
tgaaccgtattcggcaacat

SEQ ID NO: 16339 - DNA, 20 bp, Artificial Sequence
  sgRNA
  Cln3_13
gcagaatactttatcaacca

SEQ ID NO: 16340 - DNA, 20 bp, Artificial Sequence
  sgRNA
  Cln3_14
ggtgacctcccctagccctg

SEQ ID NO: 16341 - DNA, 20 bp, Artificial Sequence
  sgRNA
  Cln3_15
gcagacatctgccagcagga

SEQ ID NO: 16342 - DNA, 20 bp, Artificial Sequence
  sgRNA
  Cln3_16
tcatcatcattctgtacgaa

SEQ ID NO: 16343 - DNA, 20 bp, Artificial Sequence
  sgRNA
  Cln3_17
ctccactgacgagcacccgg

SEQ ID NO: 16344 - DNA, 20 bp, Artificial Sequence
  sgRNA
  Cln3_18
gccatgctcagcagtaccga

SEQ ID NO: 16345 - DNA, 20 bp, Artificial Sequence
  sgRNA
  Cln3_19
cgccaggagtttgatgacaa

SEQ ID NO: 16346 - DNA, 20 bp, Artificial Sequence
  sgRNA
  Cln3_20
agaaagtagggtgtgctgcg

SEQ ID NO: 16347 - DNA, 20 bp, Artificial Sequence
  sgRNA
  Clrn1_1
atagtggctttaacccacag

SEQ ID NO: 16348 - DNA, 20 bp, Artificial Sequence
  sgRNA
  Clrn1_2
tacttacatgagaaccggaa

SEQ ID NO: 16349 - DNA, 20 bp, Artificial Sequence
  sgRNA
  Clrn1_3
attgccttacgccttctccg

SEQ ID NO: 16350 - DNA, 20 bp, Artificial Sequence
  sgRNA
  Clrn1_4
gcttgtcaacgcgtcaggga

SEQ ID NO: 16351 - DNA, 20 bp, Artificial Sequence
  sgRNA
  Clrn1_5
ggtccatgaagagtttcaaa

SEQ ID NO: 16352 - DNA, 20 bp, Artificial Sequence
  sgRNA
  Clrn1_6
aaggagctggacaagttcat

SEQ ID NO: 16353 - DNA, 20 bp, Artificial Sequence
  sgRNA
  Clrn1_7
cactatcctctgcaaaacag

SEQ ID NO: 16354 - DNA, 20 bp, Artificial Sequence
  sgRNA
  Clrn1_8
ggagaggtactctctgtatg

SEQ ID NO: 16355 - DNA, 20 bp, Artificial Sequence
  sgRNA
  Clrn1_9
gattcttgtcgtcttaacca

SEQ ID NO: 16356 - DNA, 20 bp, Artificial Sequence
  sgRNA
  Clrn1_10
cttgtcgtcttaaccatggt

SEQ ID NO: 16357 - DNA, 20 bp, Artificial Sequence
  sgRNA
  Clrn1_11
aaactcttcatggaccactg

SEQ ID NO: 16358 - DNA, 20 bp, Artificial Sequence
  sgRNA
  Clrn1_12
ctgaccagatagagccccag

SEQ ID NO: 16359 - DNA, 20 bp, Artificial Sequence
  sgRNA
  Clrn1_13
gagaaggcgtaaggcaatgt

SEQ ID NO: 16360 - DNA, 20 bp, Artificial Sequence
  sgRNA
  Clrn1_14
tattgatgtggatgcttacg

SEQ ID NO: 16361 - DNA, 20 bp, Artificial Sequence
  sgRNA
  Clrn1_15
gaagaaggctgtccccacca

SEQ ID NO: 16362 - DNA, 20 bp, Artificial Sequence
  sgRNA
  Clrn1_16
gcggtggactttcacttcag

SEQ ID NO: 16363 - DNA, 20 bp, Artificial Sequence
  sgRNA
  Clrn1_17
ttgtcgtcttaaccatggtg

SEQ ID NO: 16364 - DNA, 20 bp, Artificial Sequence
  sgRNA
  Clrn1_18
ccactatcctctgcaaaaca

SEQ ID NO: 16365 - DNA, 20 bp, Artificial Sequence
  sgRNA
  Clrn1_19
ctctgcttgtcaacgcgtca

SEQ ID NO: 16366 - DNA, 20 bp, Artificial Sequence
  sgRNA
  Clrn1_20
cttggagtggtgacagcagt

SEQ ID NO: 16367 - DNA, 20 bp, Artificial Sequence
  sgRNA
  Clrn2_1
tcatcggggacatttactac

SEQ ID NO: 16368 - DNA, 20 bp, Artificial Sequence
  sgRNA
  Clrn2_2
ggagcaagagaattgtgacg

SEQ ID NO: 16369 - DNA, 20 bp, Artificial Sequence
  sgRNA
  Clrn2_3
ggtgcggcaatgcggacttg

SEQ ID NO: 16370 - DNA, 20 bp, Artificial Sequence
  sgRNA
  Clrn2_4
ggagtcgtggcactagccat

SEQ ID NO: 16371 - DNA, 20 bp, Artificial Sequence
  sgRNA
  Clrn2_5
ccagagccagggccaacgcc

SEQ ID NO: 16372 - DNA, 20 bp, Artificial Sequence
  sgRNA
  Clrn2_6
agttggcgatcctttctgtc

SEQ ID NO: 16373 - DNA, 20 bp, Artificial Sequence
  sgRNA
  Clrn2_7
gggccattgactgctctgta

SEQ ID NO: 16374 - DNA, 20 bp, Artificial Sequence
  sgRNA
  Clrn2_8
agaactggtcaaattcatcg

SEQ ID NO: 16375 - DNA, 20 bp, Artificial Sequence
  sgRNA
  Clrn2_9
ccacgcagcaaacttggttg

SEQ ID NO: 16376 - DNA, 20 bp, Artificial Sequence
  sgRNA
  Clrn2_10
agaggccacagttaccccgg

SEQ ID NO: 16377 - DNA, 20 bp, Artificial Sequence
  sgRNA
  Clrn2_11
acccatgctgaccagagcca

SEQ ID NO: 16378 - DNA, 20 bp, Artificial Sequence
  sgRNA
  Clrn2_12
ggatgcaaggtgcggcaatg

SEQ ID NO: 16379 - DNA, 20 bp, Artificial Sequence
  sgRNA
  Clrn2_13
catcggcagcttcatggctg

SEQ ID NO: 16380 - DNA, 20 bp, Artificial Sequence
  sgRNA
  Clrn2_14
atttactacgggctcttccg

SEQ ID NO: 16381 - DNA, 20 bp, Artificial Sequence
  sgRNA
  Clrn2_15
tcttccgaggatgcaaggtg

SEQ ID NO: 16382 - DNA, 20 bp, Artificial Sequence
  sgRNA
  Clrn2_16
cttgctcctcttcctggcgt

SEQ ID NO: 16383 - DNA, 20 bp, Artificial Sequence
  sgRNA
  Clrn2_17
gccctggctctggtcagcat

SEQ ID NO: 16384 - DNA, 20 bp, Artificial Sequence
  sgRNA
  Clrn2_18
ccacaaccaagtttgctgcg

SEQ ID NO: 16385 - DNA, 20 bp, Artificial Sequence
  sgRNA
  Clrn2_19
tacagagcagtcaatggccc

SEQ ID NO: 16386 - DNA, 20 bp, Artificial Sequence
  sgRNA
  Clrn2_20
gtgcggcaatgcggacttgg

SEQ ID NO: 16387 - DNA, 20 bp, Artificial Sequence
  sgRNA
  Clstn1_1
tccaagtgtgactctctacg

SEQ ID NO: 16388 - DNA, 20 bp, Artificial Sequence
  sgRNA
  Clstn1_2
cccagacgtgccgttcactg

SEQ ID NO: 16389 - DNA, 20 bp, Artificial Sequence
  sgRNA
  Clstn1_3
agtcaccgagaacgataaca

SEQ ID NO: 16390 - DNA, 20 bp, Artificial Sequence
  sgRNA
  Clstn1_4
caacgaggcggcttgcatcg

SEQ ID NO: 16391 - DNA, 20 bp, Artificial Sequence
  sgRNA
  Clstn1_5
gcttgaacttgcgatccagc

SEQ ID NO: 16392 - DNA, 20 bp, Artificial Sequence
  sgRNA
  Clstn1_6
gatccacacagccaaccccg

SEQ ID NO: 16393 - DNA, 20 bp, Artificial Sequence
  sgRNA
  Clstn1_7
tctcaaactcagaagctgcg

SEQ ID NO: 16394 - DNA, 20 bp, Artificial Sequence
  sgRNA
  Clstn1_8
cggcccatgccgcatccaca

SEQ ID NO: 16395 - DNA, 20 bp, Artificial Sequence
  sgRNA
  Clstn1_9
tggcattctggccgtctccg

SEQ ID NO: 16396 - DNA, 20 bp, Artificial Sequence
  sgRNA
  Clstn1_10
tgtggttggcatgttccacg

SEQ ID NO: 16397 - DNA, 20 bp, Artificial Sequence
  sgRNA
  Clstn1_11
agtgtgactctctacgtgga

SEQ ID NO: 16398 - DNA, 20 bp, Artificial Sequence
  sgRNA
  Clstn1_12
gcttgacgcttatcttcact

SEQ ID NO: 16399 - DNA, 20 bp, Artificial Sequence
  sgRNA
  Clstn1_13
gagcggtgaatctttatcca

SEQ ID NO: 16400 - DNA, 20 bp, Artificial Sequence
  sgRNA
  Clstn1_14
catcacgtagccttccaccg

SEQ ID NO: 16401 - DNA, 20 bp, Artificial Sequence
  sgRNA
  Clstn1_15
ggagaccatggcaagctacg

SEQ ID NO: 16402 - DNA, 20 bp, Artificial Sequence
  sgRNA
  Clstn1_16
tctcctcagacgggtcctga

SEQ ID NO: 16403 - DNA, 20 bp, Artificial Sequence
  sgRNA
  Clstn1_17
atccacacggagattgtaaa

SEQ ID NO: 16404 - DNA, 20 bp, Artificial Sequence
  sgRNA
  Clstn1_18
cgtggtagtggataagtcca

SEQ ID NO: 16405 - DNA, 20 bp, Artificial Sequence
  sgRNA
  Clstn1_19
cgtggacgtagagcgaataa

SEQ ID NO: 16406 - DNA, 20 bp, Artificial Sequence
  sgRNA
  Clstn1_20
cccggatccgaaacaccccc

SEQ ID NO: 16407 - DNA, 20 bp, Artificial Sequence
  sgRNA
  Clstn2_1
gagctgcagactaattacat

SEQ ID NO: 16408 - DNA, 20 bp, Artificial Sequence
  sgRNA
  Clstn2_2
atagccatgcaacttactgt

SEQ ID NO: 16409 - DNA, 20 bp, Artificial Sequence
  sgRNA
  Clstn2_3
tggatcgagacatcgtatca

SEQ ID NO: 16410 - DNA, 20 bp, Artificial Sequence
  sgRNA
  Clstn2_4
agggtgccaagatccctgat

SEQ ID NO: 16411 - DNA, 20 bp, Artificial Sequence
  sgRNA
  Clstn2_5
caagagatcgatgatacccg

SEQ ID NO: 16412 - DNA, 20 bp, Artificial Sequence
  sgRNA
  Clstn2_6
ccacgtcccttgagacccgg

SEQ ID NO: 16413 - DNA, 20 bp, Artificial Sequence
  sgRNA
  Clstn2_7
ctacaaggccatcgtcacgg

SEQ ID NO: 16414 - DNA, 20 bp, Artificial Sequence
  sgRNA
  Clstn2_8
ttctgcagctcacagtcgat

SEQ ID NO: 16415 - DNA, 20 bp, Artificial Sequence
  sgRNA
  Clstn2_9
tgatcttcaagtttgacggc

SEQ ID NO: 16416 - DNA, 20 bp, Artificial Sequence
  sgRNA
  Clstn2_10
ggggccatgtttcatccaca

SEQ ID NO: 16417 - DNA, 20 bp, Artificial Sequence
  sgRNA
  Clstn2_11
gatctatgacagcatcctgc

SEQ ID NO: 16418 - DNA, 20 bp, Artificial Sequence
  sgRNA
  Clstn2_12
gcttccagtgaaactctgca

SEQ ID NO: 16419 - DNA, 20 bp, Artificial Sequence
  sgRNA
  Clstn2_13
tacaaggccatcgtcacgga

SEQ ID NO: 16420 - DNA, 20 bp, Artificial Sequence
  sgRNA
  Clstn2_14
tcacgaggatggactgtgaa

SEQ ID NO: 16421 - DNA, 20 bp, Artificial Sequence
  sgRNA
  Clstn2_15
tgtcatcgccttccatcacg

SEQ ID NO: 16422 - DNA, 20 bp, Artificial Sequence
  sgRNA
  Clstn2_16
agaaacgctctgttccctgg

SEQ ID NO: 16423 - DNA, 20 bp, Artificial Sequence
  sgRNA
  Clstn2_17
gatcttgccctccgtgacga

SEQ ID NO: 16424 - DNA, 20 bp, Artificial Sequence
  sgRNA
  Clstn2_18
cagctaccaactggactgcg

SEQ ID NO: 16425 - DNA, 20 bp, Artificial Sequence
  sgRNA
  Clstn2_19
ggatgggcagagtcagacat

SEQ ID NO: 16426 - DNA, 20 bp, Artificial Sequence
  sgRNA
  Clstn2_20
ggtgccagttgcggtaacgg

SEQ ID NO: 16427 - DNA, 20 bp, Artificial Sequence
  sgRNA
  Clstn3_1
cagacgctccacaaagaccg

SEQ ID NO: 16428 - DNA, 20 bp, Artificial Sequence
  sgRNA
  Clstn3_2
cagttacctgcatagcgcag

SEQ ID NO: 16429 - DNA, 20 bp, Artificial Sequence
  sgRNA
  Clstn3_3
accgagacaactattcagag

SEQ ID NO: 16430 - DNA, 20 bp, Artificial Sequence
  sgRNA
  Clstn3_4
agtagtggtggatcagcaag

SEQ ID NO: 16431 - DNA, 20 bp, Artificial Sequence
  sgRNA
  Clstn3_5
gtatgatcggatcttacgtg

SEQ ID NO: 16432 - DNA, 20 bp, Artificial Sequence
  sgRNA
  Clstn3_6
ccaatgccaactggacagcg

SEQ ID NO: 16433 - DNA, 20 bp, Artificial Sequence
  sgRNA
  Clstn3_7
tcacagcagttcctgcaccg

SEQ ID NO: 16434 - DNA, 20 bp, Artificial Sequence
  sgRNA
  Clstn3_8
gtaccgtgctgcagtgacgg

SEQ ID NO: 16435 - DNA, 20 bp, Artificial Sequence
  sgRNA
  Clstn3_9
atagtgtgactcccagcaag

SEQ ID NO: 16436 - DNA, 20 bp, Artificial Sequence
  sgRNA
  Clstn3_10
gatccgggctaaggagcccg

SEQ ID NO: 16437 - DNA, 20 bp, Artificial Sequence
  sgRNA
  Clstn3_11
gggtgagcagggactgcgag

SEQ ID NO: 16438 - DNA, 20 bp, Artificial Sequence
  sgRNA
  Clstn3_12
ggacgagcactctcaagcaa

SEQ ID NO: 16439 - DNA, 20 bp, Artificial Sequence
  sgRNA
  Clstn3_13
acggtcacactgtatactga

SEQ ID NO: 16440 - DNA, 20 bp, Artificial Sequence
  sgRNA
  Clstn3_14
gtgcctctatgcatgtcggg

SEQ ID NO: 16441 - DNA, 20 bp, Artificial Sequence
  sgRNA
  Clstn3_15
tgtgatcctggacaaggcaa

SEQ ID NO: 16442 - DNA, 20 bp, Artificial Sequence
  sgRNA
  Clstn3_16
cctgcatagcatgaaccggg

SEQ ID NO: 16443 - DNA, 20 bp, Artificial Sequence
  sgRNA
  Clstn3_17
tggatcgaggcagagtacca

SEQ ID NO: 16444 - DNA, 20 bp, Artificial Sequence
  sgRNA
  Clstn3_18
gagattgtacacaacttgga

SEQ ID NO: 16445 - DNA, 20 bp, Artificial Sequence
  sgRNA
  Clstn3_19
tcccctccgtcactgcagca

SEQ ID NO: 16446 - DNA, 20 bp, Artificial Sequence
  sgRNA
  Clstn3_20
gctcatcacaggtctccaga

SEQ ID NO: 16447 - DNA, 20 bp, Artificial Sequence
  sgRNA
  Cmklr1_1
actcgcaagtagtttccaca

SEQ ID NO: 16448 - DNA, 20 bp, Artificial Sequence
  sgRNA
  Cmklr1_2
ggccgttgcctaggagaccg

SEQ ID NO: 16449 - DNA, 20 bp, Artificial Sequence
  sgRNA
  Cmklr1_3
ggaggaggcgagtccgtggg

SEQ ID NO: 16450 - DNA, 20 bp, Artificial Sequence
  sgRNA
  Cmklr1_4
agacgctggtgtacatgttg

SEQ ID NO: 16451 - DNA, 20 bp, Artificial Sequence
  sgRNA
  Cmklr1_5
gccgatgcacatcacctacg

SEQ ID NO: 16452 - DNA, 20 bp, Artificial Sequence
  sgRNA
  Cmklr1_6
gggacaccgccaacattcat

SEQ ID NO: 16453 - DNA, 20 bp, Artificial Sequence
  sgRNA
  Cmklr1_7
ggtggttctgggaccagacg

SEQ ID NO: 16454 - DNA, 20 bp, Artificial Sequence
  sgRNA
  Cmklr1_8
ccaagctgtagatcaccacc

SEQ ID NO: 16455 - DNA, 20 bp, Artificial Sequence
  sgRNA
  Cmklr1_9
tggccttcccgaacacccag

SEQ ID NO: 16456 - DNA, 20 bp, Artificial Sequence
  sgRNA
  Cmklr1_10
ggagcagcacggagatgcag

SEQ ID NO: 16457 - DNA, 20 bp, Artificial Sequence
  sgRNA
  Cmklr1_11
gccgcgtaggtgatgtgcat

SEQ ID NO: 16458 - DNA, 20 bp, Artificial Sequence
  sgRNA
  Cmklr1_12
gatcaccaccaggaagaccg

SEQ ID NO: 16459 - DNA, 20 bp, Artificial Sequence
  sgRNA
  Cmklr1_13
atggtgataatgatcttgaa

SEQ ID NO: 16460 - DNA, 20 bp, Artificial Sequence
  sgRNA
  Cmklr1_14
gaaccaccgcagcatccgcc

SEQ ID NO: 16461 - DNA, 20 bp, Artificial Sequence
  sgRNA
  Cmklr1_15
gtactcatcatcatagatgc

SEQ ID NO: 16462 - DNA, 20 bp, Artificial Sequence
  sgRNA
  Cmklr1_16
ggaaactacttgcgagtggg

SEQ ID NO: 16463 - DNA, 20 bp, Artificial Sequence
  sgRNA
  Cmklr1_17
cgcggccatggactaccact

SEQ ID NO: 16464 - DNA, 20 bp, Artificial Sequence
  sgRNA
  Cmklr1_18
aggccgtgatgatgaagacg

SEQ ID NO: 16465 - DNA, 20 bp, Artificial Sequence
  sgRNA
  Cmklr1_19
tatcttcccatgaatgttgg

SEQ ID NO: 16466 - DNA, 20 bp, Artificial Sequence
  sgRNA
  Cmklr1_20
gaacacccagtggtagtcca

SEQ ID NO: 16467 - DNA, 20 bp, Artificial Sequence
  sgRNA
  Cnnm2_1
accgtcgtggtaaatccagg

SEQ ID NO: 16468 - DNA, 20 bp, Artificial Sequence
  sgRNA
  Cnnm2_2
cggcgattgagaatgatgtg

SEQ ID NO: 16469 - DNA, 20 bp, Artificial Sequence
  sgRNA
  Cnnm2_3
tgctaaccggataagaagcg

SEQ ID NO: 16470 - DNA, 20 bp, Artificial Sequence
  sgRNA
  Cnnm2_4
ctgcttcatgataaccggcg

SEQ ID NO: 16471 - DNA, 20 bp, Artificial Sequence
  sgRNA
  Cnnm2_5
tgttcagctcttccttaacg

SEQ ID NO: 16472 - DNA, 20 bp, Artificial Sequence
  sgRNA
  Cnnm2_6
actcgaatcccggtgttcga

SEQ ID NO: 16473 - DNA, 20 bp, Artificial Sequence
  sgRNA
  Cnnm2_7
tcgccttcactgagcacgag

SEQ ID NO: 16474 - DNA, 20 bp, Artificial Sequence
  sgRNA
  Cnnm2_8
gggctcgtactgagtagtca

SEQ ID NO: 16475 - DNA, 20 bp, Artificial Sequence
  sgRNA
  Cnnm2_9
catcgtgcaaaactgcggca

SEQ ID NO: 16476 - DNA, 20 bp, Artificial Sequence
  sgRNA
  Cnnm2_10
actcttacggagctgcatga

SEQ ID NO: 16477 - DNA, 20 bp, Artificial Sequence
  sgRNA
  Cnnm2_11
gctcatggctctggacccga

SEQ ID NO: 16478 - DNA, 20 bp, Artificial Sequence
  sgRNA
  Cnnm2_12
cttccaagtgggcagtgcgg

SEQ ID NO: 16479 - DNA, 20 bp, Artificial Sequence
  sgRNA
  Cnnm2_13
gcgccgctcgtgctcagtga

SEQ ID NO: 16480 - DNA, 20 bp, Artificial Sequence
  sgRNA
  Cnnm2_14
ttatgccaagcgcatcgagc

SEQ ID NO: 16481 - DNA, 20 bp, Artificial Sequence
  sgRNA
  Cnnm2_15
tctcgatgatgcccgatgtg

SEQ ID NO: 16482 - DNA, 20 bp, Artificial Sequence
  sgRNA
  Cnnm2_16
gcgtggagagagacgtgcac

SEQ ID NO: 16483 - DNA, 20 bp, Artificial Sequence
  sgRNA
  Cnnm2_17
gctggagctccgcaccaaga

SEQ ID NO: 16484 - DNA, 20 bp, Artificial Sequence
  sgRNA
  Cnnm2_18
cagcagctcagcagtagcag

SEQ ID NO: 16485 - DNA, 20 bp, Artificial Sequence
  sgRNA
  Cnnm2_19
acagtcatccggatccacga

SEQ ID NO: 16486 - DNA, 20 bp, Artificial Sequence
  sgRNA
  Cnnm2_20
ctgagtgctacctctaccag

SEQ ID NO: 16487 - DNA, 20 bp, Artificial Sequence
  sgRNA
  Cnnm3_1
ccgccgtgctgggttgcgcg

SEQ ID NO: 16488 - DNA, 20 bp, Artificial Sequence
  sgRNA
  Cnnm3_2
ccctacagcgacctcagcaa

SEQ ID NO: 16489 - DNA, 20 bp, Artificial Sequence
  sgRNA
  Cnnm3_3
cgtacactgggatgcgcgtg

SEQ ID NO: 16490 - DNA, 20 bp, Artificial Sequence
  sgRNA
  Cnnm3_4
gaagagtcgcaagcacaaag

SEQ ID NO: 16491 - DNA, 20 bp, Artificial Sequence
  sgRNA
  Cnnm3_5
gttcaggctgcacgtcatgg

SEQ ID NO: 16492 - DNA, 20 bp, Artificial Sequence
  sgRNA
  Cnnm3_6
ggacactccatagtacgtga

SEQ ID NO: 16493 - DNA, 20 bp, Artificial Sequence
  sgRNA
  Cnnm3_7
ggtgctgctcaccttgcccg

SEQ ID NO: 16494 - DNA, 20 bp, Artificial Sequence
  sgRNA
  Cnnm3_8
gataatggtgtgcggccagg

SEQ ID NO: 16495 - DNA, 20 bp, Artificial Sequence
  sgRNA
  Cnnm3_9
gtgcagcctgaaccagccga

SEQ ID NO: 16496 - DNA, 20 bp, Artificial Sequence
  sgRNA
  Cnnm3_10
gtttgacgagagcaaccgcc

SEQ ID NO: 16497 - DNA, 20 bp, Artificial Sequence
  sgRNA
  Cnnm3_11
gcaaggtgagcagcaccgcc

SEQ ID NO: 16498 - DNA, 20 bp, Artificial Sequence
  sgRNA
  Cnnm3_12
aggtgagcagcaccgccagg

SEQ ID NO: 16499 - DNA, 20 bp, Artificial Sequence
  sgRNA
  Cnnm3_13
agcataaagcagtcttcgag

SEQ ID NO: 16500 - DNA, 20 bp, Artificial Sequence
  sgRNA
  Cnnm3_14
gcagagtcgaggtcgaaatt

SEQ ID NO: 16501 - DNA, 20 bp, Artificial Sequence
  sgRNA
  Cnnm3_15
gctgaacttctgcacggaag

SEQ ID NO: 16502 - DNA, 20 bp, Artificial Sequence
  sgRNA
  Cnnm3_16
gggcctgaagttcgagaacg

SEQ ID NO: 16503 - DNA, 20 bp, Artificial Sequence
  sgRNA
  Cnnm3_17
gcccagggctctcctccact

SEQ ID NO: 16504 - DNA, 20 bp, Artificial Sequence
  sgRNA
  Cnnm3_18
tctgtctgggcagcaccgca

SEQ ID NO: 16505 - DNA, 20 bp, Artificial Sequence
  sgRNA
  Cnnm3_19
ggtgctgcccagacagaacg

SEQ ID NO: 16506 - DNA, 20 bp, Artificial Sequence
  sgRNA
  Cnnm3_20
gtttccaagtgtgccaaaga

SEQ ID NO: 16507 - DNA, 20 bp, Artificial Sequence
  sgRNA
  Cnnm4_1
agagcgtgatcctaggcatg

SEQ ID NO: 16508 - DNA, 20 bp, Artificial Sequence
  sgRNA
  Cnnm4_2
ccatgatgccagacccgatg

SEQ ID NO: 16509 - DNA, 20 bp, Artificial Sequence
  sgRNA
  Cnnm4_3
gaaaaacaaaatgtaccggg

SEQ ID NO: 16510 - DNA, 20 bp, Artificial Sequence
  sgRNA
  Cnnm4_4
gcatccccgacgtgttcccg

SEQ ID NO: 16511 - DNA, 20 bp, Artificial Sequence
  sgRNA
  Cnnm4_5
tgagctcctgaatgacgtcg

SEQ ID NO: 16512 - DNA, 20 bp, Artificial Sequence
  sgRNA
  Cnnm4_6
gttgcggtccgggtaactga

SEQ ID NO: 16513 - DNA, 20 bp, Artificial Sequence
  sgRNA
  Cnnm4_7
caacctgatctccttcaccg

SEQ ID NO: 16514 - DNA, 20 bp, Artificial Sequence
  sgRNA
  Cnnm4_8
ggcatcatcttcgtgtccga

SEQ ID NO: 16515 - DNA, 20 bp, Artificial Sequence
  sgRNA
  Cnnm4_9
atgaggacgaagcaatcggc

SEQ ID NO: 16516 - DNA, 20 bp, Artificial Sequence
  sgRNA
  Cnnm4_10
ggaactaaggaccaaaactg

SEQ ID NO: 16517 - DNA, 20 bp, Artificial Sequence
  sgRNA
  Cnnm4_11
tgagccgcgggaacacgtcg

SEQ ID NO: 16518 - DNA, 20 bp, Artificial Sequence
  sgRNA
  Cnnm4_12
gcgagctgcaacaagtcgtg

SEQ ID NO: 16519 - DNA, 20 bp, Artificial Sequence
  sgRNA
  Cnnm4_13
tgtacatgtccgactcatcg

SEQ ID NO: 16520 - DNA, 20 bp, Artificial Sequence
  sgRNA
  Cnnm4_14
ccaacagcaccataacgaga

SEQ ID NO: 16521 - DNA, 20 bp, Artificial Sequence
  sgRNA
  Cnnm4_15
gtcgtggtctcgtccaccgg

SEQ ID NO: 16522 - DNA, 20 bp, Artificial Sequence
  sgRNA
  Cnnm4_16
gtggttgtagaagcgagtga

SEQ ID NO: 16523 - DNA, 20 bp, Artificial Sequence
  sgRNA
  Cnnm4_17
gcgagtgatggtcttgagcg

SEQ ID NO: 16524 - DNA, 20 bp, Artificial Sequence
  sgRNA
  Cnnm4_18
atagagcccatcaggcgcaa

SEQ ID NO: 16525 - DNA, 20 bp, Artificial Sequence
  sgRNA
  Cnnm4_19
gaggagttaaatatgatcca

SEQ ID NO: 16526 - DNA, 20 bp, Artificial Sequence
  sgRNA
  Cnnm4_20
agtcgtggtctcgtccaccg

SEQ ID NO: 16527 - DNA, 20 bp, Artificial Sequence
  sgRNA
  Cnr1_1
gctggatcatgcgaactgcg

SEQ ID NO: 16528 - DNA, 20 bp, Artificial Sequence
  sgRNA
  Cnr1_2
ggcaggagacaactccccgt

SEQ ID NO: 16529 - DNA, 20 bp, Artificial Sequence
  sgRNA
  Cnr1_3
tgtacctgtcgatggccgtg

SEQ ID NO: 16530 - DNA, 20 bp, Artificial Sequence
  sgRNA
  Cnr1_4
aacgaggacaacatccagtg

SEQ ID NO: 16531 - DNA, 20 bp, Artificial Sequence
  sgRNA
  Cnr1_5
gagcactgttaagatcgcca

SEQ ID NO: 16532 - DNA, 20 bp, Artificial Sequence
  sgRNA
  Cnr1_6
cattgggactatctttgcgg

SEQ ID NO: 16533 - DNA, 20 bp, Artificial Sequence
  sgRNA
  Cnr1_7
gcagttcgcatgatccagcg

SEQ ID NO: 16534 - DNA, 20 bp, Artificial Sequence
  sgRNA
  Cnr1_8
cagaaccgtgaaggtgccca

SEQ ID NO: 16535 - DNA, 20 bp, Artificial Sequence
  sgRNA
  Cnr1_9
tccgatccagaacatcaggt

SEQ ID NO: 16536 - DNA, 20 bp, Artificial Sequence
  sgRNA
  Cnr1_10
ggatgacacatagcaccagc

SEQ ID NO: 16537 - DNA, 20 bp, Artificial Sequence
  sgRNA
  Cnr1_11
agcagatgatcaacaccacc

SEQ ID NO: 16538 - DNA, 20 bp, Artificial Sequence
  sgRNA
  Cnr1_12
tcccccatgctgttatctag

SEQ ID NO: 16539 - DNA, 20 bp, Artificial Sequence
  sgRNA
  Cnr1_13
gcgcagtgccttcacatgaa

SEQ ID NO: 16540 - DNA, 20 bp, Artificial Sequence
  sgRNA
  Cnr1_14
ggtggtgttgatcatctgct

SEQ ID NO: 16541 - DNA, 20 bp, Artificial Sequence
  sgRNA
  Cnr1_15
gcagcctctagataacagca

SEQ ID NO: 16542 - DNA, 20 bp, Artificial Sequence
  sgRNA
  Cnr1_16
tgttcctcacggccatcgac

SEQ ID NO: 16543 - DNA, 20 bp, Artificial Sequence
  sgRNA
  Cnr1_17
gatgaacaagcttatcaaga

SEQ ID NO: 16544 - DNA, 20 bp, Artificial Sequence
  sgRNA
  Cnr1_18
caccaccaggatcagaacca

SEQ ID NO: 16545 - DNA, 20 bp, Artificial Sequence
  sgRNA
  Cnr1_19
atagatgatggggttcacgg

SEQ ID NO: 16546 - DNA, 20 bp, Artificial Sequence
  sgRNA
  Cnr1_20
catcaagcaaaaggccacta

SEQ ID NO: 16547 - DNA, 20 bp, Artificial Sequence
  sgRNA
  Cnr2_1
gcgaatctctccactccgca

SEQ ID NO: 16548 - DNA, 20 bp, Artificial Sequence
  sgRNA
  Cnr2_2
acaaagctctagtcacccgt

SEQ ID NO: 16549 - DNA, 20 bp, Artificial Sequence
  sgRNA
  Cnr2_3
ggctggaagaagtatctaca

SEQ ID NO: 16550 - DNA, 20 bp, Artificial Sequence
  sgRNA
  Cnr2_4
cttgacctggtcactcagcg

SEQ ID NO: 16551 - DNA, 20 bp, Artificial Sequence
  sgRNA
  Cnr2_5
ctgctgatgaacaggtacga

SEQ ID NO: 16552 - DNA, 20 bp, Artificial Sequence
  sgRNA
  Cnr2_6
atattatcctgtcctcccgg

SEQ ID NO: 16553 - DNA, 20 bp, Artificial Sequence
  sgRNA
  Cnr2_7
caaggtggctacatgccggt

SEQ ID NO: 16554 - DNA, 20 bp, Artificial Sequence
  sgRNA
  Cnr2_8
acataggtagcggtcaacag

SEQ ID NO: 16555 - DNA, 20 bp, Artificial Sequence
  sgRNA
  Cnr2_9
tttccagaggacatacccat

SEQ ID NO: 16556 - DNA, 20 bp, Artificial Sequence
  sgRNA
  Cnr2_10
ggatcatgtactccttcatg

SEQ ID NO: 16557 - DNA, 20 bp, Artificial Sequence
  sgRNA
  Cnr2_11
gctgctgatgaacaggtacg

SEQ ID NO: 16558 - DNA, 20 bp, Artificial Sequence
  sgRNA
  Cnr2_12
caacaagtccaccccatgag

SEQ ID NO: 16559 - DNA, 20 bp, Artificial Sequence
  sgRNA
  Cnr2_13
agtcgaccccgtggaagacg

SEQ ID NO: 16560 - DNA, 20 bp, Artificial Sequence
  sgRNA
  Cnr2_14
tacaaagctctagtcacccg

SEQ ID NO: 16561 - DNA, 20 bp, Artificial Sequence
  sgRNA
  Cnr2_15
tatagatgatgccggaaaag

SEQ ID NO: 16562 - DNA, 20 bp, Artificial Sequence
  sgRNA
  Cnr2_16
tggccagcagatcgccgtgg

SEQ ID NO: 16563 - DNA, 20 bp, Artificial Sequence
  sgRNA
  Cnr2_17
gttgcaggcgaagatcacgc

SEQ ID NO: 16564 - DNA, 20 bp, Artificial Sequence
  sgRNA
  Cnr2_18
tagcgttggagtcgaccccg

SEQ ID NO: 16565 - DNA, 20 bp, Artificial Sequence
  sgRNA
  Cnr2_19
agcccagtaggtagtcgtta

SEQ ID NO: 16566 - DNA, 20 bp, Artificial Sequence
  sgRNA
  Cnr2_20
ccggcatcatctatacctat

SEQ ID NO: 16567 - DNA, 20 bp, Artificial Sequence
  sgRNA
  Cntfr_1
agacgctcatactgcacgtg

SEQ ID NO: 16568 - DNA, 20 bp, Artificial Sequence
  sgRNA
  Cntfr_2
atactgcgaagcttagaact

SEQ ID NO: 16569 - DNA, 20 bp, Artificial Sequence
  sgRNA
  Cntfr_3
aacccacatgtagaaggact

SEQ ID NO: 16570 - DNA, 20 bp, Artificial Sequence
  sgRNA
  Cntfr_4
ggccgtagtgttgtgaccca

SEQ ID NO: 16571 - DNA, 20 bp, Artificial Sequence
  sgRNA
  Cntfr_5
ccatcacagatgcctacgca

SEQ ID NO: 16572 - DNA, 20 bp, Artificial Sequence
  sgRNA
  Cntfr_6
aatgtggcagcggttcttga

SEQ ID NO: 16573 - DNA, 20 bp, Artificial Sequence
  sgRNA
  Cntfr_7
tgatcctccagaaaacgtgg

SEQ ID NO: 16574 - DNA, 20 bp, Artificial Sequence
  sgRNA
  Cntfr_8
gaaggaatacatcatccagg

SEQ ID NO: 16575 - DNA, 20 bp, Artificial Sequence
  sgRNA
  Cntfr_9
cagacgctcatactgcacgt

SEQ ID NO: 16576 - DNA, 20 bp, Artificial Sequence
  sgRNA
  Cntfr_10
tttctgcgtgtagacagcgg

SEQ ID NO: 16577 - DNA, 20 bp, Artificial Sequence
  sgRNA
  Cntfr_11
atgtcacctccagccgacgg

SEQ ID NO: 16578 - DNA, 20 bp, Artificial Sequence
  sgRNA
  Cntfr_12
ctgcgtgtagacagcggcgg

SEQ ID NO: 16579 - DNA, 20 bp, Artificial Sequence
  sgRNA
  Cntfr_13
agggtcacagatcttcgtgg

SEQ ID NO: 16580 - DNA, 20 bp, Artificial Sequence
  sgRNA
  Cntfr_14
gtgtttctgcgtgtagacag

SEQ ID NO: 16581 - DNA, 20 bp, Artificial Sequence
  sgRNA
  Cntfr_15
gcacagcacagcaggcccat

SEQ ID NO: 16582 - DNA, 20 bp, Artificial Sequence
  sgRNA
  Cntfr_16
ataagtgtcagcaacgcctt

SEQ ID NO: 16583 - DNA, 20 bp, Artificial Sequence
  sgRNA
  Cntfr_17
gcttctgttgtgagatgccg

SEQ ID NO: 16584 - DNA, 20 bp, Artificial Sequence
  sgRNA
  Cntfr_18
gacatggagtgactggagcg

SEQ ID NO: 16585 - DNA, 20 bp, Artificial Sequence
  sgRNA
  Cntfr_19
gcatgtaccgaatgtggcag

SEQ ID NO: 16586 - DNA, 20 bp, Artificial Sequence
  sgRNA
  Cntfr_20
attgttggctgtggcagcag

SEQ ID NO: 16587 - DNA, 20 bp, Artificial Sequence
  sgRNA
  Cntn1_1
gatcggtacagtatggtcgg

SEQ ID NO: 16588 - DNA, 20 bp, Artificial Sequence
  sgRNA
  Cntn1_2
gtgcacggcgcagacaatcg

SEQ ID NO: 16589 - DNA, 20 bp, Artificial Sequence
  sgRNA
  Cntn1_3
tacccttcagtatcacaaag

SEQ ID NO: 16590 - DNA, 20 bp, Artificial Sequence
  sgRNA
  Cntn1_4
tgaaggaccacacaaacgtg

SEQ ID NO: 16591 - DNA, 20 bp, Artificial Sequence
  sgRNA
  Cntn1_5
ggttcgagcacacagcgacg

SEQ ID NO: 16592 - DNA, 20 bp, Artificial Sequence
  sgRNA
  Cntn1_6
acgtggacctgacaaacgat

SEQ ID NO: 16593 - DNA, 20 bp, Artificial Sequence
  sgRNA
  Cntn1_7
ttacgcatatccattaccag

SEQ ID NO: 16594 - DNA, 20 bp, Artificial Sequence
  sgRNA
  Cntn1_8
tgcgatgtagagattgccgt

SEQ ID NO: 16595 - DNA, 20 bp, Artificial Sequence
  sgRNA
  Cntn1_9
aatgcgcagctgaaacacgc

SEQ ID NO: 16596 - DNA, 20 bp, Artificial Sequence
  sgRNA
  Cntn1_10
gctccaagtcagtgccacag

SEQ ID NO: 16597 - DNA, 20 bp, Artificial Sequence
  sgRNA
  Cntn1_11
gatggagtatgaatttcgag

SEQ ID NO: 16598 - DNA, 20 bp, Artificial Sequence
  sgRNA
  Cntn1_12
cagagttgatgacagctacg

SEQ ID NO: 16599 - DNA, 20 bp, Artificial Sequence
  sgRNA
  Cntn1_13
tctcagcctcacactcgtag

SEQ ID NO: 16600 - DNA, 20 bp, Artificial Sequence
  sgRNA
  Cntn1_14
ttgtcgagagagtaccatta

SEQ ID NO: 16601 - DNA, 20 bp, Artificial Sequence
  sgRNA
  Cntn1_15
gcatagcagaaaacgcgtat

SEQ ID NO: 16602 - DNA, 20 bp, Artificial Sequence
  sgRNA
  Cntn1_16
agcccattcctaccatcagg

SEQ ID NO: 16603 - DNA, 20 bp, Artificial Sequence
  sgRNA
  Cntn1_17
gtctcgatcacatcactgga

SEQ ID NO: 16604 - DNA, 20 bp, Artificial Sequence
  sgRNA
  Cntn1_18
acagagagctgacaataacg

SEQ ID NO: 16605 - DNA, 20 bp, Artificial Sequence
  sgRNA
  Cntn1_19
ctgttcctgatatccggtgg

SEQ ID NO: 16606 - DNA, 20 bp, Artificial Sequence
  sgRNA
  Cntn1_20
gctcacgatatataatcaca

SEQ ID NO: 16607 - DNA, 20 bp, Artificial Sequence
  sgRNA
  Cntn2_1
gaccccgtgaaaacccacga

SEQ ID NO: 16608 - DNA, 20 bp, Artificial Sequence
  sgRNA
  Cntn2_2
ctcaccaccacacccccagg

SEQ ID NO: 16609 - DNA, 20 bp, Artificial Sequence
  sgRNA
  Cntn2_3
tgtgaatatcgagggcaacg

SEQ ID NO: 16610 - DNA, 20 bp, Artificial Sequence
  sgRNA
  Cntn2_4
aagggccgtgacaccgtcca

SEQ ID NO: 16611 - DNA, 20 bp, Artificial Sequence
  sgRNA
  Cntn2_5
tctggtgcagattcgaacca

SEQ ID NO: 16612 - DNA, 20 bp, Artificial Sequence
  sgRNA
  Cntn2_6
tggtgcagattcgaaccacg

SEQ ID NO: 16613 - DNA, 20 bp, Artificial Sequence
  sgRNA
  Cntn2_7
gttgatggtaagctctccag

SEQ ID NO: 16614 - DNA, 20 bp, Artificial Sequence
  sgRNA
  Cntn2_8
gttgctgtagacgaagtact

SEQ ID NO: 16615 - DNA, 20 bp, Artificial Sequence
  sgRNA
  Cntn2_9
ccgaagctacaatcgccggg

SEQ ID NO: 16616 - DNA, 20 bp, Artificial Sequence
  sgRNA
  Cntn2_10
ctagccctccagccacctat

SEQ ID NO: 16617 - DNA, 20 bp, Artificial Sequence
  sgRNA
  Cntn2_11
cctgtgctacaagacatgaa

SEQ ID NO: 16618 - DNA, 20 bp, Artificial Sequence
  sgRNA
  Cntn2_12
atccgaagctacaatcgccg

SEQ ID NO: 16619 - DNA, 20 bp, Artificial Sequence
  sgRNA
  Cntn2_13
gctgatccctgcagcccgag

SEQ ID NO: 16620 - DNA, 20 bp, Artificial Sequence
  sgRNA
  Cntn2_14
gcgttgccctcgatattcac

SEQ ID NO: 16621 - DNA, 20 bp, Artificial Sequence
  sgRNA
  Cntn2_15
atggttatactgatgctcgc

SEQ ID NO: 16622 - DNA, 20 bp, Artificial Sequence
  sgRNA
  Cntn2_16
gctacaatactgtggagcaa

SEQ ID NO: 16623 - DNA, 20 bp, Artificial Sequence
  sgRNA
  Cntn2_17
ggttcagcttagagaatcgc

SEQ ID NO: 16624 - DNA, 20 bp, Artificial Sequence
  sgRNA
  Cntn2_18
ccagtgcgtacgtctctggg

SEQ ID NO: 16625 - DNA, 20 bp, Artificial Sequence
  sgRNA
  Cntn2_19
ggcgatgtacaggttccctg

SEQ ID NO: 16626 - DNA, 20 bp, Artificial Sequence
  sgRNA
  Cntn2_20
cgaagtgacgcccatccgtt

SEQ ID NO: 16627 - DNA, 20 bp, Artificial Sequence
  sgRNA
  Cntn3_1
catcgttacaaactgaatgg

SEQ ID NO: 16628 - DNA, 20 bp, Artificial Sequence
  sgRNA
  Cntn3_2
tgtcgtggagttaaacccat

SEQ ID NO: 16629 - DNA, 20 bp, Artificial Sequence
  sgRNA
  Cntn3_3
aacattcaattgaaacacag

SEQ ID NO: 16630 - DNA, 20 bp, Artificial Sequence
  sgRNA
  Cntn3_4
cgcacctgtcacaaccaagt

SEQ ID NO: 16631 - DNA, 20 bp, Artificial Sequence
  sgRNA
  Cntn3_5
gtagccagtaacaaaatcgg

SEQ ID NO: 16632 - DNA, 20 bp, Artificial Sequence
  sgRNA
  Cntn3_6
ggaaattcaaaacttccaac

SEQ ID NO: 16633 - DNA, 20 bp, Artificial Sequence
  sgRNA
  Cntn3_7
tgtccattgctcaacttcca

SEQ ID NO: 16634 - DNA, 20 bp, Artificial Sequence
  sgRNA
  Cntn3_8
gcaccttctgaggtcagcgg

SEQ ID NO: 16635 - DNA, 20 bp, Artificial Sequence
  sgRNA
  Cntn3_9
gctctcttggacggaaggca

SEQ ID NO: 16636 - DNA, 20 bp, Artificial Sequence
  sgRNA
  Cntn3_10
aggtggtaaccccaagtggg

SEQ ID NO: 16637 - DNA, 20 bp, Artificial Sequence
  sgRNA
  Cntn3_11
ggacagctgtgtaataggcc

SEQ ID NO: 16638 - DNA, 20 bp, Artificial Sequence
  sgRNA
  Cntn3_12
ggatcatgttgaacctggca

SEQ ID NO: 16639 - DNA, 20 bp, Artificial Sequence
  sgRNA
  Cntn3_13
ttccaaacaacatttcctgg

SEQ ID NO: 16640 - DNA, 20 bp, Artificial Sequence
  sgRNA
  Cntn3_14
catcagagcgtagcaccaaa

SEQ ID NO: 16641 - DNA, 20 bp, Artificial Sequence
  sgRNA
  Cntn3_15
gtttaggcttcccacttgcc

SEQ ID NO: 16642 - DNA, 20 bp, Artificial Sequence
  sgRNA
  Cntn3_16
tcgccatatgaagttaaagt

SEQ ID NO: 16643 - DNA, 20 bp, Artificial Sequence
  sgRNA
  Cntn3_17
ggactgcatacgatataact

SEQ ID NO: 16644 - DNA, 20 bp, Artificial Sequence
  sgRNA
  Cntn3_18
gcagctgagctcatcgtgag

SEQ ID NO: 16645 - DNA, 20 bp, Artificial Sequence
  sgRNA
  Cntn3_19
acagcaacgtccatgtttga

SEQ ID NO: 16646 - DNA, 20 bp, Artificial Sequence
  sgRNA
  Cntn3_20
atcagagcgtagcaccaaag

SEQ ID NO: 16647 - DNA, 20 bp, Artificial Sequence
  sgRNA
  Cntn4_1
tctcttgagaaacgaagcgg

SEQ ID NO: 16648 - DNA, 20 bp, Artificial Sequence
  sgRNA
  Cntn4_2
tgccggttcatatgaatgtg

SEQ ID NO: 16649 - DNA, 20 bp, Artificial Sequence
  sgRNA
  Cntn4_3
gatagaatacaaatcgagca

SEQ ID NO: 16650 - DNA, 20 bp, Artificial Sequence
  sgRNA
  Cntn4_4
agctaggactccattctccg

SEQ ID NO: 16651 - DNA, 20 bp, Artificial Sequence
  sgRNA
  Cntn4_5
accaccactgacgttagccg

SEQ ID NO: 16652 - DNA, 20 bp, Artificial Sequence
  sgRNA
  Cntn4_6
ccagaaaacttcgatatccg

SEQ ID NO: 16653 - DNA, 20 bp, Artificial Sequence
  sgRNA
  Cntn4_7
gctaggactccattctccgt

SEQ ID NO: 16654 - DNA, 20 bp, Artificial Sequence
  sgRNA
  Cntn4_8
ttcagcagaatacaccagcg

SEQ ID NO: 16655 - DNA, 20 bp, Artificial Sequence
  sgRNA
  Cntn4_9
attgactgcttgccagccca

SEQ ID NO: 16656 - DNA, 20 bp, Artificial Sequence
  sgRNA
  Cntn4_10
gtaacacttgtcaaagtggg

SEQ ID NO: 16657 - DNA, 20 bp, Artificial Sequence
  sgRNA
  Cntn4_11
gccggccctcagagaaacgg

SEQ ID NO: 16658 - DNA, 20 bp, Artificial Sequence
  sgRNA
  Cntn4_12
aataataaatgatatccacg

SEQ ID NO: 16659 - DNA, 20 bp, Artificial Sequence
  sgRNA
  Cntn4_13
ggtaacacatgatcactccc

SEQ ID NO: 16660 - DNA, 20 bp, Artificial Sequence
  sgRNA
  Cntn4_14
cagtctcttgagaaacgaag

SEQ ID NO: 16661 - DNA, 20 bp, Artificial Sequence
  sgRNA
  Cntn4_15
cgtcctctgttctttccaat

SEQ ID NO: 16662 - DNA, 20 bp, Artificial Sequence
  sgRNA
  Cntn4_16
gctgcggacctgattgtaag

SEQ ID NO: 16663 - DNA, 20 bp, Artificial Sequence
  sgRNA
  Cntn4_17
acattgactgttgcactgga

SEQ ID NO: 16664 - DNA, 20 bp, Artificial Sequence
  sgRNA
  Cntn4_18
gccagaagacataagtcgaa

SEQ ID NO: 16665 - DNA, 20 bp, Artificial Sequence
  sgRNA
  Cntn4_19
tcacattagctgcaacagtg

SEQ ID NO: 16666 - DNA, 20 bp, Artificial Sequence
  sgRNA
  Cntn4_20
ccacgtaaacacaatgtcca

SEQ ID NO: 16667 - DNA, 20 bp, Artificial Sequence
  sgRNA
  Cntn5_1
tatcgctacagtctgataga

SEQ ID NO: 16668 - DNA, 20 bp, Artificial Sequence
  sgRNA
  Cntn5_2
ggagtgataaaggttgcctg

SEQ ID NO: 16669 - DNA, 20 bp, Artificial Sequence
  sgRNA
  Cntn5_3
aaagtgcaaacatccgatgt

SEQ ID NO: 16670 - DNA, 20 bp, Artificial Sequence
  sgRNA
  Cntn5_4
ctccccatgtaccgtacctg

SEQ ID NO: 16671 - DNA, 20 bp, Artificial Sequence
  sgRNA
  Cntn5_5
tctactatgaccactccagg

SEQ ID NO: 16672 - DNA, 20 bp, Artificial Sequence
  sgRNA
  Cntn5_6
aatgaaggactgctgaaccg

SEQ ID NO: 16673 - DNA, 20 bp, Artificial Sequence
  sgRNA
  Cntn5_7
ggctgtggacctaaacccct

SEQ ID NO: 16674 - DNA, 20 bp, Artificial Sequence
  sgRNA
  Cntn5_8
tagaaacagtccgaaccaga

SEQ ID NO: 16675 - DNA, 20 bp, Artificial Sequence
  sgRNA
  Cntn5_9
acgcttctaaagcagatgag

SEQ ID NO: 16676 - DNA, 20 bp, Artificial Sequence
  sgRNA
  Cntn5_10
aggatcctcaggcttccgtc

SEQ ID NO: 16677 - DNA, 20 bp, Artificial Sequence
  sgRNA
  Cntn5_11
cttcactgtttgccagccca

SEQ ID NO: 16678 - DNA, 20 bp, Artificial Sequence
  sgRNA
  Cntn5_12
agcacatcagaacaaccccc

SEQ ID NO: 16679 - DNA, 20 bp, Artificial Sequence
  sgRNA
  Cntn5_13
acaccaactttgacctcaaa

SEQ ID NO: 16680 - DNA, 20 bp, Artificial Sequence
  sgRNA
  Cntn5_14
ggtctggacttggaaccaaa

SEQ ID NO: 16681 - DNA, 20 bp, Artificial Sequence
  sgRNA
  Cntn5_15
tgcacagctgaaaactcccg

SEQ ID NO: 16682 - DNA, 20 bp, Artificial Sequence
  sgRNA
  Cntn5_16
acaaatgtagctgccaacat

SEQ ID NO: 16683 - DNA, 20 bp, Artificial Sequence
  sgRNA
  Cntn5_17
acttgattcagttcgaagga

SEQ ID NO: 16684 - DNA, 20 bp, Artificial Sequence
  sgRNA
  Cntn5_18
ttcagacctaatggaacacg

SEQ ID NO: 16685 - DNA, 20 bp, Artificial Sequence
  sgRNA
  Cntn5_19
gagtcattcgtcatgttgac

SEQ ID NO: 16686 - DNA, 20 bp, Artificial Sequence
  sgRNA
  Cntn5_20
gtgtgaatcaatcagatgct

SEQ ID NO: 16687 - DNA, 20 bp, Artificial Sequence
  sgRNA
  Cntn6_1
tatcactataggttggatgg

SEQ ID NO: 16688 - DNA, 20 bp, Artificial Sequence
  sgRNA
  Cntn6_2
tggtggggtcatgagacact

SEQ ID NO: 16689 - DNA, 20 bp, Artificial Sequence
  sgRNA
  Cntn6_3
gtgcgcagcactaaaggcgt

SEQ ID NO: 16690 - DNA, 20 bp, Artificial Sequence
  sgRNA
  Cntn6_4
aatccccaagttccaacaag

SEQ ID NO: 16691 - DNA, 20 bp, Artificial Sequence
  sgRNA
  Cntn6_5
cgaggaagaaaccttgcaaa

SEQ ID NO: 16692 - DNA, 20 bp, Artificial Sequence
  sgRNA
  Cntn6_6
catgacttatcactataggt

SEQ ID NO: 16693 - DNA, 20 bp, Artificial Sequence
  sgRNA
  Cntn6_7
gatcggaacttgtcattacg

SEQ ID NO: 16694 - DNA, 20 bp, Artificial Sequence
  sgRNA
  Cntn6_8
gtataattgcccacatcaga

SEQ ID NO: 16695 - DNA, 20 bp, Artificial Sequence
  sgRNA
  Cntn6_9
tcgtacacgtggctaaagaa

SEQ ID NO: 16696 - DNA, 20 bp, Artificial Sequence
  sgRNA
  Cntn6_10
cctgcacaagagtttatgag

SEQ ID NO: 16697 - DNA, 20 bp, Artificial Sequence
  sgRNA
  Cntn6_11
tgagagcctataacactgca

SEQ ID NO: 16698 - DNA, 20 bp, Artificial Sequence
  sgRNA
  Cntn6_12
gctcctggataaaaatagga

SEQ ID NO: 16699 - DNA, 20 bp, Artificial Sequence
  sgRNA
  Cntn6_13
gtagctgatatcattgtgag

SEQ ID NO: 16700 - DNA, 20 bp, Artificial Sequence
  sgRNA
  Cntn6_14
atccaaatccttcgtacacg

SEQ ID NO: 16701 - DNA, 20 bp, Artificial Sequence
  sgRNA
  Cntn6_15
ggaaatatcaatggaggcgg

SEQ ID NO: 16702 - DNA, 20 bp, Artificial Sequence
  sgRNA
  Cntn6_16
ttctttagccacgtgtacga

SEQ ID NO: 16703 - DNA, 20 bp, Artificial Sequence
  sgRNA
  Cntn6_17
gggtcatgagacacttggca

SEQ ID NO: 16704 - DNA, 20 bp, Artificial Sequence
  sgRNA
  Cntn6_18
gcttgccagcccacagaaaa

SEQ ID NO: 16705 - DNA, 20 bp, Artificial Sequence
  sgRNA
  Cntn6_19
gtggcaccaggaaatatcaa

SEQ ID NO: 16706 - DNA, 20 bp, Artificial Sequence
  sgRNA
  Cntn6_20
tctaaaatggatgttacagt

SEQ ID NO: 16707 - DNA, 20 bp, Artificial Sequence
  sgRNA
  Cntnap1_1
gctccactctcacgtaaggt

SEQ ID NO: 16708 - DNA, 20 bp, Artificial Sequence
  sgRNA
  Cntnap1_2
ttcctacagatattcatcgg

SEQ ID NO: 16709 - DNA, 20 bp, Artificial Sequence
  sgRNA
  Cntnap1_3
agaagtatgaagtccctgtg

SEQ ID NO: 16710 - DNA, 20 bp, Artificial Sequence
  sgRNA
  Cntnap1_4
gaggaacagcatttctactg

SEQ ID NO: 16711 - DNA, 20 bp, Artificial Sequence
  sgRNA
  Cntnap1_5
ggatgtagcgagccgtaaag

SEQ ID NO: 16712 - DNA, 20 bp, Artificial Sequence
  sgRNA
  Cntnap1_6
gccaagacctggtcacacca

SEQ ID NO: 16713 - DNA, 20 bp, Artificial Sequence
  sgRNA
  Cntnap1_7
gcttcacgttgatttcagct

SEQ ID NO: 16714 - DNA, 20 bp, Artificial Sequence
  sgRNA
  Cntnap1_8
gcatcagtggatggtcgccc

SEQ ID NO: 16715 - DNA, 20 bp, Artificial Sequence
  sgRNA
  Cntnap1_9
ggtcgttaagaacgccacca

SEQ ID NO: 16716 - DNA, 20 bp, Artificial Sequence
  sgRNA
  Cntnap1_10
ccatagtgtcaacatcaccc

SEQ ID NO: 16717 - DNA, 20 bp, Artificial Sequence
  sgRNA
  Cntnap1_11
catactaccatgacgacgga

SEQ ID NO: 16718 - DNA, 20 bp, Artificial Sequence
  sgRNA
  Cntnap1_12
atatttcccactgagccgat

SEQ ID NO: 16719 - DNA, 20 bp, Artificial Sequence
  sgRNA
  Cntnap1_13
ccgagatgcaaatttcaccc

SEQ ID NO: 16720 - DNA, 20 bp, Artificial Sequence
  sgRNA
  Cntnap1_14
cttcagcatcctgctcgcca

SEQ ID NO: 16721 - DNA, 20 bp, Artificial Sequence
  sgRNA
  Cntnap1_15
gctggaaccagtcactcgag

SEQ ID NO: 16722 - DNA, 20 bp, Artificial Sequence
  sgRNA
  Cntnap1_16
gggacttcatacttctttgg

SEQ ID NO: 16723 - DNA, 20 bp, Artificial Sequence
  sgRNA
  Cntnap1_17
gtgcctggctttccacgccg

SEQ ID NO: 16724 - DNA, 20 bp, Artificial Sequence
  sgRNA
  Cntnap1_18
ttctctaggaagacacccga

SEQ ID NO: 16725 - DNA, 20 bp, Artificial Sequence
  sgRNA
  Cntnap1_19
ggacaccattctaccaaaaa

SEQ ID NO: 16726 - DNA, 20 bp, Artificial Sequence
  sgRNA
  Cntnap1_20
accgactgcccgagtacccg

SEQ ID NO: 16727 - DNA, 20 bp, Artificial Sequence
  sgRNA
  Cntnap2_1
atttatacgaagtagcacac

SEQ ID NO: 16728 - DNA, 20 bp, Artificial Sequence
  sgRNA
  Cntnap2_2
atggaaagcatcaactacaa

SEQ ID NO: 16729 - DNA, 20 bp, Artificial Sequence
  sgRNA
  Cntnap2_3
ggcactaatctggtccatgg

SEQ ID NO: 16730 - DNA, 20 bp, Artificial Sequence
  sgRNA
  Cntnap2_4
cagatgtgtggccatagatg

SEQ ID NO: 16731 - DNA, 20 bp, Artificial Sequence
  sgRNA
  Cntnap2_5
cggtacatgttccgtcacaa

SEQ ID NO: 16732 - DNA, 20 bp, Artificial Sequence
  sgRNA
  Cntnap2_6
gctgttctggtcaagcccac

SEQ ID NO: 16733 - DNA, 20 bp, Artificial Sequence
  sgRNA
  Cntnap2_7
gctcaccctgaatgtgcacg

SEQ ID NO: 16734 - DNA, 20 bp, Artificial Sequence
  sgRNA
  Cntnap2_8
tgtgatgagacaggatacag

SEQ ID NO: 16735 - DNA, 20 bp, Artificial Sequence
  sgRNA
  Cntnap2_9
tggaagtccttacacctggt

SEQ ID NO: 16736 - DNA, 20 bp, Artificial Sequence
  sgRNA
  Cntnap2_10
caatgctacaagctacctgg

SEQ ID NO: 16737 - DNA, 20 bp, Artificial Sequence
  sgRNA
  Cntnap2_11
gagctggtggaatctaactg

SEQ ID NO: 16738 - DNA, 20 bp, Artificial Sequence
  sgRNA
  Cntnap2_12
aaatgcatcgaaaaatacca

SEQ ID NO: 16739 - DNA, 20 bp, Artificial Sequence
  sgRNA
  Cntnap2_13
gctggggcaggcgatccacc

SEQ ID NO: 16740 - DNA, 20 bp, Artificial Sequence
  sgRNA
  Cntnap2_14
gtaagccaagttccagtaat

SEQ ID NO: 16741 - DNA, 20 bp, Artificial Sequence
  sgRNA
  Cntnap2_15
ttcaagacattaatccccag

SEQ ID NO: 16742 - DNA, 20 bp, Artificial Sequence
  sgRNA
  Cntnap2_16
gcacttctctaccttccaag

SEQ ID NO: 16743 - DNA, 20 bp, Artificial Sequence
  sgRNA
  Cntnap2_17
tctgtactcattgagcgcca

SEQ ID NO: 16744 - DNA, 20 bp, Artificial Sequence
  sgRNA
  Cntnap2_18
tatgccaagattaataaacg

SEQ ID NO: 16745 - DNA, 20 bp, Artificial Sequence
  sgRNA
  Cntnap2_19
gttggggtcgttgttcatga

SEQ ID NO: 16746 - DNA, 20 bp, Artificial Sequence
  sgRNA
  Cntnap2_20
ctccattcatcctcaaggag

SEQ ID NO: 16747 - DNA, 20 bp, Artificial Sequence
  sgRNA
  Cntnap3_1
ctctgactgtcactacatcg

SEQ ID NO: 16748 - DNA, 20 bp, Artificial Sequence
  sgRNA
  Cntnap3_2
agccataagaccagtaagag

SEQ ID NO: 16749 - DNA, 20 bp, Artificial Sequence
  sgRNA
  Cntnap3_3
ttgtatcaaataaatatcag

SEQ ID NO: 16750 - DNA, 20 bp, Artificial Sequence
  sgRNA
  Cntnap3_4
aaagtcactggaattgtctg

SEQ ID NO: 16751 - DNA, 20 bp, Artificial Sequence
  sgRNA
  Cntnap3_5
tgttcgaagctgaaaagcga

SEQ ID NO: 16752 - DNA, 20 bp, Artificial Sequence
  sgRNA
  Cntnap3_6
tcaccagctgacgattaaca

SEQ ID NO: 16753 - DNA, 20 bp, Artificial Sequence
  sgRNA
  Cntnap3_7
actgcaactgtgatgctgac

SEQ ID NO: 16754 - DNA, 20 bp, Artificial Sequence
  sgRNA
  Cntnap3_8
tatgcatatgaacttcaccc

SEQ ID NO: 16755 - DNA, 20 bp, Artificial Sequence
  sgRNA
  Cntnap3_9
tctctgttgatgaacccgta

SEQ ID NO: 16756 - DNA, 20 bp, Artificial Sequence
  sgRNA
  Cntnap3_10
gttctccatgaacacaccag

SEQ ID NO: 16757 - DNA, 20 bp, Artificial Sequence
  sgRNA
  Cntnap3_11
gattcagtgcagccttcagt

SEQ ID NO: 16758 - DNA, 20 bp, Artificial Sequence
  sgRNA
  Cntnap3_12
ggctttgccaagtagtttaa

SEQ ID NO: 16759 - DNA, 20 bp, Artificial Sequence
  sgRNA
  Cntnap3_13
gtgccttctctgcctacgat

SEQ ID NO: 16760 - DNA, 20 bp, Artificial Sequence
  sgRNA
  Cntnap3_14
ggtacaagttggacagacat

SEQ ID NO: 16761 - DNA, 20 bp, Artificial Sequence
  sgRNA
  Cntnap3_15
gtttcaggatcagcatccag

SEQ ID NO: 16762 - DNA, 20 bp, Artificial Sequence
  sgRNA
  Cntnap3_16
tgacctccattcgttctcca

SEQ ID NO: 16763 - DNA, 20 bp, Artificial Sequence
  sgRNA
  Cntnap3_17
ggatctcctgctgctactag

SEQ ID NO: 16764 - DNA, 20 bp, Artificial Sequence
  sgRNA
  Cntnap3_18
aggttaaccagagtacaaag

SEQ ID NO: 16765 - DNA, 20 bp, Artificial Sequence
  sgRNA
  Cntnap3_19
gcatggactgttgttcagca

SEQ ID NO: 16766 - DNA, 20 bp, Artificial Sequence
  sgRNA
  Cntnap3_20
gcagcctgtgaagccctgag

SEQ ID NO: 16767 - DNA, 20 bp, Artificial Sequence
  sgRNA
  Cntnap4_1
ggaggaccaaataactcctg

SEQ ID NO: 16768 - DNA, 20 bp, Artificial Sequence
  sgRNA
  Cntnap4_2
ttgtgtccaacaaataccag

SEQ ID NO: 16769 - DNA, 20 bp, Artificial Sequence
  sgRNA
  Cntnap4_3
aagattgtgattacggacac

SEQ ID NO: 16770 - DNA, 20 bp, Artificial Sequence
  sgRNA
  Cntnap4_4
actcaccttgctgattaacg

SEQ ID NO: 16771 - DNA, 20 bp, Artificial Sequence
  sgRNA
  Cntnap4_5
ccaggccgccattaaccggg

SEQ ID NO: 16772 - DNA, 20 bp, Artificial Sequence
  sgRNA
  Cntnap4_6
cgcagcttcctttaataccg

SEQ ID NO: 16773 - DNA, 20 bp, Artificial Sequence
  sgRNA
  Cntnap4_7
tggaccgtcatgcagcacaa

SEQ ID NO: 16774 - DNA, 20 bp, Artificial Sequence
  sgRNA
  Cntnap4_8
agggagctcgtccacccgaa

SEQ ID NO: 16775 - DNA, 20 bp, Artificial Sequence
  sgRNA
  Cntnap4_9
gtaatcacaatcttagtgac

SEQ ID NO: 16776 - DNA, 20 bp, Artificial Sequence
  sgRNA
  Cntnap4_10
gctccctccaaagatacaag

SEQ ID NO: 16777 - DNA, 20 bp, Artificial Sequence
  sgRNA
  Cntnap4_11
tgtgaagcctataagcacca

SEQ ID NO: 16778 - DNA, 20 bp, Artificial Sequence
  sgRNA
  Cntnap4_12
ggctctttcttccagatcca

SEQ ID NO: 16779 - DNA, 20 bp, Artificial Sequence
  sgRNA
  Cntnap4_13
gtgctccgcccggttaatgg

SEQ ID NO: 16780 - DNA, 20 bp, Artificial Sequence
  sgRNA
  Cntnap4_14
gcttcctctttagtagacgc

SEQ ID NO: 16781 - DNA, 20 bp, Artificial Sequence
  sgRNA
  Cntnap4_15
ccaggttcggaattgaaagc

SEQ ID NO: 16782 - DNA, 20 bp, Artificial Sequence
  sgRNA
  Cntnap4_16
agtaatacaccagctcctgt

SEQ ID NO: 16783 - DNA, 20 bp, Artificial Sequence
  sgRNA
  Cntnap4_17
gatgtggcatcggtgccaga

SEQ ID NO: 16784 - DNA, 20 bp, Artificial Sequence
  sgRNA
  Cntnap4_18
ctcacttcaacgacaaccag

SEQ ID NO: 16785 - DNA, 20 bp, Artificial Sequence
  sgRNA
  Cntnap4_19
gcaacctggctgcaccccag

SEQ ID NO: 16786 - DNA, 20 bp, Artificial Sequence
  sgRNA
  Cntnap4_20
acatgaaagaggcatccctt

SEQ ID NO: 16787 - DNA, 20 bp, Artificial Sequence
  sgRNA
  Corin_1
ggatatgttgatagcaactg

SEQ ID NO: 16788 - DNA, 20 bp, Artificial Sequence
  sgRNA
  Corin_2
cctggaacttggacccggag

SEQ ID NO: 16789 - DNA, 20 bp, Artificial Sequence
  sgRNA
  Corin_3
cactgctgttagtctcagtg

SEQ ID NO: 16790 - DNA, 20 bp, Artificial Sequence
  sgRNA
  Corin_4
acagtttattatgagaacac

SEQ ID NO: 16791 - DNA, 20 bp, Artificial Sequence
  sgRNA
  Corin_5
ggtagactatgatatcagcg

SEQ ID NO: 16792 - DNA, 20 bp, Artificial Sequence
  sgRNA
  Corin_6
agagcagcgggctctccgca

SEQ ID NO: 16793 - DNA, 20 bp, Artificial Sequence
  sgRNA
  Corin_7
ctggtttgtgaacgacccgg

SEQ ID NO: 16794 - DNA, 20 bp, Artificial Sequence
  sgRNA
  Corin_8
gccagcacagatcatccgat

SEQ ID NO: 16795 - DNA, 20 bp, Artificial Sequence
  sgRNA
  Corin_9
ggtagggcagaatttgacac

SEQ ID NO: 16796 - DNA, 20 bp, Artificial Sequence
  sgRNA
  Corin_10
gtatttacaggaataacacc

SEQ ID NO: 16797 - DNA, 20 bp, Artificial Sequence
  sgRNA
  Corin_11
gaacggtcttggctgcgcgg

SEQ ID NO: 16798 - DNA, 20 bp, Artificial Sequence
  sgRNA
  Corin_12
gtccacttctgcattccacc

SEQ ID NO: 16799 - DNA, 20 bp, Artificial Sequence
  sgRNA
  Corin_13
ccgtcgcaccaaaggtcacg

SEQ ID NO: 16800 - DNA, 20 bp, Artificial Sequence
  sgRNA
  Corin_14
actcctccggagcaagggcg

SEQ ID NO: 16801 - DNA, 20 bp, Artificial Sequence
  sgRNA
  Corin_15
tgaacggtcttggctgcgcg

SEQ ID NO: 16802 - DNA, 20 bp, Artificial Sequence
  sgRNA
  Corin_16
gtactcctccggagcaaggg

SEQ ID NO: 16803 - DNA, 20 bp, Artificial Sequence
  sgRNA
  Corin_17
gcctcacagaaagatctaca

SEQ ID NO: 16804 - DNA, 20 bp, Artificial Sequence
  sgRNA
  Corin_18
tccccgttacagtcgagcag

SEQ ID NO: 16805 - DNA, 20 bp, Artificial Sequence
  sgRNA
  Corin_19
tctgccctaccacagcacgt

SEQ ID NO: 16806 - DNA, 20 bp, Artificial Sequence
  sgRNA
  Corin_20
ccgggtcgttcacaaaccag

SEQ ID NO: 16807 - DNA, 20 bp, Artificial Sequence
  sgRNA
  Cpd_1
gctgggcagcaaatacacgt

SEQ ID NO: 16808 - DNA, 20 bp, Artificial Sequence
  sgRNA
  Cpd_2
tggcgcgcactggtatgacg

SEQ ID NO: 16809 - DNA, 20 bp, Artificial Sequence
  sgRNA
  Cpd_3
atggagatatctgataaccc

SEQ ID NO: 16810 - DNA, 20 bp, Artificial Sequence
  sgRNA
  Cpd_4
tttgaagtaactatcgaact

SEQ ID NO: 16811 - DNA, 20 bp, Artificial Sequence
  sgRNA
  Cpd_5
aaatcacagcatctgcccga

SEQ ID NO: 16812 - DNA, 20 bp, Artificial Sequence
  sgRNA
  Cpd_6
atacctggaggagtgatgcg

SEQ ID NO: 16813 - DNA, 20 bp, Artificial Sequence
  sgRNA
  Cpd_7
acatcaacgcaattgctgat

SEQ ID NO: 16814 - DNA, 20 bp, Artificial Sequence
  sgRNA
  Cpd_8
atctgctgaagatcgaacaa

SEQ ID NO: 16815 - DNA, 20 bp, Artificial Sequence
  sgRNA
  Cpd_9
gctccgtttgttatcccatg

SEQ ID NO: 16816 - DNA, 20 bp, Artificial Sequence
  sgRNA
  Cpd_10
tatgtcagcactgatcctaa

SEQ ID NO: 16817 - DNA, 20 bp, Artificial Sequence
  sgRNA
  Cpd_11
gctgtcagccaatctgcacg

SEQ ID NO: 16818 - DNA, 20 bp, Artificial Sequence
  sgRNA
  Cpd_12
ccaagccattctcagccgaa

SEQ ID NO: 16819 - DNA, 20 bp, Artificial Sequence
  sgRNA
  Cpd_13
gtatctaaagacttcatcat

SEQ ID NO: 16820 - DNA, 20 bp, Artificial Sequence
  sgRNA
  Cpd_14
tttcctcatgggataacaaa

SEQ ID NO: 16821 - DNA, 20 bp, Artificial Sequence
  sgRNA
  Cpd_15
tgaccactactaccacgaag

SEQ ID NO: 16822 - DNA, 20 bp, Artificial Sequence
  sgRNA
  Cpd_16
gattggctgacagcacaaac

SEQ ID NO: 16823 - DNA, 20 bp, Artificial Sequence
  sgRNA
  Cpd_17
ttacccaccagcttcacctg

SEQ ID NO: 16824 - DNA, 20 bp, Artificial Sequence
  sgRNA
  Cpd_18
tgaactggtcagggaagctg

SEQ ID NO: 16825 - DNA, 20 bp, Artificial Sequence
  sgRNA
  Cpd_19
ctggaactcatggcttagga

SEQ ID NO: 16826 - DNA, 20 bp, Artificial Sequence
  sgRNA
  Cpd_20
ctgcccagcctgaacccgga

SEQ ID NO: 16827 - DNA, 20 bp, Artificial Sequence
  sgRNA
  Cpm_1
gttgtcccgaagcttaaccc

SEQ ID NO: 16828 - DNA, 20 bp, Artificial Sequence
  sgRNA
  Cpm_2
ggacggcttcgaatccatcg

SEQ ID NO: 16829 - DNA, 20 bp, Artificial Sequence
  sgRNA
  Cpm_3
gtagccgttgataatcccgt

SEQ ID NO: 16830 - DNA, 20 bp, Artificial Sequence
  sgRNA
  Cpm_4
aaatacgtggcgaatatgca

SEQ ID NO: 16831 - DNA, 20 bp, Artificial Sequence
  sgRNA
  Cpm_5
tcacgaagcttactattcca

SEQ ID NO: 16832 - DNA, 20 bp, Artificial Sequence
  sgRNA
  Cpm_6
ggatttccgatatcaccacc

SEQ ID NO: 16833 - DNA, 20 bp, Artificial Sequence
  sgRNA
  Cpm_7
gtggtgatatcggaaatcca

SEQ ID NO: 16834 - DNA, 20 bp, Artificial Sequence
  sgRNA
  Cpm_8
ggtcaagtgttcgatcagag

SEQ ID NO: 16835 - DNA, 20 bp, Artificial Sequence
  sgRNA
  Cpm_9
gtgctgtaaatatcctcgcg

SEQ ID NO: 16836 - DNA, 20 bp, Artificial Sequence
  sgRNA
  Cpm_10
tgtcatgttgggattccggg

SEQ ID NO: 16837 - DNA, 20 bp, Artificial Sequence
  sgRNA
  Cpm_11
taggctttgtggcagccgag

SEQ ID NO: 16838 - DNA, 20 bp, Artificial Sequence
  sgRNA
  Cpm_12
gtaacagtcgggcttctgga

SEQ ID NO: 16839 - DNA, 20 bp, Artificial Sequence
  sgRNA
  Cpm_13
tcaccagatagtcgatcagg

SEQ ID NO: 16840 - DNA, 20 bp, Artificial Sequence
  sgRNA
  Cpm_14
cggaatcccaacatgacaaa

SEQ ID NO: 16841 - DNA, 20 bp, Artificial Sequence
  sgRNA
  Cpm_15
gctccacctgatcgactatc

SEQ ID NO: 16842 - DNA, 20 bp, Artificial Sequence
  sgRNA
  Cpm_16
ttccccaacgggattatcaa

SEQ ID NO: 16843 - DNA, 20 bp, Artificial Sequence
  sgRNA
  Cpm_17
agccgttgataatcccgttg

SEQ ID NO: 16844 - DNA, 20 bp, Artificial Sequence
  sgRNA
  Cpm_18
catcgtccggggttaagctt

SEQ ID NO: 16845 - DNA, 20 bp, Artificial Sequence
  sgRNA
  Cpm_19
acgcctccatcccttcctgg

SEQ ID NO: 16846 - DNA, 20 bp, Artificial Sequence
  sgRNA
  Cpm_20
gtgatatcggaaatccaggg

SEQ ID NO: 16847 - DNA, 20 bp, Artificial Sequence
  sgRNA
  Cr1l_1
ttgttgagttcaatgcactg

SEQ ID NO: 16848 - DNA, 20 bp, Artificial Sequence
  sgRNA
  Cr1l_2
atgcctgggggtatctcaca

SEQ ID NO: 16849 - DNA, 20 bp, Artificial Sequence
  sgRNA
  Cr1l_3
ttaattatacttgtaatcaa

SEQ ID NO: 16850 - DNA, 20 bp, Artificial Sequence
  sgRNA
  Cr1l_4
aaggcgctctttaacctggt

SEQ ID NO: 16851 - DNA, 20 bp, Artificial Sequence
  sgRNA
  Cr1l_5
attccttgtgagataccccc

SEQ ID NO: 16852 - DNA, 20 bp, Artificial Sequence
  sgRNA
  Cr1l_6
gcgcagagcctatttaccgc

SEQ ID NO: 16853 - DNA, 20 bp, Artificial Sequence
  sgRNA
  Cr1l_7
cacggttcaccgggaacccg

SEQ ID NO: 16854 - DNA, 20 bp, Artificial Sequence
  sgRNA
  Cr1l_8
tgcgcagagcctatttaccg

SEQ ID NO: 16855 - DNA, 20 bp, Artificial Sequence
  sgRNA
  Cr1l_9
atacccatcctcacattcca

SEQ ID NO: 16856 - DNA, 20 bp, Artificial Sequence
  sgRNA
  Cr1l_10
ttgctggtacagtataagga

SEQ ID NO: 16857 - DNA, 20 bp, Artificial Sequence
  sgRNA
  Cr1l_11
ctgaggcacctatttgtgag

SEQ ID NO: 16858 - DNA, 20 bp, Artificial Sequence
  sgRNA
  Cr1l_12
tgagtgagtgaattccgtgc

SEQ ID NO: 16859 - DNA, 20 bp, Artificial Sequence
  sgRNA
  Cr1l_13
gattccagctgccatcagac

SEQ ID NO: 16860 - DNA, 20 bp, Artificial Sequence
  sgRNA
  Cr1l_14
tttactttgggtgagctgcg

SEQ ID NO: 16861 - DNA, 20 bp, Artificial Sequence
  sgRNA
  Cr1l_15
cgcagctcacccaaagtaaa

SEQ ID NO: 16862 - DNA, 20 bp, Artificial Sequence
  sgRNA
  Cr1l_16
catttactttgggtgagctg

SEQ ID NO: 16863 - DNA, 20 bp, Artificial Sequence
  sgRNA
  Cr1l_17
gttcaatgcactgaggagga

SEQ ID NO: 16864 - DNA, 20 bp, Artificial Sequence
  sgRNA
  Cr1l_18
cctggggaagcacggacaca

SEQ ID NO: 16865 - DNA, 20 bp, Artificial Sequence
  sgRNA
  Cr1l_19
ggctccttgtagccttcggc

SEQ ID NO: 16866 - DNA, 20 bp, Artificial Sequence
  sgRNA
  Cr1l_20
ttgtgagcagagactgaagg

SEQ ID NO: 16867 - DNA, 20 bp, Artificial Sequence
  sgRNA
  Cr2_1
atgttgaccagtttgttgcg

SEQ ID NO: 16868 - DNA, 20 bp, Artificial Sequence
  sgRNA
  Cr2_2
ctatacattgcacccctgag

SEQ ID NO: 16869 - DNA, 20 bp, Artificial Sequence
  sgRNA
  Cr2_3
agacggatttctataaacca

SEQ ID NO: 16870 - DNA, 20 bp, Artificial Sequence
  sgRNA
  Cr2_4
atgcaatgctcatggcacat

SEQ ID NO: 16871 - DNA, 20 bp, Artificial Sequence
  sgRNA
  Cr2_5
ggtgtcatactaataacaca

SEQ ID NO: 16872 - DNA, 20 bp, Artificial Sequence
  sgRNA
  Cr2_6
cctttattcatgaatccccc

SEQ ID NO: 16873 - DNA, 20 bp, Artificial Sequence
  sgRNA
  Cr2_7
gtcccgttgtgtataacagg

SEQ ID NO: 16874 - DNA, 20 bp, Artificial Sequence
  sgRNA
  Cr2_8
gctgctgtagaagtctccat

SEQ ID NO: 16875 - DNA, 20 bp, Artificial Sequence
  sgRNA
  Cr2_9
ctcccaccagtaaatagcca

SEQ ID NO: 16876 - DNA, 20 bp, Artificial Sequence
  sgRNA
  Cr2_10
cacagtagccccaaatcgat

SEQ ID NO: 16877 - DNA, 20 bp, Artificial Sequence
  sgRNA
  Cr2_11
tacatgactgacattccagg

SEQ ID NO: 16878 - DNA, 20 bp, Artificial Sequence
  sgRNA
  Cr2_12
cctgcttagaaacctccaag

SEQ ID NO: 16879 - DNA, 20 bp, Artificial Sequence
  sgRNA
  Cr2_13
ccaatgggaatcatactggt

SEQ ID NO: 16880 - DNA, 20 bp, Artificial Sequence
  sgRNA
  Cr2_14
atgacttcctaaaataccca

SEQ ID NO: 16881 - DNA, 20 bp, Artificial Sequence
  sgRNA
  Cr2_15
gtacatgactgacattccag

SEQ ID NO: 16882 - DNA, 20 bp, Artificial Sequence
  sgRNA
  Cr2_16
ggaaggccatgtactctcat

SEQ ID NO: 16883 - DNA, 20 bp, Artificial Sequence
  sgRNA
  Cr2_17
gaacctggcttcaccttgaa

SEQ ID NO: 16884 - DNA, 20 bp, Artificial Sequence
  sgRNA
  Cr2_18
ttccaatgagagtatagcca

SEQ ID NO: 16885 - DNA, 20 bp, Artificial Sequence
  sgRNA
  Cr2_19
gtatgacttccattacgaac

SEQ ID NO: 16886 - DNA, 20 bp, Artificial Sequence
  sgRNA
  Cr2_20
ctgagcatctgaccacttgg

SEQ ID NO: 16887 - DNA, 20 bp, Artificial Sequence
  sgRNA
  Crb1_1
gtcttggagacagcctacaa

SEQ ID NO: 16888 - DNA, 20 bp, Artificial Sequence
  sgRNA
  Crb1_2
actaaaggccgcatatcctg

SEQ ID NO: 16889 - DNA, 20 bp, Artificial Sequence
  sgRNA
  Crb1_3
acagatacacacatagcccg

SEQ ID NO: 16890 - DNA, 20 bp, Artificial Sequence
  sgRNA
  Crb1_4
gagacaacacatgtaaggta

SEQ ID NO: 16891 - DNA, 20 bp, Artificial Sequence
  sgRNA
  Crb1_5
catcattcatgcgcagtacg

SEQ ID NO: 16892 - DNA, 20 bp, Artificial Sequence
  sgRNA
  Crb1_6
cctgccctacaaacacagcg

SEQ ID NO: 16893 - DNA, 20 bp, Artificial Sequence
  sgRNA
  Crb1_7
tgatccacatttccactcga

SEQ ID NO: 16894 - DNA, 20 bp, Artificial Sequence
  sgRNA
  Crb1_8
acatgtcaggacgctccagg

SEQ ID NO: 16895 - DNA, 20 bp, Artificial Sequence
  sgRNA
  Crb1_9
gagccatctctaatcaccca

SEQ ID NO: 16896 - DNA, 20 bp, Artificial Sequence
  sgRNA
  Crb1_10
agacacctccattatgacag

SEQ ID NO: 16897 - DNA, 20 bp, Artificial Sequence
  sgRNA
  Crb1_11
cagtggcccagacctcccgg

SEQ ID NO: 16898 - DNA, 20 bp, Artificial Sequence
  sgRNA
  Crb1_12
gtttccatatagaccctctg

SEQ ID NO: 16899 - DNA, 20 bp, Artificial Sequence
  sgRNA
  Crb1_13
agatgactccacaggatatg

SEQ ID NO: 16900 - DNA, 20 bp, Artificial Sequence
  sgRNA
  Crb1_14
ggtaggacaggagctgaaag

SEQ ID NO: 16901 - DNA, 20 bp, Artificial Sequence
  sgRNA
  Crb1_15
gcaacttcacttatcacaaa

SEQ ID NO: 16902 - DNA, 20 bp, Artificial Sequence
  sgRNA
  Crb1_16
ccacttgtgtgaaaatccca

SEQ ID NO: 16903 - DNA, 20 bp, Artificial Sequence
  sgRNA
  Crb1_17
caaagttccggagccaacag

SEQ ID NO: 16904 - DNA, 20 bp, Artificial Sequence
  sgRNA
  Crb1_18
gtcagtgtctggctagagca

SEQ ID NO: 16905 - DNA, 20 bp, Artificial Sequence
  sgRNA
  Crb1_19
acaccactgaacttgctcgc

SEQ ID NO: 16906 - DNA, 20 bp, Artificial Sequence
  sgRNA
  Crb1_20
aggcagttggagcctgtata

SEQ ID NO: 16907 - DNA, 20 bp, Artificial Sequence
  sgRNA
  Crb2_1
gactgcccgagaccttaccg

SEQ ID NO: 16908 - DNA, 20 bp, Artificial Sequence
  sgRNA
  Crb2_2
aaggcccataggtccccggt

SEQ ID NO: 16909 - DNA, 20 bp, Artificial Sequence
  sgRNA
  Crb2_3
tctgacccgaccttgtacgg

SEQ ID NO: 16910 - DNA, 20 bp, Artificial Sequence
  sgRNA
  Crb2_4
actctcgagacatggcactg

SEQ ID NO: 16911 - DNA, 20 bp, Artificial Sequence
  sgRNA
  Crb2_5
ggtggagcgtcacttccacc

SEQ ID NO: 16912 - DNA, 20 bp, Artificial Sequence
  sgRNA
  Crb2_6
cgttacccttggcgccaccg

SEQ ID NO: 16913 - DNA, 20 bp, Artificial Sequence
  sgRNA
  Crb2_7
gtgaacatacgggtccgcca

SEQ ID NO: 16914 - DNA, 20 bp, Artificial Sequence
  sgRNA
  Crb2_8
ggaagtcgccaagtgccacg

SEQ ID NO: 16915 - DNA, 20 bp, Artificial Sequence
  sgRNA
  Crb2_9
tagatggagtaggatcccgg

SEQ ID NO: 16916 - DNA, 20 bp, Artificial Sequence
  sgRNA
  Crb2_10
ggtgcggaggaaaaatgaca

SEQ ID NO: 16917 - DNA, 20 bp, Artificial Sequence
  sgRNA
  Crb2_11
ctctgacccgaccttgtacg

SEQ ID NO: 16918 - DNA, 20 bp, Artificial Sequence
  sgRNA
  Crb2_12
tactcagccatgccaccacg

SEQ ID NO: 16919 - DNA, 20 bp, Artificial Sequence
  sgRNA
  Crb2_13
aaggtctcgggcagtcgcag

SEQ ID NO: 16920 - DNA, 20 bp, Artificial Sequence
  sgRNA
  Crb2_14
gagggcagcgacactcgaag

SEQ ID NO: 16921 - DNA, 20 bp, Artificial Sequence
  sgRNA
  Crb2_15
ggtcagcgcggatctcgcag

SEQ ID NO: 16922 - DNA, 20 bp, Artificial Sequence
  sgRNA
  Crb2_16
tggagcgacatgggtcagcg

SEQ ID NO: 16923 - DNA, 20 bp, Artificial Sequence
  sgRNA
  Crb2_17
gcgacactcgaagcggccgt

SEQ ID NO: 16924 - DNA, 20 bp, Artificial Sequence
  sgRNA
  Crb2_18
ggcaaactggagcaacaggc

SEQ ID NO: 16925 - DNA, 20 bp, Artificial Sequence
  sgRNA
  Crb2_19
cctagcccgggagttcccac

SEQ ID NO: 16926 - DNA, 20 bp, Artificial Sequence
  sgRNA
  Crb2_20
tgcccactccaatatctggt

SEQ ID NO: 16927 - DNA, 20 bp, Artificial Sequence
  sgRNA
  Crb3_1
ccaggtgatgagtccaacgg

SEQ ID NO: 16928 - DNA, 20 bp, Artificial Sequence
  sgRNA
  Crb3_2
acagtcccactgctataagg

SEQ ID NO: 16929 - DNA, 20 bp, Artificial Sequence
  sgRNA
  Crb3_3
cctacctgttaggctccagc

SEQ ID NO: 16930 - DNA, 20 bp, Artificial Sequence
  sgRNA
  Crb3_4
aatagcacaactcaaccccc

SEQ ID NO: 16931 - DNA, 20 bp, Artificial Sequence
  sgRNA
  Crb3_5
ggtttgccgatgctgccctc

SEQ ID NO: 16932 - DNA, 20 bp, Artificial Sequence
  sgRNA
  Crb3_6
gactccaaggagccagtgcg

SEQ ID NO: 16933 - DNA, 20 bp, Artificial Sequence
  sgRNA
  Crb3_7
ccgttggactcatcacctgg

SEQ ID NO: 16934 - DNA, 20 bp, Artificial Sequence
  sgRNA
  Crb3_8
cccaggtgatgagtccaacg

SEQ ID NO: 16935 - DNA, 20 bp, Artificial Sequence
  sgRNA
  Crb3_9
tataaggaggactcccagaa

SEQ ID NO: 16936 - DNA, 20 bp, Artificial Sequence
  sgRNA
  Crb3_10
tgcgaaaacttcgggaaaag

SEQ ID NO: 16937 - DNA, 20 bp, Artificial Sequence
  sgRNA
  Crb3_11
ttctgctcatgcgaaaactt

SEQ ID NO: 16938 - DNA, 20 bp, Artificial Sequence
  sgRNA
  Crb3_12
aatggaaaagaccacagtga

SEQ ID NO: 16939 - DNA, 20 bp, Artificial Sequence
  sgRNA
  Crb3_13
gagttgtgctatttgtgaaa

SEQ ID NO: 16940 - DNA, 20 bp, Artificial Sequence
  sgRNA
  Crb3_14
ggctattgtagccatcactg

SEQ ID NO: 16941 - DNA, 20 bp, Artificial Sequence
  sgRNA
  Crb3_15
gggagtcctccttatagcag

SEQ ID NO: 16942 - DNA, 20 bp, Artificial Sequence
  sgRNA
  Crb3_16
ggagtcctccttatagcagt

SEQ ID NO: 16943 - DNA, 20 bp, Artificial Sequence
  sgRNA
  Crb3_17
actggctccttggagtcctg

SEQ ID NO: 16944 - DNA, 20 bp, Artificial Sequence
  sgRNA
  Crb3_18
cccagcagtgaggagcaggt

SEQ ID NO: 16945 - DNA, 20 bp, Artificial Sequence
  sgRNA
  Crb3_19
tcaagctgcccccggaggag

SEQ ID NO: 16946 - DNA, 20 bp, Artificial Sequence
  sgRNA
  Crb3_20
ggcagacagagggcacctac

SEQ ID NO: 16947 - DNA, 20 bp, Artificial Sequence
  sgRNA
  Crhr1_1
gagctggaccacaaaccacg

SEQ ID NO: 16948 - DNA, 20 bp, Artificial Sequence
  sgRNA
  Crhr1_2
ggtggagtacgtgagtacga

SEQ ID NO: 16949 - DNA, 20 bp, Artificial Sequence
  sgRNA
  Crhr1_3
ggcactcagaataattcaca

SEQ ID NO: 16950 - DNA, 20 bp, Artificial Sequence
  sgRNA
  Crhr1_4
cctgcagtgcaatgcctccg

SEQ ID NO: 16951 - DNA, 20 bp, Artificial Sequence
  sgRNA
  Crhr1_5
gtcgtagtaaagtttcccaa

SEQ ID NO: 16952 - DNA, 20 bp, Artificial Sequence
  sgRNA
  Crhr1_6
tcgccgccacctcttccgga

SEQ ID NO: 16953 - DNA, 20 bp, Artificial Sequence
  sgRNA
  Crhr1_7
gcactccatcagagcccgag

SEQ ID NO: 16954 - DNA, 20 bp, Artificial Sequence
  sgRNA
  Crhr1_8
ggatgatgttcctcaggcac

SEQ ID NO: 16955 - DNA, 20 bp, Artificial Sequence
  sgRNA
  Crhr1_9
tcatcctgcgcaacgccacg

SEQ ID NO: 16956 - DNA, 20 bp, Artificial Sequence
  sgRNA
  Crhr1_10
tggagacctcgtcctcccca

SEQ ID NO: 16957 - DNA, 20 bp, Artificial Sequence
  sgRNA
  Crhr1_11
gttgacgaagaacaacatgt

SEQ ID NO: 16958 - DNA, 20 bp, Artificial Sequence
  sgRNA
  Crhr1_12
gccgtcatcatcaactacct

SEQ ID NO: 16959 - DNA, 20 bp, Artificial Sequence
  sgRNA
  Crhr1_13
atgttcgtctgcatcggctg

SEQ ID NO: 16960 - DNA, 20 bp, Artificial Sequence
  sgRNA
  Crhr1_14
tgttgttcttcgtcaaccct

SEQ ID NO: 16961 - DNA, 20 bp, Artificial Sequence
  sgRNA
  Crhr1_15
ggtgccaatgaggtccacgg

SEQ ID NO: 16962 - DNA, 20 bp, Artificial Sequence
  sgRNA
  Crhr1_16
ggacaccgtagaaaaaggca

SEQ ID NO: 16963 - DNA, 20 bp, Artificial Sequence
  sgRNA
  Crhr1_17
gcaggatgaaagccgagatg

SEQ ID NO: 16964 - DNA, 20 bp, Artificial Sequence
  sgRNA
  Crhr1_18
gcagtgtgagagcctgtccc

SEQ ID NO: 16965 - DNA, 20 bp, Artificial Sequence
  sgRNA
  Crhr1_19
tatactgactacatctacca

SEQ ID NO: 16966 - DNA, 20 bp, Artificial Sequence
  sgRNA
  Crhr1_20
gcactcagaataattcacac

SEQ ID NO: 16967 - DNA, 20 bp, Artificial Sequence
  sgRNA
  Crhr2_1
atcgaccacgaagtgcacga

SEQ ID NO: 16968 - DNA, 20 bp, Artificial Sequence
  sgRNA
  Crhr2_2
gtattggattgtctcggacg

SEQ ID NO: 16969 - DNA, 20 bp, Artificial Sequence
  sgRNA
  Crhr2_3
tcattctgagaaacatcgcg

SEQ ID NO: 16970 - DNA, 20 bp, Artificial Sequence
  sgRNA
  Crhr2_4
cttctttgtcaatcctggcg

SEQ ID NO: 16971 - DNA, 20 bp, Artificial Sequence
  sgRNA
  Crhr2_5
tgtaggtgatgcccaacagg

SEQ ID NO: 16972 - DNA, 20 bp, Artificial Sequence
  sgRNA
  Crhr2_6
tgtggagtacgtcatgacaa

SEQ ID NO: 16973 - DNA, 20 bp, Artificial Sequence
  sgRNA
  Crhr2_7
ccgtgccccgagtacttcaa

SEQ ID NO: 16974 - DNA, 20 bp, Artificial Sequence
  sgRNA
  Crhr2_8
acctaagactcaaacggcgg

SEQ ID NO: 16975 - DNA, 20 bp, Artificial Sequence
  sgRNA
  Crhr2_9
tgatgccattgaagtactcg

SEQ ID NO: 16976 - DNA, 20 bp, Artificial Sequence
  sgRNA
  Crhr2_10
ggatcacattcctcaggcag

SEQ ID NO: 16977 - DNA, 20 bp, Artificial Sequence
  sgRNA
  Crhr2_11
caaacctaagactcaaacgg

SEQ ID NO: 16978 - DNA, 20 bp, Artificial Sequence
  sgRNA
  Crhr2_12
gccgtccaggagcagctctt

SEQ ID NO: 16979 - DNA, 20 bp, Artificial Sequence
  sgRNA
  Crhr2_13
gcgcggccctgagaaagcgg

SEQ ID NO: 16980 - DNA, 20 bp, Artificial Sequence
  sgRNA
  Crhr2_14
agtcatccaccagccctcga

SEQ ID NO: 16981 - DNA, 20 bp, Artificial Sequence
  sgRNA
  Crhr2_15
ggagggctgctacctgcaca

SEQ ID NO: 16982 - DNA, 20 bp, Artificial Sequence
  sgRNA
  Crhr2_16
cctgccctatcatcatcgcc

SEQ ID NO: 16983 - DNA, 20 bp, Artificial Sequence
  sgRNA
  Crhr2_17
actgccacaggaccacaact

SEQ ID NO: 16984 - DNA, 20 bp, Artificial Sequence
  sgRNA
  Crhr2_18
caggcgatgatgatagggca

SEQ ID NO: 16985 - DNA, 20 bp, Artificial Sequence
  sgRNA
  Crhr2_19
cgtccgagacaatccaatac

SEQ ID NO: 16986 - DNA, 20 bp, Artificial Sequence
  sgRNA
  Crhr2_20
gccgaagagctgctcctgga

SEQ ID NO: 16987 - DNA, 20 bp, Artificial Sequence
  sgRNA
  Crim1_1
tggccatcatcataagaacg

SEQ ID NO: 16988 - DNA, 20 bp, Artificial Sequence
  sgRNA
  Crim1_2
gagagaaccgcacttcacag

SEQ ID NO: 16989 - DNA, 20 bp, Artificial Sequence
  sgRNA
  Crim1_3
acagctacgaaacgcaagtg

SEQ ID NO: 16990 - DNA, 20 bp, Artificial Sequence
  sgRNA
  Crim1_4
aggtggatcaatcgtgatgt

SEQ ID NO: 16991 - DNA, 20 bp, Artificial Sequence
  sgRNA
  Crim1_5
gtaaaggacagcactccccg

SEQ ID NO: 16992 - DNA, 20 bp, Artificial Sequence
  sgRNA
  Crim1_6
tctatttgccacgcccccgg

SEQ ID NO: 16993 - DNA, 20 bp, Artificial Sequence
  sgRNA
  Crim1_7
gctcggcacagggtaacggt

SEQ ID NO: 16994 - DNA, 20 bp, Artificial Sequence
  sgRNA
  Crim1_8
ggatcaatcgtgatgtaggt

SEQ ID NO: 16995 - DNA, 20 bp, Artificial Sequence
  sgRNA
  Crim1_9
ctgtgacgagtccaagtgcg

SEQ ID NO: 16996 - DNA, 20 bp, Artificial Sequence
  sgRNA
  Crim1_10
tctccacgagagactattcg

SEQ ID NO: 16997 - DNA, 20 bp, Artificial Sequence
  sgRNA
  Crim1_11
gatggagtcgccattgagcg

SEQ ID NO: 16998 - DNA, 20 bp, Artificial Sequence
  sgRNA
  Crim1_12
gcagctgacggtcgagcaga

SEQ ID NO: 16999 - DNA, 20 bp, Artificial Sequence
  sgRNA
  Crim1_13
gcagaaacagaaccatctac

SEQ ID NO: 17000 - DNA, 20 bp, Artificial Sequence
  sgRNA
  Crim1_14
gcagcactgtccggaacgaa

SEQ ID NO: 17001 - DNA, 20 bp, Artificial Sequence
  sgRNA
  Crim1_15
ccggctgcaacataatcaat

SEQ ID NO: 17002 - DNA, 20 bp, Artificial Sequence
  sgRNA
  Crim1_16
tgtttcgaatggacaactgt

SEQ ID NO: 17003 - DNA, 20 bp, Artificial Sequence
  sgRNA
  Crim1_17
tcgcacttggactcgtcaca

SEQ ID NO: 17004 - DNA, 20 bp, Artificial Sequence
  sgRNA
  Crim1_18
tatctctgtaatctacctgg

SEQ ID NO: 17005 - DNA, 20 bp, Artificial Sequence
  sgRNA
  Crim1_19
gcgtttcgtagctgtccagg

SEQ ID NO: 17006 - DNA, 20 bp, Artificial Sequence
  sgRNA
  Crim1_20
gtagatcccacctcacaaac

SEQ ID NO: 17007 - DNA, 20 bp, Artificial Sequence
  sgRNA
  Crlf2_1
ggaagtcatagcagcgtacg

SEQ ID NO: 17008 - DNA, 20 bp, Artificial Sequence
  sgRNA
  Crlf2_2
cccacaccactcacgccagg

SEQ ID NO: 17009 - DNA, 20 bp, Artificial Sequence
  sgRNA
  Crlf2_3
gcgccggacaggaaatatcg

SEQ ID NO: 17010 - DNA, 20 bp, Artificial Sequence
  sgRNA
  Crlf2_4
agcggtgacaaggctttccg

SEQ ID NO: 17011 - DNA, 20 bp, Artificial Sequence
  sgRNA
  Crlf2_5
gcaatgacgatgaggacgcc

SEQ ID NO: 17012 - DNA, 20 bp, Artificial Sequence
  sgRNA
  Crlf2_6
cgactgtgacatcacctgcg

SEQ ID NO: 17013 - DNA, 20 bp, Artificial Sequence
  sgRNA
  Crlf2_7
gctgctctggacaccagacg

SEQ ID NO: 17014 - DNA, 20 bp, Artificial Sequence
  sgRNA
  Crlf2_8
ctgcctagccttaaacacca

SEQ ID NO: 17015 - DNA, 20 bp, Artificial Sequence
  sgRNA
  Crlf2_9
ggagacggtggaggtcacgt

SEQ ID NO: 17016 - DNA, 20 bp, Artificial Sequence
  sgRNA
  Crlf2_10
gacgactgtgacatcacctg

SEQ ID NO: 17017 - DNA, 20 bp, Artificial Sequence
  sgRNA
  Crlf2_11
gagacggtggaggtcacgtg

SEQ ID NO: 17018 - DNA, 20 bp, Artificial Sequence
  sgRNA
  Crlf2_12
ccacccagcttcgagccaag

SEQ ID NO: 17019 - DNA, 20 bp, Artificial Sequence
  sgRNA
  Crlf2_13
acgttcatggtgggcgacag

SEQ ID NO: 17020 - DNA, 20 bp, Artificial Sequence
  sgRNA
  Crlf2_14
agatgacctcatccacacca

SEQ ID NO: 17021 - DNA, 20 bp, Artificial Sequence
  sgRNA
  Crlf2_15
tcatccacaccaaggctaag

SEQ ID NO: 17022 - DNA, 20 bp, Artificial Sequence
  sgRNA
  Crlf2_16
cgatatttcctgtccggcgc

SEQ ID NO: 17023 - DNA, 20 bp, Artificial Sequence
  sgRNA
  Crlf2_17
cgccggacaggaaatatcgc

SEQ ID NO: 17024 - DNA, 20 bp, Artificial Sequence
  sgRNA
  Crlf2_18
gatgcttctcaaagagtcca

SEQ ID NO: 17025 - DNA, 20 bp, Artificial Sequence
  sgRNA
  Crlf2_19
gctgtcgcccaccatgaacg

SEQ ID NO: 17026 - DNA, 20 bp, Artificial Sequence
  sgRNA
  Crlf2_20
ctacctgggcctggactacg

SEQ ID NO: 17027 - DNA, 20 bp, Artificial Sequence
  sgRNA
  Crtam_1
gtccaatgtaactctccgag

SEQ ID NO: 17028 - DNA, 20 bp, Artificial Sequence
  sgRNA
  Crtam_2
tgctgggaacatacctaaca

SEQ ID NO: 17029 - DNA, 20 bp, Artificial Sequence
  sgRNA
  Crtam_3
gcactgcattatccagcacg

SEQ ID NO: 17030 - DNA, 20 bp, Artificial Sequence
  sgRNA
  Crtam_4
tctgaaaatggagaccgtca

SEQ ID NO: 17031 - DNA, 20 bp, Artificial Sequence
  sgRNA
  Crtam_5
gttgcatgaactacatcacg

SEQ ID NO: 17032 - DNA, 20 bp, Artificial Sequence
  sgRNA
  Crtam_6
tgtacttgtgggctgctgga

SEQ ID NO: 17033 - DNA, 20 bp, Artificial Sequence
  sgRNA
  Crtam_7
cagatcaagatccaacaacg

SEQ ID NO: 17034 - DNA, 20 bp, Artificial Sequence
  sgRNA
  Crtam_8
gtgctggataatgcagtgca

SEQ ID NO: 17035 - DNA, 20 bp, Artificial Sequence
  sgRNA
  Crtam_9
tctgagaaccaaagcttcca

SEQ ID NO: 17036 - DNA, 20 bp, Artificial Sequence
  sgRNA
  Crtam_10
gcacccagaacagcaaactg

SEQ ID NO: 17037 - DNA, 20 bp, Artificial Sequence
  sgRNA
  Crtam_11
ttcctctcggagagttacat

SEQ ID NO: 17038 - DNA, 20 bp, Artificial Sequence
  sgRNA
  Crtam_12
gtgtatacatgcttgcacta

SEQ ID NO: 17039 - DNA, 20 bp, Artificial Sequence
  sgRNA
  Crtam_13
agcatacaggactggcccgg

SEQ ID NO: 17040 - DNA, 20 bp, Artificial Sequence
  sgRNA
  Crtam_14
gcccagcactggaagctcgg

SEQ ID NO: 17041 - DNA, 20 bp, Artificial Sequence
  sgRNA
  Crtam_15
cttgatctgcaactaaaaag

SEQ ID NO: 17042 - DNA, 20 bp, Artificial Sequence
  sgRNA
  Crtam_16
cactgcattatccagcacga

SEQ ID NO: 17043 - DNA, 20 bp, Artificial Sequence
  sgRNA
  Crtam_17
aaaaaaatggtgaacccaga

SEQ ID NO: 17044 - DNA, 20 bp, Artificial Sequence
  sgRNA
  Crtam_18
aatgtaactctccgagagga

SEQ ID NO: 17045 - DNA, 20 bp, Artificial Sequence
  sgRNA
  Crtam_19
gagaccgtcacggtagagga

SEQ ID NO: 17046 - DNA, 20 bp, Artificial Sequence
  sgRNA
  Crtam_20
ggacaagccagggtcttgag

SEQ ID NO: 17047 - DNA, 20 bp, Artificial Sequence
  sgRNA
  Csf1_1
tttgctaagtgctctagccg

SEQ ID NO: 17048 - DNA, 20 bp, Artificial Sequence
  sgRNA
  Csf1_2
tccattccctaaatcaacag

SEQ ID NO: 17049 - DNA, 20 bp, Artificial Sequence
  sgRNA
  Csf1_3
gtgccaagcagcgaccaccc

SEQ ID NO: 17050 - DNA, 20 bp, Artificial Sequence
  sgRNA
  Csf1_4
ggtgtccattcccaatcatg

SEQ ID NO: 17051 - DNA, 20 bp, Artificial Sequence
  sgRNA
  Csf1_5
gcctgggtcctctatgcgaa

SEQ ID NO: 17052 - DNA, 20 bp, Artificial Sequence
  sgRNA
  Csf1_6
ccaatgctaacgccaccgag

SEQ ID NO: 17053 - DNA, 20 bp, Artificial Sequence
  sgRNA
  Csf1_7
tgttgactcgagggtctggc

SEQ ID NO: 17054 - DNA, 20 bp, Artificial Sequence
  sgRNA
  Csf1_8
atagggttcacctctgtcaa

SEQ ID NO: 17055 - DNA, 20 bp, Artificial Sequence
  sgRNA
  Csf1_9
gaagcagtaactgagcaacg

SEQ ID NO: 17056 - DNA, 20 bp, Artificial Sequence
  sgRNA
  Csf1_10
ggattcggtgtcgcaatatg

SEQ ID NO: 17057 - DNA, 20 bp, Artificial Sequence
  sgRNA
  Csf1_11
cttgccctcaagctccccaa

SEQ ID NO: 17058 - DNA, 20 bp, Artificial Sequence
  sgRNA
  Csf1_12
ggatgattctcagaggacag

SEQ ID NO: 17059 - DNA, 20 bp, Artificial Sequence
  sgRNA
  Csf1_13
ctggtggtcttcacgcagcg

SEQ ID NO: 17060 - DNA, 20 bp, Artificial Sequence
  sgRNA
  Csf1_14
tgagggcaagagaagtacca

SEQ ID NO: 17061 - DNA, 20 bp, Artificial Sequence
  sgRNA
  Csf1_15
gctgagttgctgactcgttg

SEQ ID NO: 17062 - DNA, 20 bp, Artificial Sequence
  sgRNA
  Csf1_16
cacaacctcatccttctgcg

SEQ ID NO: 17063 - DNA, 20 bp, Artificial Sequence
  sgRNA
  Csf1_17
ccaatgtctgagggtctcga

SEQ ID NO: 17064 - DNA, 20 bp, Artificial Sequence
  sgRNA
  Csf1_18
catgagcaggagtattgcca

SEQ ID NO: 17065 - DNA, 20 bp, Artificial Sequence
  sgRNA
  Csf1_19
tcttgccctcaagctcccca

SEQ ID NO: 17066 - DNA, 20 bp, Artificial Sequence
  sgRNA
  Csf1_20
ttgccctcaagctccccaag

SEQ ID NO: 17067 - DNA, 20 bp, Artificial Sequence
  sgRNA
  Csf1r_1
gataacgttgaatcccactt

SEQ ID NO: 17068 - DNA, 20 bp, Artificial Sequence
  sgRNA
  Csf1r_2
aagatcatcgagagatacga

SEQ ID NO: 17069 - DNA, 20 bp, Artificial Sequence
  sgRNA
  Csf1r_3
ttcaagctcggtacaacggt

SEQ ID NO: 17070 - DNA, 20 bp, Artificial Sequence
  sgRNA
  Csf1r_4
cggataatgaaccctcgcca

SEQ ID NO: 17071 - DNA, 20 bp, Artificial Sequence
  sgRNA
  Csf1r_5
acttcttctcgccatggcga

SEQ ID NO: 17072 - DNA, 20 bp, Artificial Sequence
  sgRNA
  Csf1r_6
tgaatgatcactttgtcgaa

SEQ ID NO: 17073 - DNA, 20 bp, Artificial Sequence
  sgRNA
  Csf1r_7
ttcgagctgctacgtcccgg

SEQ ID NO: 17074 - DNA, 20 bp, Artificial Sequence
  sgRNA
  Csf1r_8
tcagggtgtagacacctacg

SEQ ID NO: 17075 - DNA, 20 bp, Artificial Sequence
  sgRNA
  Csf1r_9
tgttgttcactaggatgccg

SEQ ID NO: 17076 - DNA, 20 bp, Artificial Sequence
  sgRNA
  Csf1r_10
ctttctccgaaggaaggccg

SEQ ID NO: 17077 - DNA, 20 bp, Artificial Sequence
  sgRNA
  Csf1r_11
ggattccctaccattcacca

SEQ ID NO: 17078 - DNA, 20 bp, Artificial Sequence
  sgRNA
  Csf1r_12
gcgagggttcattatccgca

SEQ ID NO: 17079 - DNA, 20 bp, Artificial Sequence
  sgRNA
  Csf1r_13
gctaacctgccaagcagcgg

SEQ ID NO: 17080 - DNA, 20 bp, Artificial Sequence
  sgRNA
  Csf1r_14
agtcctggtcaggactccga

SEQ ID NO: 17081 - DNA, 20 bp, Artificial Sequence
  sgRNA
  Csf1r_15
gcttgagtttatcacccaaa

SEQ ID NO: 17082 - DNA, 20 bp, Artificial Sequence
  sgRNA
  Csf1r_16
gagtgaagagggactcatcg

SEQ ID NO: 17083 - DNA, 20 bp, Artificial Sequence
  sgRNA
  Csf1r_17
cgaaacgtgctgttgaccag

SEQ ID NO: 17084 - DNA, 20 bp, Artificial Sequence
  sgRNA
  Csf1r_18
gctggtgcggattcgagggg

SEQ ID NO: 17085 - DNA, 20 bp, Artificial Sequence
  sgRNA
  Csf1r_19
agagcccccacagataaaat

SEQ ID NO: 17086 - DNA, 20 bp, Artificial Sequence
  sgRNA
  Csf1r_20
gctgggtcctagcatagcct

SEQ ID NO: 17087 - DNA, 20 bp, Artificial Sequence
  sgRNA
  Csf2ra_1
aggacgcggtgacgtcacgt

SEQ ID NO: 17088 - DNA, 20 bp, Artificial Sequence
  sgRNA
  Csf2ra_2
cctacttggtcgtgaccggt

SEQ ID NO: 17089 - DNA, 20 bp, Artificial Sequence
  sgRNA
  Csf2ra_3
ctagcgtcactaacccagaa

SEQ ID NO: 17090 - DNA, 20 bp, Artificial Sequence
  sgRNA
  Csf2ra_4
tgacatccagcgtgacaccg

SEQ ID NO: 17091 - DNA, 20 bp, Artificial Sequence
  sgRNA
  Csf2ra_5
cgcgcaggaaaggaagcgcg

SEQ ID NO: 17092 - DNA, 20 bp, Artificial Sequence
  sgRNA
  Csf2ra_6
cgtcaccgtgacgttccccg

SEQ ID NO: 17093 - DNA, 20 bp, Artificial Sequence
  sgRNA
  Csf2ra_7
aaccagcagcggcaaccgaa

SEQ ID NO: 17094 - DNA, 20 bp, Artificial Sequence
  sgRNA
  Csf2ra_8
aggatgatggcgctgcacca

SEQ ID NO: 17095 - DNA, 20 bp, Artificial Sequence
  sgRNA
  Csf2ra_9
gcggttcctggacgacgtgg

SEQ ID NO: 17096 - DNA, 20 bp, Artificial Sequence
  sgRNA
  Csf2ra_10
gtgtgatgacgtcatccccg

SEQ ID NO: 17097 - DNA, 20 bp, Artificial Sequence
  sgRNA
  Csf2ra_11
aggtcagcgtccgagtccag

SEQ ID NO: 17098 - DNA, 20 bp, Artificial Sequence
  sgRNA
  Csf2ra_12
aggctgagcttcgtcaacga

SEQ ID NO: 17099 - DNA, 20 bp, Artificial Sequence
  sgRNA
  Csf2ra_13
tcacgacgtggcgcgatgca

SEQ ID NO: 17100 - DNA, 20 bp, Artificial Sequence
  sgRNA
  Csf2ra_14
tgaccttgtgacctccgtgg

SEQ ID NO: 17101 - DNA, 20 bp, Artificial Sequence
  sgRNA
  Csf2ra_15
ggtgtcacgctggatgtcaa

SEQ ID NO: 17102 - DNA, 20 bp, Artificial Sequence
  sgRNA
  Csf2ra_16
cagcgagtaccggacgtccg

SEQ ID NO: 17103 - DNA, 20 bp, Artificial Sequence
  sgRNA
  Csf2ra_17
gacgcggtgacgtcacgtgg

SEQ ID NO: 17104 - DNA, 20 bp, Artificial Sequence
  sgRNA
  Csf2ra_18
tgaggactcgcagcgagtac

SEQ ID NO: 17105 - DNA, 20 bp, Artificial Sequence
  sgRNA
  Csf2ra_19
gtgtatccccgcctcccgcg

SEQ ID NO: 17106 - DNA, 20 bp, Artificial Sequence
  sgRNA
  Csf2ra_20
cacaaggtcaaggtgcgcgc

SEQ ID NO: 17107 - DNA, 20 bp, Artificial Sequence
  sgRNA
  Csf2rb_1
tacacttggaagactgactg

SEQ ID NO: 17108 - DNA, 20 bp, Artificial Sequence
  sgRNA
  Csf2rb_2
tgatggaaaatcgtgtatag

SEQ ID NO: 17109 - DNA, 20 bp, Artificial Sequence
  sgRNA
  Csf2rb_3
gaagaaatcggacagctggg

SEQ ID NO: 17110 - DNA, 20 bp, Artificial Sequence
  sgRNA
  Csf2rb_4
tggagactgtaggcatcctg

SEQ ID NO: 17111 - DNA, 20 bp, Artificial Sequence
  sgRNA
  Csf2rb_5
gaccaactcctaacagacct

SEQ ID NO: 17112 - DNA, 20 bp, Artificial Sequence
  sgRNA
  Csf2rb_6
ggtccagtacaagaagaaat

SEQ ID NO: 17113 - DNA, 20 bp, Artificial Sequence
  sgRNA
  Csf2rb_7
ggagacctgggcatccccaa

SEQ ID NO: 17114 - DNA, 20 bp, Artificial Sequence
  sgRNA
  Csf2rb_8
agcccatctctaactacgat

SEQ ID NO: 17115 - DNA, 20 bp, Artificial Sequence
  sgRNA
  Csf2rb_9
ggctctctgttggggacacg

SEQ ID NO: 17116 - DNA, 20 bp, Artificial Sequence
  sgRNA
  Csf2rb_10
gtacacttggaagactgact

SEQ ID NO: 17117 - DNA, 20 bp, Artificial Sequence
  sgRNA
  Csf2rb_11
agtgtcctgtgagctcagtg

SEQ ID NO: 17118 - DNA, 20 bp, Artificial Sequence
  sgRNA
  Csf2rb_12
gtgtagacactggcccccgg

SEQ ID NO: 17119 - DNA, 20 bp, Artificial Sequence
  sgRNA
  Csf2rb_13
ccatgctcagctcaactgga

SEQ ID NO: 17120 - DNA, 20 bp, Artificial Sequence
  sgRNA
  Csf2rb_14
tgcccagatcactatctggc

SEQ ID NO: 17121 - DNA, 20 bp, Artificial Sequence
  sgRNA
  Csf2rb_15
gaggagaagatcatggaccg

SEQ ID NO: 17122 - DNA, 20 bp, Artificial Sequence
  sgRNA
  Csf2rb_16
agtggagcgaagagtacact

SEQ ID NO: 17123 - DNA, 20 bp, Artificial Sequence
  sgRNA
  Csf2rb_17
gtagtagtcttcgtttgtga

SEQ ID NO: 17124 - DNA, 20 bp, Artificial Sequence
  sgRNA
  Csf2rb_18
agaccagctgggttcccccc

SEQ ID NO: 17125 - DNA, 20 bp, Artificial Sequence
  sgRNA
  Csf2rb_19
agcactgcagagtcttcaga

SEQ ID NO: 17126 - DNA, 20 bp, Artificial Sequence
  sgRNA
  Csf2rb_20
gctgagcatggaggaacagg

SEQ ID NO: 17127 - DNA, 20 bp, Artificial Sequence
  sgRNA
  Csf2rb2_1
gcaggaaatgatccccagag

SEQ ID NO: 17128 - DNA, 20 bp, Artificial Sequence
  sgRNA
  Csf2rb2_2
agctcagtgagaaactcatg

SEQ ID NO: 17129 - DNA, 20 bp, Artificial Sequence
  sgRNA
  Csf2rb2_3
cctaggtcgagtcaatagca

SEQ ID NO: 17130 - DNA, 20 bp, Artificial Sequence
  sgRNA
  Csf2rb2_4
caggcacaggtagactgcag

SEQ ID NO: 17131 - DNA, 20 bp, Artificial Sequence
  sgRNA
  Csf2rb2_5
ccagctgcagatgatacggt

SEQ ID NO: 17132 - DNA, 20 bp, Artificial Sequence
  sgRNA
  Csf2rb2_6
gtctagctggtgatagagga

SEQ ID NO: 17133 - DNA, 20 bp, Artificial Sequence
  sgRNA
  Csf2rb2_7
tgtgcgcactcggctgtccg

SEQ ID NO: 17134 - DNA, 20 bp, Artificial Sequence
  sgRNA
  Csf2rb2_8
gagatacactccattccagc

SEQ ID NO: 17135 - DNA, 20 bp, Artificial Sequence
  sgRNA
  Csf2rb2_9
ggtccagcctggagaccaca

SEQ ID NO: 17136 - DNA, 20 bp, Artificial Sequence
  sgRNA
  Csf2rb2_10
gatcccgtcgtagtcagaga

SEQ ID NO: 17137 - DNA, 20 bp, Artificial Sequence
  sgRNA
  Csf2rb2_11
gctggcctgggagatcaggc

SEQ ID NO: 17138 - DNA, 20 bp, Artificial Sequence
  sgRNA
  Csf2rb2_12
gctgagcgtggagaaacagg

SEQ ID NO: 17139 - DNA, 20 bp, Artificial Sequence
  sgRNA
  Csf2rb2_13
ttccagccagatcgtgacct

SEQ ID NO: 17140 - DNA, 20 bp, Artificial Sequence
  sgRNA
  Csf2rb2_14
tgaggattggaggttccatc

SEQ ID NO: 17141 - DNA, 20 bp, Artificial Sequence
  sgRNA
  Csf2rb2_15
ccatgctattgactcgacct

SEQ ID NO: 17142 - DNA, 20 bp, Artificial Sequence
  sgRNA
  Csf2rb2_16
agttgcacttgacctccagg

SEQ ID NO: 17143 - DNA, 20 bp, Artificial Sequence
  sgRNA
  Csf2rb2_17
agcactccagagtcttcaga

SEQ ID NO: 17144 - DNA, 20 bp, Artificial Sequence
  sgRNA
  Csf2rb2_18
acgacgggatctggagcgag

SEQ ID NO: 17145 - DNA, 20 bp, Artificial Sequence
  sgRNA
  Csf2rb2_19
gtctctccactgctcctggg

SEQ ID NO: 17146 - DNA, 20 bp, Artificial Sequence
  sgRNA
  Csf2rb2_20
ggattcagatgaggcagctg

SEQ ID NO: 17147 - DNA, 20 bp, Artificial Sequence
  sgRNA
  Csf3r_1
tcagctctacagaattacag

SEQ ID NO: 17148 - DNA, 20 bp, Artificial Sequence
  sgRNA
  Csf3r_2
tgaggcaggataggtttgag

SEQ ID NO: 17149 - DNA, 20 bp, Artificial Sequence
  sgRNA
  Csf3r_3
tgagctgcgtggtgttgcaa

SEQ ID NO: 17150 - DNA, 20 bp, Artificial Sequence
  sgRNA
  Csf3r_4
ctttgccacacaatccggga

SEQ ID NO: 17151 - DNA, 20 bp, Artificial Sequence
  sgRNA
  Csf3r_5
gcgaatgcatcgcatctgta

SEQ ID NO: 17152 - DNA, 20 bp, Artificial Sequence
  sgRNA
  Csf3r_6
gtaaatgtctacaccttcgc

SEQ ID NO: 17153 - DNA, 20 bp, Artificial Sequence
  sgRNA
  Csf3r_7
gtagacatgatacaaactgg

SEQ ID NO: 17154 - DNA, 20 bp, Artificial Sequence
  sgRNA
  Csf3r_8
gtttcctctgtcatgatggt

SEQ ID NO: 17155 - DNA, 20 bp, Artificial Sequence
  sgRNA
  Csf3r_9
gaagatacagctgagctgcg

SEQ ID NO: 17156 - DNA, 20 bp, Artificial Sequence
  sgRNA
  Csf3r_10
gctggtgagagactacatca

SEQ ID NO: 17157 - DNA, 20 bp, Artificial Sequence
  sgRNA
  Csf3r_11
gcacccagatggccatatac

SEQ ID NO: 17158 - DNA, 20 bp, Artificial Sequence
  sgRNA
  Csf3r_12
gattccgaaagctctgggaa

SEQ ID NO: 17159 - DNA, 20 bp, Artificial Sequence
  sgRNA
  Csf3r_13
aaagctgtgcctcgacccca

SEQ ID NO: 17160 - DNA, 20 bp, Artificial Sequence
  sgRNA
  Csf3r_14
agttggacgctgtcttccca

SEQ ID NO: 17161 - DNA, 20 bp, Artificial Sequence
  sgRNA
  Csf3r_15
cctggatgatagaacctaac

SEQ ID NO: 17162 - DNA, 20 bp, Artificial Sequence
  sgRNA
  Csf3r_16
tctacctcatggccaccagt

SEQ ID NO: 17163 - DNA, 20 bp, Artificial Sequence
  sgRNA
  Csf3r_17
aaggtgtagacatttacagg

SEQ ID NO: 17164 - DNA, 20 bp, Artificial Sequence
  sgRNA
  Csf3r_18
ggtcccccaggcggacaaca

SEQ ID NO: 17165 - DNA, 20 bp, Artificial Sequence
  sgRNA
  Csf3r_19
attctctgcttgcacccaga

SEQ ID NO: 17166 - DNA, 20 bp, Artificial Sequence
  sgRNA
  Csf3r_20
tgtgccccaacctccaaacc

SEQ ID NO: 17167 - DNA, 20 bp, Artificial Sequence
  sgRNA
  Csmd1_1
gtacttaccaatgcacaaag

SEQ ID NO: 17168 - DNA, 20 bp, Artificial Sequence
  sgRNA
  Csmd1_2
gtcacacactcaatggacga

SEQ ID NO: 17169 - DNA, 20 bp, Artificial Sequence
  sgRNA
  Csmd1_3
cgaactgaaacccaattctg

SEQ ID NO: 17170 - DNA, 20 bp, Artificial Sequence
  sgRNA
  Csmd1_4
gtggtactctcctatgagtg

SEQ ID NO: 17171 - DNA, 20 bp, Artificial Sequence
  sgRNA
  Csmd1_5
ggtcaatgcgaccttcactg

SEQ ID NO: 17172 - DNA, 20 bp, Artificial Sequence
  sgRNA
  Csmd1_6
ctatgttgaacctcgttccg

SEQ ID NO: 17173 - DNA, 20 bp, Artificial Sequence
  sgRNA
  Csmd1_7
gttacactcgaagcggacga

SEQ ID NO: 17174 - DNA, 20 bp, Artificial Sequence
  sgRNA
  Csmd1_8
gagcattgaaccctttacgt

SEQ ID NO: 17175 - DNA, 20 bp, Artificial Sequence
  sgRNA
  Csmd1_9
gattcttcaaatcactacca

SEQ ID NO: 17176 - DNA, 20 bp, Artificial Sequence
  sgRNA
  Csmd1_10
gcaattgagctgaagtcgag

SEQ ID NO: 17177 - DNA, 20 bp, Artificial Sequence
  sgRNA
  Csmd1_11
ccaaaagcggagcttctgca

SEQ ID NO: 17178 - DNA, 20 bp, Artificial Sequence
  sgRNA
  Csmd1_12
agtggggtcatattacctcc

SEQ ID NO: 17179 - DNA, 20 bp, Artificial Sequence
  sgRNA
  Csmd1_13
acatgtggatcaaacctgcg

SEQ ID NO: 17180 - DNA, 20 bp, Artificial Sequence
  sgRNA
  Csmd1_14
gtactccaggtgaaagccgg

SEQ ID NO: 17181 - DNA, 20 bp, Artificial Sequence
  sgRNA
  Csmd1_15
acagcaatcaccgacgtaaa

SEQ ID NO: 17182 - DNA, 20 bp, Artificial Sequence
  sgRNA
  Csmd1_16
agttctctacagctgcaacc

SEQ ID NO: 17183 - DNA, 20 bp, Artificial Sequence
  sgRNA
  Csmd1_17
tggaagatcatagtatcgga

SEQ ID NO: 17184 - DNA, 20 bp, Artificial Sequence
  sgRNA
  Csmd1_18
agcttatgctggcaccccat

SEQ ID NO: 17185 - DNA, 20 bp, Artificial Sequence
  sgRNA
  Csmd1_19
gtacccgctacggtgacagc

SEQ ID NO: 17186 - DNA, 20 bp, Artificial Sequence
  sgRNA
  Csmd1_20
ggatcctgtagccatagtta

SEQ ID NO: 17187 - DNA, 20 bp, Artificial Sequence
  sgRNA
  Csmd2_1
gtgattccatcacatagccg

SEQ ID NO: 17188 - DNA, 20 bp, Artificial Sequence
  sgRNA
  Csmd2_2
gtacaatatctcgatcacgg

SEQ ID NO: 17189 - DNA, 20 bp, Artificial Sequence
  sgRNA
  Csmd2_3
gacatcgtggaggtacacga

SEQ ID NO: 17190 - DNA, 20 bp, Artificial Sequence
  sgRNA
  Csmd2_4
actccatccagacccagccg

SEQ ID NO: 17191 - DNA, 20 bp, Artificial Sequence
  sgRNA
  Csmd2_5
ctgcacgtggaccatcaccg

SEQ ID NO: 17192 - DNA, 20 bp, Artificial Sequence
  sgRNA
  Csmd2_6
gatcctgtgctggtcctccg

SEQ ID NO: 17193 - DNA, 20 bp, Artificial Sequence
  sgRNA
  Csmd2_7
ggtagttgcccgggaaaccg

SEQ ID NO: 17194 - DNA, 20 bp, Artificial Sequence
  sgRNA
  Csmd2_8
attggcttgacacattcgct

SEQ ID NO: 17195 - DNA, 20 bp, Artificial Sequence
  sgRNA
  Csmd2_9
gtagacaaagtggaaccccc

SEQ ID NO: 17196 - DNA, 20 bp, Artificial Sequence
  sgRNA
  Csmd2_10
cctgtcagcatggcaccaat

SEQ ID NO: 17197 - DNA, 20 bp, Artificial Sequence
  sgRNA
  Csmd2_11
gctccgagaacagtgccacg

SEQ ID NO: 17198 - DNA, 20 bp, Artificial Sequence
  sgRNA
  Csmd2_12
acagtgatgtagtctccgaa

SEQ ID NO: 17199 - DNA, 20 bp, Artificial Sequence
  sgRNA
  Csmd2_13
tgtcaacggacacatcaacg

SEQ ID NO: 17200 - DNA, 20 bp, Artificial Sequence
  sgRNA
  Csmd2_14
gcattgttgtgatactcggc

SEQ ID NO: 17201 - DNA, 20 bp, Artificial Sequence
  sgRNA
  Csmd2_15
tccagactgaccactccaca

SEQ ID NO: 17202 - DNA, 20 bp, Artificial Sequence
  sgRNA
  Csmd2_16
ggatggagtagatacactcg

SEQ ID NO: 17203 - DNA, 20 bp, Artificial Sequence
  sgRNA
  Csmd2_17
ggaacctcgggctcttcgca

SEQ ID NO: 17204 - DNA, 20 bp, Artificial Sequence
  sgRNA
  Csmd2_18
aaggtcaagtatcagcccgg

SEQ ID NO: 17205 - DNA, 20 bp, Artificial Sequence
  sgRNA
  Csmd2_19
ccaagcctcttgccatagcg

SEQ ID NO: 17206 - DNA, 20 bp, Artificial Sequence
  sgRNA
  Csmd2_20
cgaactacgccaactgcacg

SEQ ID NO: 17207 - DNA, 20 bp, Artificial Sequence
  sgRNA
  Cspg4_1
ccacggttgaaagtacgcgt

SEQ ID NO: 17208 - DNA, 20 bp, Artificial Sequence
  sgRNA
  Cspg4_2
ggaatcagccgacccctaag

SEQ ID NO: 17209 - DNA, 20 bp, Artificial Sequence
  sgRNA
  Cspg4_3
aaggcccgctttgttcacga

SEQ ID NO: 17210 - DNA, 20 bp, Artificial Sequence
  sgRNA
  Cspg4_4
gtcagtagaaacgaacgcgg

SEQ ID NO: 17211 - DNA, 20 bp, Artificial Sequence
  sgRNA
  Cspg4_5
cctgtcagtagaaacgaacg

SEQ ID NO: 17212 - DNA, 20 bp, Artificial Sequence
  sgRNA
  Cspg4_6
gcgtggcaactttatctacg

SEQ ID NO: 17213 - DNA, 20 bp, Artificial Sequence
  sgRNA
  Cspg4_7
cctgccacagaagtccccgt

SEQ ID NO: 17214 - DNA, 20 bp, Artificial Sequence
  sgRNA
  Cspg4_8
gctcctctgctgaagcgccg

SEQ ID NO: 17215 - DNA, 20 bp, Artificial Sequence
  sgRNA
  Cspg4_9
gcgtacacatagatgttcac

SEQ ID NO: 17216 - DNA, 20 bp, Artificial Sequence
  sgRNA
  Cspg4_10
ggagcccacgaagagcccgt

SEQ ID NO: 17217 - DNA, 20 bp, Artificial Sequence
  sgRNA
  Cspg4_11
catcgtgctggtagaccagt

SEQ ID NO: 17218 - DNA, 20 bp, Artificial Sequence
  sgRNA
  Cspg4_12
ggcgtacaccagctgtcccg

SEQ ID NO: 17219 - DNA, 20 bp, Artificial Sequence
  sgRNA
  Cspg4_13
gacatagtctatgtccaccg

SEQ ID NO: 17220 - DNA, 20 bp, Artificial Sequence
  sgRNA
  Cspg4_14
cggaccacacggccatagcg

SEQ ID NO: 17221 - DNA, 20 bp, Artificial Sequence
  sgRNA
  Cspg4_15
cctgcaatctgagctggccg

SEQ ID NO: 17222 - DNA, 20 bp, Artificial Sequence
  sgRNA
  Cspg4_16
caaaacttcagcgttcccga

SEQ ID NO: 17223 - DNA, 20 bp, Artificial Sequence
  sgRNA
  Cspg4_17
ctgcactgtgacatttacgg

SEQ ID NO: 17224 - DNA, 20 bp, Artificial Sequence
  sgRNA
  Cspg4_18
tggaaaatctccggtcccag

SEQ ID NO: 17225 - DNA, 20 bp, Artificial Sequence
  sgRNA
  Cspg4_19
cttcggggagaaccacctgg

SEQ ID NO: 17226 - DNA, 20 bp, Artificial Sequence
  sgRNA
  Cspg4_20
cctcgcatcatcttccccca

SEQ ID NO: 17227 - DNA, 20 bp, Artificial Sequence
  sgRNA
  Cspg5_1
cctacccggtacggccccag

SEQ ID NO: 17228 - DNA, 20 bp, Artificial Sequence
  sgRNA
  Cspg5_2
gtcgcgtgccaatgacacgc

SEQ ID NO: 17229 - DNA, 20 bp, Artificial Sequence
  sgRNA
  Cspg5_3
gtccatgataagcctagtgt

SEQ ID NO: 17230 - DNA, 20 bp, Artificial Sequence
  sgRNA
  Cspg5_4
gaaaatcaccctgataccga

SEQ ID NO: 17231 - DNA, 20 bp, Artificial Sequence
  sgRNA
  Cspg5_5
agtcgcgtgccaatgacacg

SEQ ID NO: 17232 - DNA, 20 bp, Artificial Sequence
  sgRNA
  Cspg5_6
ggtccttgcctggatctccg

SEQ ID NO: 17233 - DNA, 20 bp, Artificial Sequence
  sgRNA
  Cspg5_7
ggttcagccgaacctccaag

SEQ ID NO: 17234 - DNA, 20 bp, Artificial Sequence
  sgRNA
  Cspg5_8
ccgagttactgtcacaacgg

SEQ ID NO: 17235 - DNA, 20 bp, Artificial Sequence
  sgRNA
  Cspg5_9
gcatggggggaggagacacg

SEQ ID NO: 17236 - DNA, 20 bp, Artificial Sequence
  sgRNA
  Cspg5_10
gcaccgttccctgcaccact

SEQ ID NO: 17237 - DNA, 20 bp, Artificial Sequence
  sgRNA
  Cspg5_11
gagacctcgtggacagagcg

SEQ ID NO: 17238 - DNA, 20 bp, Artificial Sequence
  sgRNA
  Cspg5_12
ccgccgttgtgacagtaact

SEQ ID NO: 17239 - DNA, 20 bp, Artificial Sequence
  sgRNA
  Cspg5_13
actccctaaagagatcccct

SEQ ID NO: 17240 - DNA, 20 bp, Artificial Sequence
  sgRNA
  Cspg5_14
actgccccgctctgtccacg

SEQ ID NO: 17241 - DNA, 20 bp, Artificial Sequence
  sgRNA
  Cspg5_15
ggacaggacagcccaccaac

SEQ ID NO: 17242 - DNA, 20 bp, Artificial Sequence
  sgRNA
  Cspg5_16
tctcaagtcccgcctgaagg

SEQ ID NO: 17243 - DNA, 20 bp, Artificial Sequence
  sgRNA
  Cspg5_17
aagcccctatgttctccacc

SEQ ID NO: 17244 - DNA, 20 bp, Artificial Sequence
  sgRNA
  Cspg5_18
aggactacatctggcacaag

SEQ ID NO: 17245 - DNA, 20 bp, Artificial Sequence
  sgRNA
  Cspg5_19
acagcatgccaccggttggt

SEQ ID NO: 17246 - DNA, 20 bp, Artificial Sequence
  sgRNA
  Cspg5_20
ctgagaataccaagctgcgg

SEQ ID NO: 17247 - DNA, 20 bp, Artificial Sequence
  sgRNA
  Ctla4_1
tgtgatggtgaatattcaca

SEQ ID NO: 17248 - DNA, 20 bp, Artificial Sequence
  sgRNA
  Ctla4_2
ggactgagagctgttgacac

SEQ ID NO: 17249 - DNA, 20 bp, Artificial Sequence
  sgRNA
  Ctla4_3
acaggtgacccaaccttcag

SEQ ID NO: 17250 - DNA, 20 bp, Artificial Sequence
  sgRNA
  Ctla4_4
tgcccacaaagtatggcggt

SEQ ID NO: 17251 - DNA, 20 bp, Artificial Sequence
  sgRNA
  Ctla4_5
acctcatcagtgttgtgtga

SEQ ID NO: 17252 - DNA, 20 bp, Artificial Sequence
  sgRNA
  Ctla4_6
gggactgtacctctgcaagg

SEQ ID NO: 17253 - DNA, 20 bp, Artificial Sequence
  sgRNA
  Ctla4_7
atggaaagctggcgacacca

SEQ ID NO: 17254 - DNA, 20 bp, Artificial Sequence
  sgRNA
  Ctla4_8
accccaagctaactgcgaca

SEQ ID NO: 17255 - DNA, 20 bp, Artificial Sequence
  sgRNA
  Ctla4_9
acatagacccctgttgtaag

SEQ ID NO: 17256 - DNA, 20 bp, Artificial Sequence
  sgRNA
  Ctla4_10
tccttgtcgcagttagcttg

SEQ ID NO: 17257 - DNA, 20 bp, Artificial Sequence
  sgRNA
  Ctla4_11
agagtgagcagggctacaaa

SEQ ID NO: 17258 - DNA, 20 bp, Artificial Sequence
  sgRNA
  Ctla4_12
ctagattaccccttctgcag

SEQ ID NO: 17259 - DNA, 20 bp, Artificial Sequence
  sgRNA
  Ctla4_13
gatgaaaagaagagtgagca

SEQ ID NO: 17260 - DNA, 20 bp, Artificial Sequence
  sgRNA
  Ctla4_14
aagaagtcctcttacaacag

SEQ ID NO: 17261 - DNA, 20 bp, Artificial Sequence
  sgRNA
  Ctla4_15
cccatgcccacaaagtatgg

SEQ ID NO: 17262 - DNA, 20 bp, Artificial Sequence
  sgRNA
  Ctla4_16
acatgagttccaccttgcag

SEQ ID NO: 17263 - DNA, 20 bp, Artificial Sequence
  sgRNA
  Ctla4_17
tagccaacaccactgaaggt

SEQ ID NO: 17264 - DNA, 20 bp, Artificial Sequence
  sgRNA
  Ctla4_18
ttaaaggtaccactgcagaa

SEQ ID NO: 17265 - DNA, 20 bp, Artificial Sequence
  sgRNA
  Ctla4_19
tgtcaacagctctcagtcct

SEQ ID NO: 17266 - DNA, 20 bp, Artificial Sequence
  sgRNA
  Ctla4_20
atgcccacaaagtatggcgg

SEQ ID NO: 17267 - DNA, 20 bp, Artificial Sequence
  sgRNA
  Ctns_1
aggcatcattactgtcgacg

SEQ ID NO: 17268 - DNA, 20 bp, Artificial Sequence
  sgRNA
  Ctns_2
tggagggccatgacacacgc

SEQ ID NO: 17269 - DNA, 20 bp, Artificial Sequence
  sgRNA
  Ctns_3
taacaggttatagtgcctcg

SEQ ID NO: 17270 - DNA, 20 bp, Artificial Sequence
  sgRNA
  Ctns_4
cccaagggtgatgtcgacgt

SEQ ID NO: 17271 - DNA, 20 bp, Artificial Sequence
  sgRNA
  Ctns_5
ctgcagtcggtatcaccaca

SEQ ID NO: 17272 - DNA, 20 bp, Artificial Sequence
  sgRNA
  Ctns_6
gcatccactaaattcgacct

SEQ ID NO: 17273 - DNA, 20 bp, Artificial Sequence
  sgRNA
  Ctns_7
gcactgcaggatgacaatca

SEQ ID NO: 17274 - DNA, 20 bp, Artificial Sequence
  sgRNA
  Ctns_8
tgctgtgtatcaccaagaac

SEQ ID NO: 17275 - DNA, 20 bp, Artificial Sequence
  sgRNA
  Ctns_9
actgatcaagtatttcccac

SEQ ID NO: 17276 - DNA, 20 bp, Artificial Sequence
  sgRNA
  Ctns_10
cgacggggttcacaccattg

SEQ ID NO: 17277 - DNA, 20 bp, Artificial Sequence
  sgRNA
  Ctns_11
ccaacgtcgacatcaccctt

SEQ ID NO: 17278 - DNA, 20 bp, Artificial Sequence
  sgRNA
  Ctns_12
agtagatccagccaatcacc

SEQ ID NO: 17279 - DNA, 20 bp, Artificial Sequence
  sgRNA
  Ctns_13
tttctcctcaaataccccaa

SEQ ID NO: 17280 - DNA, 20 bp, Artificial Sequence
  sgRNA
  Ctns_14
agctgccccctgtaaaatcg

SEQ ID NO: 17281 - DNA, 20 bp, Artificial Sequence
  sgRNA
  Ctns_15
gctggatctacttcatggcg

SEQ ID NO: 17282 - DNA, 20 bp, Artificial Sequence
  sgRNA
  Ctns_16
acttgtacagaaagaaacca

SEQ ID NO: 17283 - DNA, 20 bp, Artificial Sequence
  sgRNA
  Ctns_17
gattggctggatctacttca

SEQ ID NO: 17284 - DNA, 20 bp, Artificial Sequence
  sgRNA
  Ctns_18
ttctactacaaaagcaccaa

SEQ ID NO: 17285 - DNA, 20 bp, Artificial Sequence
  sgRNA
  Ctns_19
gacttcaaaagtgatcacca

SEQ ID NO: 17286 - DNA, 20 bp, Artificial Sequence
  sgRNA
  Ctns_20
ctccgaagatcaatgtccat

SEQ ID NO: 17287 - DNA, 20 bp, Artificial Sequence
  sgRNA
  Cuzd1_1
gatggagtataactctaccg

SEQ ID NO: 17288 - DNA, 20 bp, Artificial Sequence
  sgRNA
  Cuzd1_2
gtgtctggcacatacaagtg

SEQ ID NO: 17289 - DNA, 20 bp, Artificial Sequence
  sgRNA
  Cuzd1_3
tgttggtatagctgatcgcg

SEQ ID NO: 17290 - DNA, 20 bp, Artificial Sequence
  sgRNA
  Cuzd1_4
ggacaacttaccggtagcag

SEQ ID NO: 17291 - DNA, 20 bp, Artificial Sequence
  sgRNA
  Cuzd1_5
aatatggtgactcctgtacg

SEQ ID NO: 17292 - DNA, 20 bp, Artificial Sequence
  sgRNA
  Cuzd1_6
agagttatactccatctcac

SEQ ID NO: 17293 - DNA, 20 bp, Artificial Sequence
  sgRNA
  Cuzd1_7
ggtgcggctttggataattg

SEQ ID NO: 17294 - DNA, 20 bp, Artificial Sequence
  sgRNA
  Cuzd1_8
ggcctgctcaaacaactctg

SEQ ID NO: 17295 - DNA, 20 bp, Artificial Sequence
  sgRNA
  Cuzd1_9
gatttcatcgcagtctacga

SEQ ID NO: 17296 - DNA, 20 bp, Artificial Sequence
  sgRNA
  Cuzd1_10
ggcacagctgaattctacag

SEQ ID NO: 17297 - DNA, 20 bp, Artificial Sequence
  sgRNA
  Cuzd1_11
acctacgacttaatcagcag

SEQ ID NO: 17298 - DNA, 20 bp, Artificial Sequence
  sgRNA
  Cuzd1_12
acgcgatcagctataccaac

SEQ ID NO: 17299 - DNA, 20 bp, Artificial Sequence
  sgRNA
  Cuzd1_13
ctacgatggcccctccacca

SEQ ID NO: 17300 - DNA, 20 bp, Artificial Sequence
  sgRNA
  Cuzd1_14
gtgacctgcgagcattggaa

SEQ ID NO: 17301 - DNA, 20 bp, Artificial Sequence
  sgRNA
  Cuzd1_15
tctatccctctgcacgaatg

SEQ ID NO: 17302 - DNA, 20 bp, Artificial Sequence
  sgRNA
  Cuzd1_16
actgtaccgcattcgtgcag

SEQ ID NO: 17303 - DNA, 20 bp, Artificial Sequence
  sgRNA
  Cuzd1_17
tgaagcatttcctaaatcgg

SEQ ID NO: 17304 - DNA, 20 bp, Artificial Sequence
  sgRNA
  Cuzd1_18
ctgcaggccttccctagcag

SEQ ID NO: 17305 - DNA, 20 bp, Artificial Sequence
  sgRNA
  Cuzd1_19
tgcaaagtcagacgtaggcg

SEQ ID NO: 17306 - DNA, 20 bp, Artificial Sequence
  sgRNA
  Cuzd1_20
aagtatccagaaacaccacc

SEQ ID NO: 17307 - DNA, 20 bp, Artificial Sequence
  sgRNA
  Cx3cl1_1
gggtggacaatgtgacacct

SEQ ID NO: 17308 - DNA, 20 bp, Artificial Sequence
  sgRNA
  Cx3cl1_2
gatgacctcacgaatcccag

SEQ ID NO: 17309 - DNA, 20 bp, Artificial Sequence
  sgRNA
  Cx3cl1_3
actgactactatttcccagg

SEQ ID NO: 17310 - DNA, 20 bp, Artificial Sequence
  sgRNA
  Cx3cl1_4
ggccaacccccatgggtcca

SEQ ID NO: 17311 - DNA, 20 bp, Artificial Sequence
  sgRNA
  Cx3cl1_5
tttcgcatttcgtcatgccg

SEQ ID NO: 17312 - DNA, 20 bp, Artificial Sequence
  sgRNA
  Cx3cl1_6
gctgtccccgcaaaatggcg

SEQ ID NO: 17313 - DNA, 20 bp, Artificial Sequence
  sgRNA
  Cx3cl1_7
ctgtccccgcaaaatggcgg

SEQ ID NO: 17314 - DNA, 20 bp, Artificial Sequence
  sgRNA
  Cx3cl1_8
gagttactgccacagctacg

SEQ ID NO: 17315 - DNA, 20 bp, Artificial Sequence
  sgRNA
  Cx3cl1_9
catccgctatcagctaaacc

SEQ ID NO: 17316 - DNA, 20 bp, Artificial Sequence
  sgRNA
  Cx3cl1_10
agtacacaaatggaagaacg

SEQ ID NO: 17317 - DNA, 20 bp, Artificial Sequence
  sgRNA
  Cx3cl1_11
aagcaaacatggccacccct

SEQ ID NO: 17318 - DNA, 20 bp, Artificial Sequence
  sgRNA
  Cx3cl1_12
agttactgccacagctacgg

SEQ ID NO: 17319 - DNA, 20 bp, Artificial Sequence
  sgRNA
  Cx3cl1_13
tcagggctgtccccgcaaaa

SEQ ID NO: 17320 - DNA, 20 bp, Artificial Sequence
  sgRNA
  Cx3cl1_14
ctagtggccaaggtgatccc

SEQ ID NO: 17321 - DNA, 20 bp, Artificial Sequence
  sgRNA
  Cx3cl1_15
aagccctgcatcctgtgcct

SEQ ID NO: 17322 - DNA, 20 bp, Artificial Sequence
  sgRNA
  Cx3cl1_16
gctgccctcactaaaaatgg

SEQ ID NO: 17323 - DNA, 20 bp, Artificial Sequence
  sgRNA
  Cx3cl1_17
ggatctgcagtggcatggat

SEQ ID NO: 17324 - DNA, 20 bp, Artificial Sequence
  sgRNA
  Cx3cl1_18
tgctgacccgaaggagaaat

SEQ ID NO: 17325 - DNA, 20 bp, Artificial Sequence
  sgRNA
  Cx3cl1_19
ggcggattcaggctttgtca

SEQ ID NO: 17326 - DNA, 20 bp, Artificial Sequence
  sgRNA
  Cx3cl1_20
ggggacttcccaagagccac

SEQ ID NO: 17327 - DNA, 20 bp, Artificial Sequence
  sgRNA
  Cx3cr1_1
aacaaccggacagtgcagca

SEQ ID NO: 17328 - DNA, 20 bp, Artificial Sequence
  sgRNA
  Cx3cr1_2
aaaacagcgtctggatgatg

SEQ ID NO: 17329 - DNA, 20 bp, Artificial Sequence
  sgRNA
  Cx3cr1_3
atgaggtagtgagtccagaa

SEQ ID NO: 17330 - DNA, 20 bp, Artificial Sequence
  sgRNA
  Cx3cr1_4
gtgtctgggtgactaccccg

SEQ ID NO: 17331 - DNA, 20 bp, Artificial Sequence
  sgRNA
  Cx3cr1_5
gtaccggtcgatgctgatga

SEQ ID NO: 17332 - DNA, 20 bp, Artificial Sequence
  sgRNA
  Cx3cr1_6
ctttatctacgcctttgccg

SEQ ID NO: 17333 - DNA, 20 bp, Artificial Sequence
  sgRNA
  Cx3cr1_7
tttcactcactacacaagcg

SEQ ID NO: 17334 - DNA, 20 bp, Artificial Sequence
  sgRNA
  Cx3cr1_8
caaaagctcatgataagcaa

SEQ ID NO: 17335 - DNA, 20 bp, Artificial Sequence
  sgRNA
  Cx3cr1_9
tcaccgtcatcagcatcgac

SEQ ID NO: 17336 - DNA, 20 bp, Artificial Sequence
  sgRNA
  Cx3cr1_10
gcttgcacatggcattgtgg

SEQ ID NO: 17337 - DNA, 20 bp, Artificial Sequence
  sgRNA
  Cx3cr1_11
ttcactcactacacaagcga

SEQ ID NO: 17338 - DNA, 20 bp, Artificial Sequence
  sgRNA
  Cx3cr1_12
ccccagttgtgacatgaaga

SEQ ID NO: 17339 - DNA, 20 bp, Artificial Sequence
  sgRNA
  Cx3cr1_13
gctcatgataagcaagggca

SEQ ID NO: 17340 - DNA, 20 bp, Artificial Sequence
  sgRNA
  Cx3cr1_14
ggatgttgacttccgagttg

SEQ ID NO: 17341 - DNA, 20 bp, Artificial Sequence
  sgRNA
  Cx3cr1_15
gcttctcgccagagtcccag

SEQ ID NO: 17342 - DNA, 20 bp, Artificial Sequence
  sgRNA
  Cx3cr1_16
tacgccctcgtcttcacgtt

SEQ ID NO: 17343 - DNA, 20 bp, Artificial Sequence
  sgRNA
  Cx3cr1_17
tgagtatgacgattctgctg

SEQ ID NO: 17344 - DNA, 20 bp, Artificial Sequence
  sgRNA
  Cx3cr1_18
aattctctagatccagttca

SEQ ID NO: 17345 - DNA, 20 bp, Artificial Sequence
  sgRNA
  Cx3cr1_19
gcaaggtggccacaaagagc

SEQ ID NO: 17346 - DNA, 20 bp, Artificial Sequence
  sgRNA
  Cx3cr1_20
tgtggacaggatgaccgcac

SEQ ID NO: 17347 - DNA, 20 bp, Artificial Sequence
  sgRNA
  Cxadr_1
gcatcactacacccgaacag

SEQ ID NO: 17348 - DNA, 20 bp, Artificial Sequence
  sgRNA
  Cxadr_2
actctcagtcccgaagacca

SEQ ID NO: 17349 - DNA, 20 bp, Artificial Sequence
  sgRNA
  Cxadr_3
aactactatccggatctgaa

SEQ ID NO: 17350 - DNA, 20 bp, Artificial Sequence
  sgRNA
  Cxadr_4
acgctagcctccaaccgagc

SEQ ID NO: 17351 - DNA, 20 bp, Artificial Sequence
  sgRNA
  Cxadr_5
ggactgagagtaaacttgca

SEQ ID NO: 17352 - DNA, 20 bp, Artificial Sequence
  sgRNA
  Cxadr_6
gatggccccgatgagcacaa

SEQ ID NO: 17353 - DNA, 20 bp, Artificial Sequence
  sgRNA
  Cxadr_7
tccactatctggttatcaga

SEQ ID NO: 17354 - DNA, 20 bp, Artificial Sequence
  sgRNA
  Cxadr_8
tgtccccctctaacatggag

SEQ ID NO: 17355 - DNA, 20 bp, Artificial Sequence
  sgRNA
  Cxadr_9
cccagacaatgcctacgcca

SEQ ID NO: 17356 - DNA, 20 bp, Artificial Sequence
  sgRNA
  Cxadr_10
acttaccaagaacggtcagc

SEQ ID NO: 17357 - DNA, 20 bp, Artificial Sequence
  sgRNA
  Cxadr_11
gcgttcttcacagatataac

SEQ ID NO: 17358 - DNA, 20 bp, Artificial Sequence
  sgRNA
  Cxadr_12
gctggcccttgtgctcatcg

SEQ ID NO: 17359 - DNA, 20 bp, Artificial Sequence
  sgRNA
  Cxadr_13
gccaatatagctcctggcag

SEQ ID NO: 17360 - DNA, 20 bp, Artificial Sequence
  sgRNA
  Cxadr_14
aagtacgcttacaagaccga

SEQ ID NO: 17361 - DNA, 20 bp, Artificial Sequence
  sgRNA
  Cxadr_15
cgtctagtcgcagcatacac

SEQ ID NO: 17362 - DNA, 20 bp, Artificial Sequence
  sgRNA
  Cxadr_16
ctatccggatctgaaaggac

SEQ ID NO: 17363 - DNA, 20 bp, Artificial Sequence
  sgRNA
  Cxadr_17
tcatcgttcctattatccac

SEQ ID NO: 17364 - DNA, 20 bp, Artificial Sequence
  sgRNA
  Cxadr_18
atttcttatttgcaacccca

SEQ ID NO: 17365 - DNA, 20 bp, Artificial Sequence
  sgRNA
  Cxadr_19
tcccattcgactgagattag

SEQ ID NO: 17366 - DNA, 20 bp, Artificial Sequence
  sgRNA
  Cxadr_20
aatgtccgacagctgcaggt

SEQ ID NO: 17367 - DNA, 20 bp, Artificial Sequence
  sgRNA
  Cxcl16_1
tctggcacccagataccgca

SEQ ID NO: 17368 - DNA, 20 bp, Artificial Sequence
  sgRNA
  Cxcl16_2
caaagagcacacccaaccct

SEQ ID NO: 17369 - DNA, 20 bp, Artificial Sequence
  sgRNA
  Cxcl16_3
ccagtgggtccgtgaactag

SEQ ID NO: 17370 - DNA, 20 bp, Artificial Sequence
  sgRNA
  Cxcl16_4
ccattaggcgatggcaacca

SEQ ID NO: 17371 - DNA, 20 bp, Artificial Sequence
  sgRNA
  Cxcl16_5
gcaggggtgctcgtgtccga

SEQ ID NO: 17372 - DNA, 20 bp, Artificial Sequence
  sgRNA
  Cxcl16_6
gcttccagaccatagcctga

SEQ ID NO: 17373 - DNA, 20 bp, Artificial Sequence
  sgRNA
  Cxcl16_7
atgtgatccaaagtaccctg

SEQ ID NO: 17374 - DNA, 20 bp, Artificial Sequence
  sgRNA
  Cxcl16_8
gggagagtggtcatctccca

SEQ ID NO: 17375 - DNA, 20 bp, Artificial Sequence
  sgRNA
  Cxcl16_9
gttgcacagcacataggcca

SEQ ID NO: 17376 - DNA, 20 bp, Artificial Sequence
  sgRNA
  Cxcl16_10
tcagcagcgccaacaagaaa

SEQ ID NO: 17377 - DNA, 20 bp, Artificial Sequence
  sgRNA
  Cxcl16_11
tgagtgctctgactatgtgc

SEQ ID NO: 17378 - DNA, 20 bp, Artificial Sequence
  sgRNA
  Cxcl16_12
tagcacaccagcttgggtac

SEQ ID NO: 17379 - DNA, 20 bp, Artificial Sequence
  sgRNA
  Cxcl16_13
cagtccaaaagcgtgtgtgg

SEQ ID NO: 17380 - DNA, 20 bp, Artificial Sequence
  sgRNA
  Cxcl16_14
ccactagttcacggacccac

SEQ ID NO: 17381 - DNA, 20 bp, Artificial Sequence
  sgRNA
  Cxcl16_15
cataggccatggctgcagtg

SEQ ID NO: 17382 - DNA, 20 bp, Artificial Sequence
  sgRNA
  Cxcl16_16
gcgacacagcagaactctgc

SEQ ID NO: 17383 - DNA, 20 bp, Artificial Sequence
  sgRNA
  Cxcl16_17
gagtgctctgactatgtgca

SEQ ID NO: 17384 - DNA, 20 bp, Artificial Sequence
  sgRNA
  Cxcl16_18
ggaagaagacaatggccagg

SEQ ID NO: 17385 - DNA, 20 bp, Artificial Sequence
  sgRNA
  Cxcl16_19
cagacccctgaggccgcaga

SEQ ID NO: 17386 - DNA, 20 bp, Artificial Sequence
  sgRNA
  Cxcl16_20
agacccctgaggccgcagag

SEQ ID NO: 17387 - DNA, 20 bp, Artificial Sequence
  sgRNA
  Cxcr1_1
agtgagaccatcttgcacag

SEQ ID NO: 17388 - DNA, 20 bp, Artificial Sequence
  sgRNA
  Cxcr1_2
cgtagacatccatgacggat

SEQ ID NO: 17389 - DNA, 20 bp, Artificial Sequence
  sgRNA
  Cxcr1_3
ggtcatccgaaaatctgttg

SEQ ID NO: 17390 - DNA, 20 bp, Artificial Sequence
  sgRNA
  Cxcr1_4
gggatgaaataatctccagt

SEQ ID NO: 17391 - DNA, 20 bp, Artificial Sequence
  sgRNA
  Cxcr1_5
acgtatgaaaggcaacacgg

SEQ ID NO: 17392 - DNA, 20 bp, Artificial Sequence
  sgRNA
  Cxcr1_6
catggacgatggccaggtat

SEQ ID NO: 17393 - DNA, 20 bp, Artificial Sequence
  sgRNA
  Cxcr1_7
gtttcccagcaagctcagaa

SEQ ID NO: 17394 - DNA, 20 bp, Artificial Sequence
  sgRNA
  Cxcr1_8
tatgtgggacagaccccgca

SEQ ID NO: 17395 - DNA, 20 bp, Artificial Sequence
  sgRNA
  Cxcr1_9
gctgctggcctgcatcagtg

SEQ ID NO: 17396 - DNA, 20 bp, Artificial Sequence
  sgRNA
  Cxcr1_10
ctttcgggccagcgtacggg

SEQ ID NO: 17397 - DNA, 20 bp, Artificial Sequence
  sgRNA
  Cxcr1_11
ttattggaactctcttacag

SEQ ID NO: 17398 - DNA, 20 bp, Artificial Sequence
  sgRNA
  Cxcr1_12
ttggctgtctccaaattgaa

SEQ ID NO: 17399 - DNA, 20 bp, Artificial Sequence
  sgRNA
  Cxcr1_13
tttcatctggactaatcctg

SEQ ID NO: 17400 - DNA, 20 bp, Artificial Sequence
  sgRNA
  Cxcr1_14
gagagcagaaccagattgta

SEQ ID NO: 17401 - DNA, 20 bp, Artificial Sequence
  sgRNA
  Cxcr1_15
gagacgtatgaaaggcaaca

SEQ ID NO: 17402 - DNA, 20 bp, Artificial Sequence
  sgRNA
  Cxcr1_16
ggtcaatgaaaagagtaggt

SEQ ID NO: 17403 - DNA, 20 bp, Artificial Sequence
  sgRNA
  Cxcr1_17
aatctgttgtggcttcaccc

SEQ ID NO: 17404 - DNA, 20 bp, Artificial Sequence
  sgRNA
  Cxcr1_18
gctggcccgaaagcgctact

SEQ ID NO: 17405 - DNA, 20 bp, Artificial Sequence
  sgRNA
  Cxcr1_19
gtatcggtccacactgatgc

SEQ ID NO: 17406 - DNA, 20 bp, Artificial Sequence
  sgRNA
  Cxcr1_20
gcagggtcaatgaaaagagt

SEQ ID NO: 17407 - DNA, 20 bp, Artificial Sequence
  sgRNA
  Cxcr2_1
tgtggttgtaatatacgtcc

SEQ ID NO: 17408 - DNA, 20 bp, Artificial Sequence
  sgRNA
  Cxcr2_2
gatattctcatacgtgaagg

SEQ ID NO: 17409 - DNA, 20 bp, Artificial Sequence
  sgRNA
  Cxcr2_3
tcgtagaattaagatgggca

SEQ ID NO: 17410 - DNA, 20 bp, Artificial Sequence
  sgRNA
  Cxcr2_4
caggttcagcaggtagacat

SEQ ID NO: 17411 - DNA, 20 bp, Artificial Sequence
  sgRNA
  Cxcr2_5
ggatttcgtagaattaagat

SEQ ID NO: 17412 - DNA, 20 bp, Artificial Sequence
  sgRNA
  Cxcr2_6
attggccagaaatttcgcca

SEQ ID NO: 17413 - DNA, 20 bp, Artificial Sequence
  sgRNA
  Cxcr2_7
gtatgagaatatcttgcaca

SEQ ID NO: 17414 - DNA, 20 bp, Artificial Sequence
  sgRNA
  Cxcr2_8
gcatgatgagcagcggcacg

SEQ ID NO: 17415 - DNA, 20 bp, Artificial Sequence
  sgRNA
  Cxcr2_9
aggccttgtcaatgtcatcg

SEQ ID NO: 17416 - DNA, 20 bp, Artificial Sequence
  sgRNA
  Cxcr2_10
aaggagttcttagccaagga

SEQ ID NO: 17417 - DNA, 20 bp, Artificial Sequence
  sgRNA
  Cxcr2_11
gcaaggtcagggcaaagaac

SEQ ID NO: 17418 - DNA, 20 bp, Artificial Sequence
  sgRNA
  Cxcr2_12
ggaaatcaacagttatgctg

SEQ ID NO: 17419 - DNA, 20 bp, Artificial Sequence
  sgRNA
  Cxcr2_13
acagcatctggcagaataga

SEQ ID NO: 17420 - DNA, 20 bp, Artificial Sequence
  sgRNA
  Cxcr2_14
tacatcctcatagcagacta

SEQ ID NO: 17421 - DNA, 20 bp, Artificial Sequence
  sgRNA
  Cxcr2_15
gggtgtctgtgaacagaacc

SEQ ID NO: 17422 - DNA, 20 bp, Artificial Sequence
  sgRNA
  Cxcr2_16
cagaacagcatgatgagcag

SEQ ID NO: 17423 - DNA, 20 bp, Artificial Sequence
  sgRNA
  Cxcr2_17
gtgaacagaaccaggttgta

SEQ ID NO: 17424 - DNA, 20 bp, Artificial Sequence
  sgRNA
  Cxcr2_18
actgatccagaagagacact

SEQ ID NO: 17425 - DNA, 20 bp, Artificial Sequence
  sgRNA
  Cxcr2_19
acaggtctccttgatcagct

SEQ ID NO: 17426 - DNA, 20 bp, Artificial Sequence
  sgRNA
  Cxcr2_20
tacgcagtacgaccctcaaa

SEQ ID NO: 17427 - DNA, 20 bp, Artificial Sequence
  sgRNA
  Cxcr3_1
tgagggctacacgtacccgg

SEQ ID NO: 17428 - DNA, 20 bp, Artificial Sequence
  sgRNA
  Cxcr3_2
agttaacaccagcagaacat

SEQ ID NO: 17429 - DNA, 20 bp, Artificial Sequence
  sgRNA
  Cxcr3_3
tctgcgtgtactgcagctag

SEQ ID NO: 17430 - DNA, 20 bp, Artificial Sequence
  sgRNA
  Cxcr3_4
actggcaatgggtggcattg

SEQ ID NO: 17431 - DNA, 20 bp, Artificial Sequence
  sgRNA
  Cxcr3_5
ctgtggtcgagaaagccacg

SEQ ID NO: 17432 - DNA, 20 bp, Artificial Sequence
  sgRNA
  Cxcr3_6
cgccacccagatctaccgca

SEQ ID NO: 17433 - DNA, 20 bp, Artificial Sequence
  sgRNA
  Cxcr3_7
cgaagcttatacaagccagc

SEQ ID NO: 17434 - DNA, 20 bp, Artificial Sequence
  sgRNA
  Cxcr3_8
ggatatccactagcaccacc

SEQ ID NO: 17435 - DNA, 20 bp, Artificial Sequence
  sgRNA
  Cxcr3_9
agttcaggctgaaatcctgt

SEQ ID NO: 17436 - DNA, 20 bp, Artificial Sequence
  sgRNA
  Cxcr3_10
gatctaccgcagggaccccc

SEQ ID NO: 17437 - DNA, 20 bp, Artificial Sequence
  sgRNA
  Cxcr3_11
gtgagggctacacgtacccg

SEQ ID NO: 17438 - DNA, 20 bp, Artificial Sequence
  sgRNA
  Cxcr3_12
gcacctctccctacgattat

SEQ ID NO: 17439 - DNA, 20 bp, Artificial Sequence
  sgRNA
  Cxcr3_13
gagcagtgcgacccacctgt

SEQ ID NO: 17440 - DNA, 20 bp, Artificial Sequence
  sgRNA
  Cxcr3_14
gaagttgtactggcaatggg

SEQ ID NO: 17441 - DNA, 20 bp, Artificial Sequence
  sgRNA
  Cxcr3_15
ctgacttggccacatccacg

SEQ ID NO: 17442 - DNA, 20 bp, Artificial Sequence
  sgRNA
  Cxcr3_16
gcagaacatcggctacagcc

SEQ ID NO: 17443 - DNA, 20 bp, Artificial Sequence
  sgRNA
  Cxcr3_17
tgaagatgacggctgccgct

SEQ ID NO: 17444 - DNA, 20 bp, Artificial Sequence
  sgRNA
  Cxcr3_18
gcgcactgccctgagcagca

SEQ ID NO: 17445 - DNA, 20 bp, Artificial Sequence
  sgRNA
  Cxcr3_19
ctagcaccaccaggtgatag

SEQ ID NO: 17446 - DNA, 20 bp, Artificial Sequence
  sgRNA
  Cxcr3_20
ttgccagtacaacttcccac

SEQ ID NO: 17447 - DNA, 20 bp, Artificial Sequence
  sgRNA
  Cxcr4_1
acaggctatcggggtaaagg

SEQ ID NO: 17448 - DNA, 20 bp, Artificial Sequence
  sgRNA
  Cxcr4_2
tggtggcgtggacaatagcg

SEQ ID NO: 17449 - DNA, 20 bp, Artificial Sequence
  sgRNA
  Cxcr4_3
tcttctggtaacccatgacc

SEQ ID NO: 17450 - DNA, 20 bp, Artificial Sequence
  sgRNA
  Cxcr4_4
tggagactatgactccaaca

SEQ ID NO: 17451 - DNA, 20 bp, Artificial Sequence
  sgRNA
  Cxcr4_5
gatgtccccctggctgacgt

SEQ ID NO: 17452 - DNA, 20 bp, Artificial Sequence
  sgRNA
  Cxcr4_6
ctttgccgacgtcagccagg

SEQ ID NO: 17453 - DNA, 20 bp, Artificial Sequence
  sgRNA
  Cxcr4_7
gtaccggctgcacctgtcag

SEQ ID NO: 17454 - DNA, 20 bp, Artificial Sequence
  sgRNA
  Cxcr4_8
ggagcatgacggacaagtac

SEQ ID NO: 17455 - DNA, 20 bp, Artificial Sequence
  sgRNA
  Cxcr4_9
tggacactcttccgtctcca

SEQ ID NO: 17456 - DNA, 20 bp, Artificial Sequence
  sgRNA
  Cxcr4_10
cttgcttgatgacccccaaa

SEQ ID NO: 17457 - DNA, 20 bp, Artificial Sequence
  sgRNA
  Cxcr4_11
cacataatatggcagccagc

SEQ ID NO: 17458 - DNA, 20 bp, Artificial Sequence
  sgRNA
  Cxcr4_12
ggatggggttcaggcaacag

SEQ ID NO: 17459 - DNA, 20 bp, Artificial Sequence
  sgRNA
  Cxcr4_13
gcactcaactccatgagcag

SEQ ID NO: 17460 - DNA, 20 bp, Artificial Sequence
  sgRNA
  Cxcr4_14
tgatgatgcagtaacaggag

SEQ ID NO: 17461 - DNA, 20 bp, Artificial Sequence
  sgRNA
  Cxcr4_15
ttgactggcatagtcggcaa

SEQ ID NO: 17462 - DNA, 20 bp, Artificial Sequence
  sgRNA
  Cxcr4_16
caagtggatctccatcacag

SEQ ID NO: 17463 - DNA, 20 bp, Artificial Sequence
  sgRNA
  Cxcr4_17
tctttgccgacgtcagccag

SEQ ID NO: 17464 - DNA, 20 bp, Artificial Sequence
  sgRNA
  Cxcr4_18
ttaccccgatagcctgtgga

SEQ ID NO: 17465 - DNA, 20 bp, Artificial Sequence
  sgRNA
  Cxcr4_19
cccaaagtaccagtcagcca

SEQ ID NO: 17466 - DNA, 20 bp, Artificial Sequence
  sgRNA
  Cxcr4_20
tctaagctgtcacactccaa

SEQ ID NO: 17467 - DNA, 20 bp, Artificial Sequence
  sgRNA
  Cxcr5_1
gaaggtcggctactgcgagg

SEQ ID NO: 17468 - DNA, 20 bp, Artificial Sequence
  sgRNA
  Cxcr5_2
gtgatgggatggtgttacgt

SEQ ID NO: 17469 - DNA, 20 bp, Artificial Sequence
  sgRNA
  Cxcr5_3
ggatggagaggagtcgacgg

SEQ ID NO: 17470 - DNA, 20 bp, Artificial Sequence
  sgRNA
  Cxcr5_4
ggatgtttcccatcataccc

SEQ ID NO: 17471 - DNA, 20 bp, Artificial Sequence
  sgRNA
  Cxcr5_5
tggcctgtatagctgtagac

SEQ ID NO: 17472 - DNA, 20 bp, Artificial Sequence
  sgRNA
  Cxcr5_6
cgtttcctctaccacatcgg

SEQ ID NO: 17473 - DNA, 20 bp, Artificial Sequence
  sgRNA
  Cxcr5_7
ctactaccgatgcttgtgat

SEQ ID NO: 17474 - DNA, 20 bp, Artificial Sequence
  sgRNA
  Cxcr5_8
gccttaaaggacgtcagtaa

SEQ ID NO: 17475 - DNA, 20 bp, Artificial Sequence
  sgRNA
  Cxcr5_9
tgtttcccatcatacccagg

SEQ ID NO: 17476 - DNA, 20 bp, Artificial Sequence
  sgRNA
  Cxcr5_10
agagaaggtcggctactgcg

SEQ ID NO: 17477 - DNA, 20 bp, Artificial Sequence
  sgRNA
  Cxcr5_11
ggtaaggagtcgttgttatg

SEQ ID NO: 17478 - DNA, 20 bp, Artificial Sequence
  sgRNA
  Cxcr5_12
gtagtaggaagcccccgatg

SEQ ID NO: 17479 - DNA, 20 bp, Artificial Sequence
  sgRNA
  Cxcr5_13
catggacgatggctaggtac

SEQ ID NO: 17480 - DNA, 20 bp, Artificial Sequence
  sgRNA
  Cxcr5_14
gatgtggtagaggaaacggg

SEQ ID NO: 17481 - DNA, 20 bp, Artificial Sequence
  sgRNA
  Cxcr5_15
caccatcccatcacaagcat

SEQ ID NO: 17482 - DNA, 20 bp, Artificial Sequence
  sgRNA
  Cxcr5_16
gcttggtcagaagccgagag

SEQ ID NO: 17483 - DNA, 20 bp, Artificial Sequence
  sgRNA
  Cxcr5_17
acatcacctgcacggccatt

SEQ ID NO: 17484 - DNA, 20 bp, Artificial Sequence
  sgRNA
  Cxcr5_18
cttactgacgtcctttaagg

SEQ ID NO: 17485 - DNA, 20 bp, Artificial Sequence
  sgRNA
  Cxcr5_19
tacccactaaccctggacat

SEQ ID NO: 17486 - DNA, 20 bp, Artificial Sequence
  sgRNA
  Cxcr5_20
aacttctgctctacagtcga

SEQ ID NO: 17487 - DNA, 20 bp, Artificial Sequence
  sgRNA
  Cxcr6_1
gaagtttcgagcatgaagca

SEQ ID NO: 17488 - DNA, 20 bp, Artificial Sequence
  sgRNA
  Cxcr6_2
aatgtatataatcagaacca

SEQ ID NO: 17489 - DNA, 20 bp, Artificial Sequence
  sgRNA
  Cxcr6_3
gcagagtacagacaaacacc

SEQ ID NO: 17490 - DNA, 20 bp, Artificial Sequence
  sgRNA
  Cxcr6_4
acgcttcctaaagttcaagg

SEQ ID NO: 17491 - DNA, 20 bp, Artificial Sequence
  sgRNA
  Cxcr6_5
tagtggatatctcctcactg

SEQ ID NO: 17492 - DNA, 20 bp, Artificial Sequence
  sgRNA
  Cxcr6_6
ctgtacgatgggcactacga

SEQ ID NO: 17493 - DNA, 20 bp, Artificial Sequence
  sgRNA
  Cxcr6_7
tatagcctctgtcactacga

SEQ ID NO: 17494 - DNA, 20 bp, Artificial Sequence
  sgRNA
  Cxcr6_8
gcaggaacacagccactaca

SEQ ID NO: 17495 - DNA, 20 bp, Artificial Sequence
  sgRNA
  Cxcr6_9
agatcttccacttagcctgc

SEQ ID NO: 17496 - DNA, 20 bp, Artificial Sequence
  sgRNA
  Cxcr6_10
gtttctgctgaacttgcccc

SEQ ID NO: 17497 - DNA, 20 bp, Artificial Sequence
  sgRNA
  Cxcr6_11
ggtggtctctacattgtggg

SEQ ID NO: 17498 - DNA, 20 bp, Artificial Sequence
  sgRNA
  Cxcr6_12
cactctcacctgcatcacag

SEQ ID NO: 17499 - DNA, 20 bp, Artificial Sequence
  sgRNA
  Cxcr6_13
acatggccatagatgatctg

SEQ ID NO: 17500 - DNA, 20 bp, Artificial Sequence
  sgRNA
  Cxcr6_14
ccttcaaccggcaggctaag

SEQ ID NO: 17501 - DNA, 20 bp, Artificial Sequence
  sgRNA
  Cxcr6_15
tggactgctaggaaactccc

SEQ ID NO: 17502 - DNA, 20 bp, Artificial Sequence
  sgRNA
  Cxcr6_16
cagtgaggagatatccacta

SEQ ID NO: 17503 - DNA, 20 bp, Artificial Sequence
  sgRNA
  Cxcr6_17
taccaaggccttcaaccggc

SEQ ID NO: 17504 - DNA, 20 bp, Artificial Sequence
  sgRNA
  Cxcr6_18
gaatcatagtgagcaatggc

SEQ ID NO: 17505 - DNA, 20 bp, Artificial Sequence
  sgRNA
  Cxcr6_19
tctgtacgatgggcactacg

SEQ ID NO: 17506 - DNA, 20 bp, Artificial Sequence
  sgRNA
  Cxcr6_20
tatctgtcagtaccacagtg

SEQ ID NO: 17507 - DNA, 20 bp, Artificial Sequence
  sgRNA
  Cybb_1
cctctaccaaaaccattcgg

SEQ ID NO: 17508 - DNA, 20 bp, Artificial Sequence
  sgRNA
  Cybb_2
tttaccagacgaattgtacg

SEQ ID NO: 17509 - DNA, 20 bp, Artificial Sequence
  sgRNA
  Cybb_3
attctaacttggataccttg

SEQ ID NO: 17510 - DNA, 20 bp, Artificial Sequence
  sgRNA
  Cybb_4
ttatactcgaaaactccttg

SEQ ID NO: 17511 - DNA, 20 bp, Artificial Sequence
  sgRNA
  Cybb_5
aaaatgaagtggactccacg

SEQ ID NO: 17512 - DNA, 20 bp, Artificial Sequence
  sgRNA
  Cybb_6
catcctctaccaaaaccatt

SEQ ID NO: 17513 - DNA, 20 bp, Artificial Sequence
  sgRNA
  Cybb_7
gcaaaaggtggtcatcacca

SEQ ID NO: 17514 - DNA, 20 bp, Artificial Sequence
  sgRNA
  Cybb_8
aaatgaagtggactccacgc

SEQ ID NO: 17515 - DNA, 20 bp, Artificial Sequence
  sgRNA
  Cybb_9
aattgtacgtggacagactg

SEQ ID NO: 17516 - DNA, 20 bp, Artificial Sequence
  sgRNA
  Cybb_10
tgttcctgtacctttgtgag

SEQ ID NO: 17517 - DNA, 20 bp, Artificial Sequence
  sgRNA
  Cybb_11
tcttcactggctgtaccaaa

SEQ ID NO: 17518 - DNA, 20 bp, Artificial Sequence
  sgRNA
  Cybb_12
aactcagaatccggcccgcg

SEQ ID NO: 17519 - DNA, 20 bp, Artificial Sequence
  sgRNA
  Cybb_13
ctacttctactggctgtgca

SEQ ID NO: 17520 - DNA, 20 bp, Artificial Sequence
  sgRNA
  Cybb_14
catacagttgaaattcaggc

SEQ ID NO: 17521 - DNA, 20 bp, Artificial Sequence
  sgRNA
  Cybb_15
cacatctcttcaacgttgag

SEQ ID NO: 17522 - DNA, 20 bp, Artificial Sequence
  sgRNA
  Cybb_16
gtatgtggccgtgactcggt

SEQ ID NO: 17523 - DNA, 20 bp, Artificial Sequence
  sgRNA
  Cybb_17
gtaccagacagacttgagaa

SEQ ID NO: 17524 - DNA, 20 bp, Artificial Sequence
  sgRNA
  Cybb_18
gggacacgcatgcctttgag

SEQ ID NO: 17525 - DNA, 20 bp, Artificial Sequence
  sgRNA
  Cybb_19
gaggggctattcaatgcttg

SEQ ID NO: 17526 - DNA, 20 bp, Artificial Sequence
  sgRNA
  Cybb_20
tttcgagtataattatactt

SEQ ID NO: 17527 - DNA, 20 bp, Artificial Sequence
  sgRNA
  Cysltr1_1
acataatagaccacacggag

SEQ ID NO: 17528 - DNA, 20 bp, Artificial Sequence
  sgRNA
  Cysltr1_2
gaaagacaattgcaacacac

SEQ ID NO: 17529 - DNA, 20 bp, Artificial Sequence
  sgRNA
  Cysltr1_3
acaatagaggttaacgtaca

SEQ ID NO: 17530 - DNA, 20 bp, Artificial Sequence
  sgRNA
  Cysltr1_4
aattccaatgcaaacgaacc

SEQ ID NO: 17531 - DNA, 20 bp, Artificial Sequence
  sgRNA
  Cysltr1_5
gttaacgtacaaggcatagg

SEQ ID NO: 17532 - DNA, 20 bp, Artificial Sequence
  sgRNA
  Cysltr1_6
tgtgaacataatagaccaca

SEQ ID NO: 17533 - DNA, 20 bp, Artificial Sequence
  sgRNA
  Cysltr1_7
cctgaaaagaaatatagcag

SEQ ID NO: 17534 - DNA, 20 bp, Artificial Sequence
  sgRNA
  Cysltr1_8
agaaaaacatgccaagtcgt

SEQ ID NO: 17535 - DNA, 20 bp, Artificial Sequence
  sgRNA
  Cysltr1_9
atgtacattgcctctccgtg

SEQ ID NO: 17536 - DNA, 20 bp, Artificial Sequence
  sgRNA
  Cysltr1_10
tccagtccagaacattaatt

SEQ ID NO: 17537 - DNA, 20 bp, Artificial Sequence
  sgRNA
  Cysltr1_11
agacaattatggtgacaaaa

SEQ ID NO: 17538 - DNA, 20 bp, Artificial Sequence
  sgRNA
  Cysltr1_12
acattcctggagaacatgaa

SEQ ID NO: 17539 - DNA, 20 bp, Artificial Sequence
  sgRNA
  Cysltr1_13
gaggttaacgtacaaggcat

SEQ ID NO: 17540 - DNA, 20 bp, Artificial Sequence
  sgRNA
  Cysltr1_14
ttagcttgattgttctgtgg

SEQ ID NO: 17541 - DNA, 20 bp, Artificial Sequence
  sgRNA
  Cysltr1_15
cactgtgtaaaaggtgaagg

SEQ ID NO: 17542 - DNA, 20 bp, Artificial Sequence
  sgRNA
  Cysltr1_16
tggttacacagaaaaaagcc

SEQ ID NO: 17543 - DNA, 20 bp, Artificial Sequence
  sgRNA
  Cysltr1_17
caagtcgtaggaaggctata

SEQ ID NO: 17544 - DNA, 20 bp, Artificial Sequence
  sgRNA
  Cysltr1_18
attatgttcacaaaggcaag

SEQ ID NO: 17545 - DNA, 20 bp, Artificial Sequence
  sgRNA
  Cysltr1_19
taaagaagatgctacaatag

SEQ ID NO: 17546 - DNA, 20 bp, Artificial Sequence
  sgRNA
  Cysltr1_20
taagatttgtacattaaaaa

SEQ ID NO: 17547 - DNA, 20 bp, Artificial Sequence
  sgRNA
  D130043K22Rik_1
cacggcatcacggatgacga

SEQ ID NO: 17548 - DNA, 20 bp, Artificial Sequence
  sgRNA
  D130043K22Rik_2
tgcaactctagagaacaacc

SEQ ID NO: 17549 - DNA, 20 bp, Artificial Sequence
  sgRNA
  D130043K22Rik_3
tccaaccagcaagaccctag

SEQ ID NO: 17550 - DNA, 20 bp, Artificial Sequence
  sgRNA
  D130043K22Rik_4
gaggaggggttagcccagtg

SEQ ID NO: 17551 - DNA, 20 bp, Artificial Sequence
  sgRNA
  D130043K22Rik_5
gctggtctctcacggttaac

SEQ ID NO: 17552 - DNA, 20 bp, Artificial Sequence
  sgRNA
  D130043K22Rik_6
ggatggagaacctcatacag

SEQ ID NO: 17553 - DNA, 20 bp, Artificial Sequence
  sgRNA
  D130043K22Rik_7
ggtgtctcaaaccttctccg

SEQ ID NO: 17554 - DNA, 20 bp, Artificial Sequence
  sgRNA
  D130043K22Rik_8
tcgtgcgcagacctgtccag

SEQ ID NO: 17555 - DNA, 20 bp, Artificial Sequence
  sgRNA
  D130043K22Rik_9
tgtaggtaatgggctcgcag

SEQ ID NO: 17556 - DNA, 20 bp, Artificial Sequence
  sgRNA
  D130043K22Rik_10
atttggccctgcattggcaa

SEQ ID NO: 17557 - DNA, 20 bp, Artificial Sequence
  sgRNA
  D130043K22Rik_11
agcggtggattgctgtcccg

SEQ ID NO: 17558 - DNA, 20 bp, Artificial Sequence
  sgRNA
  D130043K22Rik_12
acccacccgttgccaatgca

SEQ ID NO: 17559 - DNA, 20 bp, Artificial Sequence
  sgRNA
  D130043K22Rik_13
gggactctatgccttcagag

SEQ ID NO: 17560 - DNA, 20 bp, Artificial Sequence
  sgRNA
  D130043K22Rik_14
gctagtcactgacagtcagg

SEQ ID NO: 17561 - DNA, 20 bp, Artificial Sequence
  sgRNA
  D130043K22Rik_15
gcacgaaagtgaggtaagac

SEQ ID NO: 17562 - DNA, 20 bp, Artificial Sequence
  sgRNA
  D130043K22Rik_16
gcagctgccctcaaaccacc

SEQ ID NO: 17563 - DNA, 20 bp, Artificial Sequence
  sgRNA
  D130043K22Rik_17
ggtactctgcgctacctcta

SEQ ID NO: 17564 - DNA, 20 bp, Artificial Sequence
  sgRNA
  D130043K22Rik_18
gctgctcaacaccaacctgc

SEQ ID NO: 17565 - DNA, 20 bp, Artificial Sequence
  sgRNA
  D130043K22Rik_19
ttaaccgtgagagaccagca

SEQ ID NO: 17566 - DNA, 20 bp, Artificial Sequence
  sgRNA
  D130043K22Rik_20
cgacttggtcccctacaccc

SEQ ID NO: 17567 - DNA, 20 bp, Artificial Sequence
  sgRNA
  D430019H16Rik_1
attgccaggggagttaaaca

SEQ ID NO: 17568 - DNA, 20 bp, Artificial Sequence
  sgRNA
  D430019H16Rik_2
atgaacgctcctcccatcat

SEQ ID NO: 17569 - DNA, 20 bp, Artificial Sequence
  sgRNA
  D430019H16Rik_3
gttcatggactcatccaatg

SEQ ID NO: 17570 - DNA, 20 bp, Artificial Sequence
  sgRNA
  D430019H16Rik_4
aatgtccactcgacgtccaa

SEQ ID NO: 17571 - DNA, 20 bp, Artificial Sequence
  sgRNA
  D430019H16Rik_5
cgtcgagtggacattgccag

SEQ ID NO: 17572 - DNA, 20 bp, Artificial Sequence
  sgRNA
  D430019H16Rik_6
acagcatcgttggaggagcg

SEQ ID NO: 17573 - DNA, 20 bp, Artificial Sequence
  sgRNA
  D430019H16Rik_7
aacactggggaacatagtgg

SEQ ID NO: 17574 - DNA, 20 bp, Artificial Sequence
  sgRNA
  D430019H16Rik_8
gagactcctcaggctggccg

SEQ ID NO: 17575 - DNA, 20 bp, Artificial Sequence
  sgRNA
  D430019H16Rik_9
cgtggccgttggacgtcgag

SEQ ID NO: 17576 - DNA, 20 bp, Artificial Sequence
  sgRNA
  D430019H16Rik_10
ttgccatcatagcaacactg

SEQ ID NO: 17577 - DNA, 20 bp, Artificial Sequence
  sgRNA
  D430019H16Rik_11
acgtcgagtggacattgcca

SEQ ID NO: 17578 - DNA, 20 bp, Artificial Sequence
  sgRNA
  D430019H16Rik_12
ccaacgatgctgttctgcta

SEQ ID NO: 17579 - DNA, 20 bp, Artificial Sequence
  sgRNA
  D430019H16Rik_13
ggagttaaacagggagtact

SEQ ID NO: 17580 - DNA, 20 bp, Artificial Sequence
  sgRNA
  D430019H16Rik_14
cactcgacgtccaacggcca

SEQ ID NO: 17581 - DNA, 20 bp, Artificial Sequence
  sgRNA
  D430019H16Rik_15
attgccatcatagcaacact

SEQ ID NO: 17582 - DNA, 20 bp, Artificial Sequence
  sgRNA
  D430019H16Rik_16
tagcagaacagcatcgttgg

SEQ ID NO: 17583 - DNA, 20 bp, Artificial Sequence
  sgRNA
  D430019H16Rik_17
ctcggtactgaagtcctcat

SEQ ID NO: 17584 - DNA, 20 bp, Artificial Sequence
  sgRNA
  D430019H16Rik_18
gaggagcgaggagactcctc

SEQ ID NO: 17585 - DNA, 20 bp, Artificial Sequence
  sgRNA
  D430019H16Rik_19
gacgtcgagtggacattgcc

SEQ ID NO: 17586 - DNA, 20 bp, Artificial Sequence
  sgRNA
  D430019H16Rik_20
ccatagcagaacagcatcgt

SEQ ID NO: 17587 - DNA, 20 bp, Artificial Sequence
  sgRNA
  D430041D05Rik_1
taagcaccatcgactcccag

SEQ ID NO: 17588 - DNA, 20 bp, Artificial Sequence
  sgRNA
  D430041D05Rik_2
tgatcttctcagaaacaatg

SEQ ID NO: 17589 - DNA, 20 bp, Artificial Sequence
  sgRNA
  D430041D05Rik_3
attggtaacaatttcccaag

SEQ ID NO: 17590 - DNA, 20 bp, Artificial Sequence
  sgRNA
  D430041D05Rik_4
agctgcgctgacgtccatga

SEQ ID NO: 17591 - DNA, 20 bp, Artificial Sequence
  sgRNA
  D430041D05Rik_5
tctcacgccctggcaacgcg

SEQ ID NO: 17592 - DNA, 20 bp, Artificial Sequence
  sgRNA
  D430041D05Rik_6
ctctcggatagccttcacga

SEQ ID NO: 17593 - DNA, 20 bp, Artificial Sequence
  sgRNA
  D430041D05Rik_7
catacatcttcctttccgcc

SEQ ID NO: 17594 - DNA, 20 bp, Artificial Sequence
  sgRNA
  D430041D05Rik_8
gcagctgaagttgtaccacc

SEQ ID NO: 17595 - DNA, 20 bp, Artificial Sequence
  sgRNA
  D430041D05Rik_9
acaggccccgatgtgcggaa

SEQ ID NO: 17596 - DNA, 20 bp, Artificial Sequence
  sgRNA
  D430041D05Rik_10
gggtaggcctcgatgtaccc

SEQ ID NO: 17597 - DNA, 20 bp, Artificial Sequence
  sgRNA
  D430041D05Rik_11
gctcacacaggcattgcgga

SEQ ID NO: 17598 - DNA, 20 bp, Artificial Sequence
  sgRNA
  D430041D05Rik_12
cctctcggatagccttcacg

SEQ ID NO: 17599 - DNA, 20 bp, Artificial Sequence
  sgRNA
  D430041D05Rik_13
gcccatttatctgcgcacat

SEQ ID NO: 17600 - DNA, 20 bp, Artificial Sequence
  sgRNA
  D430041D05Rik_14
tgtcccagcaacaaggccga

SEQ ID NO: 17601 - DNA, 20 bp, Artificial Sequence
  sgRNA
  D430041D05Rik_15
tatccccgattgtgtggcga

SEQ ID NO: 17602 - DNA, 20 bp, Artificial Sequence
  sgRNA
  D430041D05Rik_16
tgcaggctggggcttccacg

SEQ ID NO: 17603 - DNA, 20 bp, Artificial Sequence
  sgRNA
  D430041D05Rik_17
agtcactgcacgacgactgg

SEQ ID NO: 17604 - DNA, 20 bp, Artificial Sequence
  sgRNA
  D430041D05Rik_18
gacagagtccacgagccccg

SEQ ID NO: 17605 - DNA, 20 bp, Artificial Sequence
  sgRNA
  D430041D05Rik_19
tggcggtgcttgcctccccg

SEQ ID NO: 17606 - DNA, 20 bp, Artificial Sequence
  sgRNA
  D430041D05Rik_20
caacctgtggatcatcgctg

SEQ ID NO: 17607 - DNA, 20 bp, Artificial Sequence
  sgRNA
  Dag1_1
tggttaggttctcccccacg

SEQ ID NO: 17608 - DNA, 20 bp, Artificial Sequence
  sgRNA
  Dag1_2
gtctggaatgccaaccacgg

SEQ ID NO: 17609 - DNA, 20 bp, Artificial Sequence
  sgRNA
  Dag1_3
gacctcgatagagaacacac

SEQ ID NO: 17610 - DNA, 20 bp, Artificial Sequence
  sgRNA
  Dag1_4
ggcgtaggcactatccgcga

SEQ ID NO: 17611 - DNA, 20 bp, Artificial Sequence
  sgRNA
  Dag1_5
cgtcaactaccacaactcgg

SEQ ID NO: 17612 - DNA, 20 bp, Artificial Sequence
  sgRNA
  Dag1_6
gttaggatcctcatcccgca

SEQ ID NO: 17613 - DNA, 20 bp, Artificial Sequence
  sgRNA
  Dag1_7
aatggcacctcgcgtccgaa

SEQ ID NO: 17614 - DNA, 20 bp, Artificial Sequence
  sgRNA
  Dag1_8
gtggtagtacggattcgagt

SEQ ID NO: 17615 - DNA, 20 bp, Artificial Sequence
  sgRNA
  Dag1_9
acggtcaccattcggacgcg

SEQ ID NO: 17616 - DNA, 20 bp, Artificial Sequence
  sgRNA
  Dag1_10
gcgaatctggccaggaaccg

SEQ ID NO: 17617 - DNA, 20 bp, Artificial Sequence
  sgRNA
  Dag1_11
gccccgagtgatgttctgaa

SEQ ID NO: 17618 - DNA, 20 bp, Artificial Sequence
  sgRNA
  Dag1_12
gctcaagaatcacattgaca

SEQ ID NO: 17619 - DNA, 20 bp, Artificial Sequence
  sgRNA
  Dag1_13
ttaggatcctcatcccgcag

SEQ ID NO: 17620 - DNA, 20 bp, Artificial Sequence
  sgRNA
  Dag1_14
tctggaatgccaaccacggt

SEQ ID NO: 17621 - DNA, 20 bp, Artificial Sequence
  sgRNA
  Dag1_15
cagatggcactacctcacca

SEQ ID NO: 17622 - DNA, 20 bp, Artificial Sequence
  sgRNA
  Dag1_16
ggtggtagtacggattcgag

SEQ ID NO: 17623 - DNA, 20 bp, Artificial Sequence
  sgRNA
  Dag1_17
tggtggctcctgaatggccg

SEQ ID NO: 17624 - DNA, 20 bp, Artificial Sequence
  sgRNA
  Dag1_18
tgatctgctatcgcaagaag

SEQ ID NO: 17625 - DNA, 20 bp, Artificial Sequence
  sgRNA
  Dag1_19
gcaggattgctgatgaaaat

SEQ ID NO: 17626 - DNA, 20 bp, Artificial Sequence
  sgRNA
  Dag1_20
ttgtgaatgtcattcaccac

SEQ ID NO: 17627 - DNA, 20 bp, Artificial Sequence
  sgRNA
  Dagla_1
gggcgatggtcaaatcactg

SEQ ID NO: 17628 - DNA, 20 bp, Artificial Sequence
  sgRNA
  Dagla_2
acgaccccgattcgcccctg

SEQ ID NO: 17629 - DNA, 20 bp, Artificial Sequence
  sgRNA
  Dagla_3
aaagtggtgatcagtatccg

SEQ ID NO: 17630 - DNA, 20 bp, Artificial Sequence
  sgRNA
  Dagla_4
gcagcgagccaaacgcaatg

SEQ ID NO: 17631 - DNA, 20 bp, Artificial Sequence
  sgRNA
  Dagla_5
acctggccgcatcatccacg

SEQ ID NO: 17632 - DNA, 20 bp, Artificial Sequence
  sgRNA
  Dagla_6
cttggtctataacccacacg

SEQ ID NO: 17633 - DNA, 20 bp, Artificial Sequence
  sgRNA
  Dagla_7
acgtactgcatggagtcccg

SEQ ID NO: 17634 - DNA, 20 bp, Artificial Sequence
  sgRNA
  Dagla_8
gcagtactggagcgtgacga

SEQ ID NO: 17635 - DNA, 20 bp, Artificial Sequence
  sgRNA
  Dagla_9
cggcgaattctagcacctga

SEQ ID NO: 17636 - DNA, 20 bp, Artificial Sequence
  sgRNA
  Dagla_10
ggacatccagaagctgccga

SEQ ID NO: 17637 - DNA, 20 bp, Artificial Sequence
  sgRNA
  Dagla_11
caggtccatgagctcccccg

SEQ ID NO: 17638 - DNA, 20 bp, Artificial Sequence
  sgRNA
  Dagla_12
gctcatggacctgaccccca

SEQ ID NO: 17639 - DNA, 20 bp, Artificial Sequence
  sgRNA
  Dagla_13
gggcgaatcggggtcgtgca

SEQ ID NO: 17640 - DNA, 20 bp, Artificial Sequence
  sgRNA
  Dagla_14
aggccagcaatgatgtcgga

SEQ ID NO: 17641 - DNA, 20 bp, Artificial Sequence
  sgRNA
  Dagla_15
gagttcatctacgctatcgt

SEQ ID NO: 17642 - DNA, 20 bp, Artificial Sequence
  sgRNA
  Dagla_16
ggtggctctcagcttgacga

SEQ ID NO: 17643 - DNA, 20 bp, Artificial Sequence
  sgRNA
  Dagla_17
cacgctccagtactgcatgg

SEQ ID NO: 17644 - DNA, 20 bp, Artificial Sequence
  sgRNA
  Dagla_18
ggagtaagcgaagcacttga

SEQ ID NO: 17645 - DNA, 20 bp, Artificial Sequence
  sgRNA
  Dagla_19
ggtcacctccacctgatcct

SEQ ID NO: 17646 - DNA, 20 bp, Artificial Sequence
  sgRNA
  Dagla_20
cagtctgagatgagtctgga

SEQ ID NO: 17647 - DNA, 20 bp, Artificial Sequence
  sgRNA
  Daglb_1
agcttagacatagacttccg

SEQ ID NO: 17648 - DNA, 20 bp, Artificial Sequence
  sgRNA
  Daglb_2
acctcacctgacaatgacgg

SEQ ID NO: 17649 - DNA, 20 bp, Artificial Sequence
  sgRNA
  Daglb_3
tctacaggaacccgttcacg

SEQ ID NO: 17650 - DNA, 20 bp, Artificial Sequence
  sgRNA
  Daglb_4
tctcaccggagcgacactga

SEQ ID NO: 17651 - DNA, 20 bp, Artificial Sequence
  sgRNA
  Daglb_5
tggtccagaaccactatgaa

SEQ ID NO: 17652 - DNA, 20 bp, Artificial Sequence
  sgRNA
  Daglb_6
tgttggtacggactgttcgg

SEQ ID NO: 17653 - DNA, 20 bp, Artificial Sequence
  sgRNA
  Daglb_7
ttgtcgtgtcgcttatccta

SEQ ID NO: 17654 - DNA, 20 bp, Artificial Sequence
  sgRNA
  Daglb_8
tcttcaggccagtcagtaac

SEQ ID NO: 17655 - DNA, 20 bp, Artificial Sequence
  sgRNA
  Daglb_9
cgctggctagagaccagcgc

SEQ ID NO: 17656 - DNA, 20 bp, Artificial Sequence
  sgRNA
  Daglb_10
ataagcacggacttgtgggt

SEQ ID NO: 17657 - DNA, 20 bp, Artificial Sequence
  sgRNA
  Daglb_11
acctggcaggatcatccacc

SEQ ID NO: 17658 - DNA, 20 bp, Artificial Sequence
  sgRNA
  Daglb_12
ggagccatcttcccgcccag

SEQ ID NO: 17659 - DNA, 20 bp, Artificial Sequence
  sgRNA
  Daglb_13
agacatagagtacgatgcag

SEQ ID NO: 17660 - DNA, 20 bp, Artificial Sequence
  sgRNA
  Daglb_14
acatagacttccgaggtcca

SEQ ID NO: 17661 - DNA, 20 bp, Artificial Sequence
  sgRNA
  Daglb_15
gtatgagctgcccttcatag

SEQ ID NO: 17662 - DNA, 20 bp, Artificial Sequence
  sgRNA
  Daglb_16
gcaggatgataacaccaggg

SEQ ID NO: 17663 - DNA, 20 bp, Artificial Sequence
  sgRNA
  Daglb_17
gacacacacgatggccaaca

SEQ ID NO: 17664 - DNA, 20 bp, Artificial Sequence
  sgRNA
  Daglb_18
gcggggagaaggcataagca

SEQ ID NO: 17665 - DNA, 20 bp, Artificial Sequence
  sgRNA
  Daglb_19
gttagccatcatgctccggg

SEQ ID NO: 17666 - DNA, 20 bp, Artificial Sequence
  sgRNA
  Daglb_20
gggttcctgtagatgtagag

SEQ ID NO: 17667 - DNA, 20 bp, Artificial Sequence
  sgRNA
  Dcbld1_1
tgacatctaagaattatcca

SEQ ID NO: 17668 - DNA, 20 bp, Artificial Sequence
  sgRNA
  Dcbld1_2
ttaataacctgtttggaacg

SEQ ID NO: 17669 - DNA, 20 bp, Artificial Sequence
  sgRNA
  Dcbld1_3
aggaatgaatattacaactg

SEQ ID NO: 17670 - DNA, 20 bp, Artificial Sequence
  sgRNA
  Dcbld1_4
gcaaagctgccatccacgca

SEQ ID NO: 17671 - DNA, 20 bp, Artificial Sequence
  sgRNA
  Dcbld1_5
ctatgactgtcctcaccgcc

SEQ ID NO: 17672 - DNA, 20 bp, Artificial Sequence
  sgRNA
  Dcbld1_6
gctatgtctctacagccagc

SEQ ID NO: 17673 - DNA, 20 bp, Artificial Sequence
  sgRNA
  Dcbld1_7
ggatctcacatttctggccg

SEQ ID NO: 17674 - DNA, 20 bp, Artificial Sequence
  sgRNA
  Dcbld1_8
cgaataaccatcatctcccc

SEQ ID NO: 17675 - DNA, 20 bp, Artificial Sequence
  sgRNA
  Dcbld1_9
ctatgtctctacagccagct

SEQ ID NO: 17676 - DNA, 20 bp, Artificial Sequence
  sgRNA
  Dcbld1_10
tcttgcgcccctcaaccaga

SEQ ID NO: 17677 - DNA, 20 bp, Artificial Sequence
  sgRNA
  Dcbld1_11
cagtcacagatgacttccgg

SEQ ID NO: 17678 - DNA, 20 bp, Artificial Sequence
  sgRNA
  Dcbld1_12
catctgtgatgatccctgcg

SEQ ID NO: 17679 - DNA, 20 bp, Artificial Sequence
  sgRNA
  Dcbld1_13
atgccacacctatcgtggag

SEQ ID NO: 17680 - DNA, 20 bp, Artificial Sequence
  sgRNA
  Dcbld1_14
acgaggcagccattatttcg

SEQ ID NO: 17681 - DNA, 20 bp, Artificial Sequence
  sgRNA
  Dcbld1_15
acaggcacagtcgcgagaaa

SEQ ID NO: 17682 - DNA, 20 bp, Artificial Sequence
  sgRNA
  Dcbld1_16
tcagtcacagatgacttccg

SEQ ID NO: 17683 - DNA, 20 bp, Artificial Sequence
  sgRNA
  Dcbld1_17
tcctcagtgtctgtgtccat

SEQ ID NO: 17684 - DNA, 20 bp, Artificial Sequence
  sgRNA
  Dcbld1_18
gggatcatcacagatgaact

SEQ ID NO: 17685 - DNA, 20 bp, Artificial Sequence
  sgRNA
  Dcbld1_19
gctggctgtagagacatagc

SEQ ID NO: 17686 - DNA, 20 bp, Artificial Sequence
  sgRNA
  Dcbld1_20
cccaggttgaaagctatcag

SEQ ID NO: 17687 - DNA, 20 bp, Artificial Sequence
  sgRNA
  Dcbld2_1
gctgcagatagaccttaaca

SEQ ID NO: 17688 - DNA, 20 bp, Artificial Sequence
  sgRNA
  Dcbld2_2
tggattccagccatacacaa

SEQ ID NO: 17689 - DNA, 20 bp, Artificial Sequence
  sgRNA
  Dcbld2_3
aggttattgccgttccgagg

SEQ ID NO: 17690 - DNA, 20 bp, Artificial Sequence
  sgRNA
  Dcbld2_4
gtcacagtgctgttcatgag

SEQ ID NO: 17691 - DNA, 20 bp, Artificial Sequence
  sgRNA
  Dcbld2_5
ctgaggttattgccgttccg

SEQ ID NO: 17692 - DNA, 20 bp, Artificial Sequence
  sgRNA
  Dcbld2_6
tgacatgtccatgacgatcg

SEQ ID NO: 17693 - DNA, 20 bp, Artificial Sequence
  sgRNA
  Dcbld2_7
gctcagtatgacaccccaaa

SEQ ID NO: 17694 - DNA, 20 bp, Artificial Sequence
  sgRNA
  Dcbld2_8
cctgacatgtccatgacgat

SEQ ID NO: 17695 - DNA, 20 bp, Artificial Sequence
  sgRNA
  Dcbld2_9
ggaagttcattcctacttcg

SEQ ID NO: 17696 - DNA, 20 bp, Artificial Sequence
  sgRNA
  Dcbld2_10
gtagtgtcaaacgtgctggg

SEQ ID NO: 17697 - DNA, 20 bp, Artificial Sequence
  sgRNA
  Dcbld2_11
gagtcctgtacagtgacgat

SEQ ID NO: 17698 - DNA, 20 bp, Artificial Sequence
  sgRNA
  Dcbld2_12
ttagagtgaaccctgtccag

SEQ ID NO: 17699 - DNA, 20 bp, Artificial Sequence
  sgRNA
  Dcbld2_13
cttactccacctcctcggaa

SEQ ID NO: 17700 - DNA, 20 bp, Artificial Sequence
  sgRNA
  Dcbld2_14
ggagtggtagttgtctccgc

SEQ ID NO: 17701 - DNA, 20 bp, Artificial Sequence
  sgRNA
  Dcbld2_15
gctcgtcccaaactaggtaa

SEQ ID NO: 17702 - DNA, 20 bp, Artificial Sequence
  sgRNA
  Dcbld2_16
cgtttgacactactcctgca

SEQ ID NO: 17703 - DNA, 20 bp, Artificial Sequence
  sgRNA
  Dcbld2_17
tgagggccatgaccagcaca

SEQ ID NO: 17704 - DNA, 20 bp, Artificial Sequence
  sgRNA
  Dcbld2_18
ttattgccgttccgaggagg

SEQ ID NO: 17705 - DNA, 20 bp, Artificial Sequence
  sgRNA
  Dcbld2_19
ctgaaccactgcccgtaacg

SEQ ID NO: 17706 - DNA, 20 bp, Artificial Sequence
  sgRNA
  Dcbld2_20
tcagcattgtgattagcaaa

SEQ ID NO: 17707 - DNA, 20 bp, Artificial Sequence
  sgRNA
  Dcc_1
gcaaaggataataatcaacg

SEQ ID NO: 17708 - DNA, 20 bp, Artificial Sequence
  sgRNA
  Dcc_2
cacctggttacgaggcgagg

SEQ ID NO: 17709 - DNA, 20 bp, Artificial Sequence
  sgRNA
  Dcc_3
cacagaaagactacccgcag

SEQ ID NO: 17710 - DNA, 20 bp, Artificial Sequence
  sgRNA
  Dcc_4
aacccatgccaacaatacac

SEQ ID NO: 17711 - DNA, 20 bp, Artificial Sequence
  sgRNA
  Dcc_5
tgaaggactttaccaatgcg

SEQ ID NO: 17712 - DNA, 20 bp, Artificial Sequence
  sgRNA
  Dcc_6
gtactggaccaccttccaac

SEQ ID NO: 17713 - DNA, 20 bp, Artificial Sequence
  sgRNA
  Dcc_7
acacagaaagactacccgca

SEQ ID NO: 17714 - DNA, 20 bp, Artificial Sequence
  sgRNA
  Dcc_8
ctaatctgcaatgctccgga

SEQ ID NO: 17715 - DNA, 20 bp, Artificial Sequence
  sgRNA
  Dcc_9
aacggtgtacagtcgcacat

SEQ ID NO: 17716 - DNA, 20 bp, Artificial Sequence
  sgRNA
  Dcc_10
gtaataaccgtggtcaccgt

SEQ ID NO: 17717 - DNA, 20 bp, Artificial Sequence
  sgRNA
  Dcc_11
ggacagatgcaccccccgca

SEQ ID NO: 17718 - DNA, 20 bp, Artificial Sequence
  sgRNA
  Dcc_12
tcattccagacaccataagc

SEQ ID NO: 17719 - DNA, 20 bp, Artificial Sequence
  sgRNA
  Dcc_13
ggagtgacactgccatgcgg

SEQ ID NO: 17720 - DNA, 20 bp, Artificial Sequence
  sgRNA
  Dcc_14
tgacagtcattactcgagag

SEQ ID NO: 17721 - DNA, 20 bp, Artificial Sequence
  sgRNA
  Dcc_15
aaagctggtcctccaccgaa

SEQ ID NO: 17722 - DNA, 20 bp, Artificial Sequence
  sgRNA
  Dcc_16
ccaagtttcacctggttacg

SEQ ID NO: 17723 - DNA, 20 bp, Artificial Sequence
  sgRNA
  Dcc_17
tgcctttccggccagcccaa

SEQ ID NO: 17724 - DNA, 20 bp, Artificial Sequence
  sgRNA
  Dcc_18
gctctcataggcatagaggt

SEQ ID NO: 17725 - DNA, 20 bp, Artificial Sequence
  sgRNA
  Dcc_19
tctgctgcgctgaagaacgc

SEQ ID NO: 17726 - DNA, 20 bp, Artificial Sequence
  sgRNA
  Dcc_20
cctccatcgggaacacaaaa

SEQ ID NO: 17727 - DNA, 20 bp, Artificial Sequence
  sgRNA
  Dchs1_1
tgcgcggaaagtgtatagcg

SEQ ID NO: 17728 - DNA, 20 bp, Artificial Sequence
  sgRNA
  Dchs1_2
actgtgatgtgcgttaacag

SEQ ID NO: 17729 - DNA, 20 bp, Artificial Sequence
  sgRNA
  Dchs1_3
taggtagggctatcaaatcg

SEQ ID NO: 17730 - DNA, 20 bp, Artificial Sequence
  sgRNA
  Dchs1_4
tcgtgtggctcgatcccccg

SEQ ID NO: 17731 - DNA, 20 bp, Artificial Sequence
  sgRNA
  Dchs1_5
tgatggggaggcgaagaccg

SEQ ID NO: 17732 - DNA, 20 bp, Artificial Sequence
  sgRNA
  Dchs1_6
aagtgtatagcgtggcaccg

SEQ ID NO: 17733 - DNA, 20 bp, Artificial Sequence
  sgRNA
  Dchs1_7
gctgcaacatgtagtgtgag

SEQ ID NO: 17734 - DNA, 20 bp, Artificial Sequence
  sgRNA
  Dchs1_8
ccgcgtgtcctatcgccttg

SEQ ID NO: 17735 - DNA, 20 bp, Artificial Sequence
  sgRNA
  Dchs1_9
gctgtagtccacagtagcat

SEQ ID NO: 17736 - DNA, 20 bp, Artificial Sequence
  sgRNA
  Dchs1_10
gttccggtggtagtgcccga

SEQ ID NO: 17737 - DNA, 20 bp, Artificial Sequence
  sgRNA
  Dchs1_11
tgttcgggcgcgaagccgca

SEQ ID NO: 17738 - DNA, 20 bp, Artificial Sequence
  sgRNA
  Dchs1_12
gctcgctgttcacggtccaa

SEQ ID NO: 17739 - DNA, 20 bp, Artificial Sequence
  sgRNA
  Dchs1_13
tcacggtgacagctatcgat

SEQ ID NO: 17740 - DNA, 20 bp, Artificial Sequence
  sgRNA
  Dchs1_14
acaacgctccccgtttcctg

SEQ ID NO: 17741 - DNA, 20 bp, Artificial Sequence
  sgRNA
  Dchs1_15
gatgctcgagtaaagacggg

SEQ ID NO: 17742 - DNA, 20 bp, Artificial Sequence
  sgRNA
  Dchs1_16
tcgatcttcagctcgaagcg

SEQ ID NO: 17743 - DNA, 20 bp, Artificial Sequence
  sgRNA
  Dchs1_17
ccgcaaggcgataggacacg

SEQ ID NO: 17744 - DNA, 20 bp, Artificial Sequence
  sgRNA
  Dchs1_18
ctctctgcatcctcacaccg

SEQ ID NO: 17745 - DNA, 20 bp, Artificial Sequence
  sgRNA
  Dchs1_19
catcacgagcaggctccagt

SEQ ID NO: 17746 - DNA, 20 bp, Artificial Sequence
  sgRNA
  Dchs1_20
cgccaagtacaggcgaccgg

SEQ ID NO: 17747 - DNA, 20 bp, Artificial Sequence
  sgRNA
  Dcstamp_1
aagcgttcctaccttcacgg

SEQ ID NO: 17748 - DNA, 20 bp, Artificial Sequence
  sgRNA
  Dcstamp_2
gctcatatgaatgacactag

SEQ ID NO: 17749 - DNA, 20 bp, Artificial Sequence
  sgRNA
  Dcstamp_3
aaggccgtaaatccactgga

SEQ ID NO: 17750 - DNA, 20 bp, Artificial Sequence
  sgRNA
  Dcstamp_4
cccacatgtagagataggtc

SEQ ID NO: 17751 - DNA, 20 bp, Artificial Sequence
  sgRNA
  Dcstamp_5
gctctgtcgtgaccaccata

SEQ ID NO: 17752 - DNA, 20 bp, Artificial Sequence
  sgRNA
  Dcstamp_6
ggaacagcataggaaaacac

SEQ ID NO: 17753 - DNA, 20 bp, Artificial Sequence
  sgRNA
  Dcstamp_7
gaagttcacttgaaactacg

SEQ ID NO: 17754 - DNA, 20 bp, Artificial Sequence
  sgRNA
  Dcstamp_8
atacagcagatagtccacag

SEQ ID NO: 17755 - DNA, 20 bp, Artificial Sequence
  sgRNA
  Dcstamp_9
cctgacctatctctacatgt

SEQ ID NO: 17756 - DNA, 20 bp, Artificial Sequence
  sgRNA
  Dcstamp_10
gatgagcagaagcccggcaa

SEQ ID NO: 17757 - DNA, 20 bp, Artificial Sequence
  sgRNA
  Dcstamp_11
gtctcagacacactgagacg

SEQ ID NO: 17758 - DNA, 20 bp, Artificial Sequence
  sgRNA
  Dcstamp_12
ggatgaagtccagccagcta

SEQ ID NO: 17759 - DNA, 20 bp, Artificial Sequence
  sgRNA
  Dcstamp_13
acagagctgttgacttccgt

SEQ ID NO: 17760 - DNA, 20 bp, Artificial Sequence
  sgRNA
  Dcstamp_14
acatcaccaaacaatttgtt

SEQ ID NO: 17761 - DNA, 20 bp, Artificial Sequence
  sgRNA
  Dcstamp_15
tttccttcttattcagcggg

SEQ ID NO: 17762 - DNA, 20 bp, Artificial Sequence
  sgRNA
  Dcstamp_16
cagagaagaggctcaccgaa

SEQ ID NO: 17763 - DNA, 20 bp, Artificial Sequence
  sgRNA
  Dcstamp_17
aggtcatcaaatagattcag

SEQ ID NO: 17764 - DNA, 20 bp, Artificial Sequence
  sgRNA
  Dcstamp_18
acggaggccacacgacagaa

SEQ ID NO: 17765 - DNA, 20 bp, Artificial Sequence
  sgRNA
  Dcstamp_19
aaaaggagaggcaccaacag

SEQ ID NO: 17766 - DNA, 20 bp, Artificial Sequence
  sgRNA
  Dcstamp_20
ggtatactgaagccatccag

SEQ ID NO: 17767 - DNA, 20 bp, Artificial Sequence
  sgRNA
  Dct_1
gaactcgagattctctacct

SEQ ID NO: 17768 - DNA, 20 bp, Artificial Sequence
  sgRNA
  Dct_2
tccaaggtcatgcagactcg

SEQ ID NO: 17769 - DNA, 20 bp, Artificial Sequence
  sgRNA
  Dct_3
gtacctgtgccacgtgacaa

SEQ ID NO: 17770 - DNA, 20 bp, Artificial Sequence
  sgRNA
  Dct_4
tttgctggttataattgtgg

SEQ ID NO: 17771 - DNA, 20 bp, Artificial Sequence
  sgRNA
  Dct_5
cttggatgactacaaccgcc

SEQ ID NO: 17772 - DNA, 20 bp, Artificial Sequence
  sgRNA
  Dct_6
gctcctcattagtcaccggt

SEQ ID NO: 17773 - DNA, 20 bp, Artificial Sequence
  sgRNA
  Dct_7
cattacacagtgtgacccgg

SEQ ID NO: 17774 - DNA, 20 bp, Artificial Sequence
  sgRNA
  Dct_8
gcttggatgactacaaccgc

SEQ ID NO: 17775 - DNA, 20 bp, Artificial Sequence
  sgRNA
  Dct_9
agagcaagacgaaagctccc

SEQ ID NO: 17776 - DNA, 20 bp, Artificial Sequence
  sgRNA
  Dct_10
ggaccggccccgactgtaat

SEQ ID NO: 17777 - DNA, 20 bp, Artificial Sequence
  sgRNA
  Dct_11
gcttcttccgattacagtcg

SEQ ID NO: 17778 - DNA, 20 bp, Artificial Sequence
  sgRNA
  Dct_12
tggcgtctgtaaaagagtgg

SEQ ID NO: 17779 - DNA, 20 bp, Artificial Sequence
  sgRNA
  Dct_13
cgactgtaatcggaagaagc

SEQ ID NO: 17780 - DNA, 20 bp, Artificial Sequence
  sgRNA
  Dct_14
acgtgatcaccacgcaacac

SEQ ID NO: 17781 - DNA, 20 bp, Artificial Sequence
  sgRNA
  Dct_15
cccggttgcaaagttccagt

SEQ ID NO: 17782 - DNA, 20 bp, Artificial Sequence
  sgRNA
  Dct_16
gttccagtagggcaacgcaa

SEQ ID NO: 17783 - DNA, 20 bp, Artificial Sequence
  sgRNA
  Dct_17
cctactggaactttgcaacc

SEQ ID NO: 17784 - DNA, 20 bp, Artificial Sequence
  sgRNA
  Dct_18
aagagctcctcattagtcac

SEQ ID NO: 17785 - DNA, 20 bp, Artificial Sequence
  sgRNA
  Dct_19
ggagctttcgtcttgctctt

SEQ ID NO: 17786 - DNA, 20 bp, Artificial Sequence
  sgRNA
  Dct_20
catggtccccttcttcccac

SEQ ID NO: 17787 - DNA, 20 bp, Artificial Sequence
  sgRNA
  Ddr1_1
acttacgcccgtccccctcg

SEQ ID NO: 17788 - DNA, 20 bp, Artificial Sequence
  sgRNA
  Ddr1_2
tgtcatatacagcccccgtg

SEQ ID NO: 17789 - DNA, 20 bp, Artificial Sequence
  sgRNA
  Ddr1_3
ggcagcggtagagtccgacc

SEQ ID NO: 17790 - DNA, 20 bp, Artificial Sequence
  sgRNA
  Ddr1_4
tcgggtaacgaggatcccgg

SEQ ID NO: 17791 - DNA, 20 bp, Artificial Sequence
  sgRNA
  Ddr1_5
cctgtcatatacagcccccg

SEQ ID NO: 17792 - DNA, 20 bp, Artificial Sequence
  sgRNA
  Ddr1_6
tgttgagcgcatcatccgcc

SEQ ID NO: 17793 - DNA, 20 bp, Artificial Sequence
  sgRNA
  Ddr1_7
gctggtccgcttctacccca

SEQ ID NO: 17794 - DNA, 20 bp, Artificial Sequence
  sgRNA
  Ddr1_8
gtaaccaaggacctgcaaag

SEQ ID NO: 17795 - DNA, 20 bp, Artificial Sequence
  sgRNA
  Ddr1_9
gcgggtcctctacttcacac

SEQ ID NO: 17796 - DNA, 20 bp, Artificial Sequence
  sgRNA
  Ddr1_10
gccactggctgttgaccccg

SEQ ID NO: 17797 - DNA, 20 bp, Artificial Sequence
  sgRNA
  Ddr1_11
gagcaatcagagcttcccca

SEQ ID NO: 17798 - DNA, 20 bp, Artificial Sequence
  sgRNA
  Ddr1_12
gaatggggtggagtcccccg

SEQ ID NO: 17799 - DNA, 20 bp, Artificial Sequence
  sgRNA
  Ddr1_13
ccgatgcacaaagttcagcg

SEQ ID NO: 17800 - DNA, 20 bp, Artificial Sequence
  sgRNA
  Ddr1_14
ccttccagtccatccagcgg

SEQ ID NO: 17801 - DNA, 20 bp, Artificial Sequence
  sgRNA
  Ddr1_15
gagcatcagcacctcccaca

SEQ ID NO: 17802 - DNA, 20 bp, Artificial Sequence
  sgRNA
  Ddr1_16
gagcttccccacgggctacg

SEQ ID NO: 17803 - DNA, 20 bp, Artificial Sequence
  sgRNA
  Ddr1_17
aagagttctcccgaagctat

SEQ ID NO: 17804 - DNA, 20 bp, Artificial Sequence
  sgRNA
  Ddr1_18
ggtgcggtcctgcatgccca

SEQ ID NO: 17805 - DNA, 20 bp, Artificial Sequence
  sgRNA
  Ddr1_19
tgtagtctgtgatcatgcag

SEQ ID NO: 17806 - DNA, 20 bp, Artificial Sequence
  sgRNA
  Ddr1_20
ggcgagataacgcatgccag

SEQ ID NO: 17807 - DNA, 20 bp, Artificial Sequence
  sgRNA
  Ddr2_1
cggaacgaaagtgctaccaa

SEQ ID NO: 17808 - DNA, 20 bp, Artificial Sequence
  sgRNA
  Ddr2_2
ctaatcacacgtaccatagg

SEQ ID NO: 17809 - DNA, 20 bp, Artificial Sequence
  sgRNA
  Ddr2_3
tacactttatcactcttgtg

SEQ ID NO: 17810 - DNA, 20 bp, Artificial Sequence
  sgRNA
  Ddr2_4
ccgtgacaaaccgggcactg

SEQ ID NO: 17811 - DNA, 20 bp, Artificial Sequence
  sgRNA
  Ddr2_5
ggtccagtgctactttcgct

SEQ ID NO: 17812 - DNA, 20 bp, Artificial Sequence
  sgRNA
  Ddr2_6
gcagccctattcccagctgt

SEQ ID NO: 17813 - DNA, 20 bp, Artificial Sequence
  sgRNA
  Ddr2_7
ccttcaggaatacatcataa

SEQ ID NO: 17814 - DNA, 20 bp, Artificial Sequence
  sgRNA
  Ddr2_8
gagagttcttccgagaccaa

SEQ ID NO: 17815 - DNA, 20 bp, Artificial Sequence
  sgRNA
  Ddr2_9
gccgacatagtgaatctcca

SEQ ID NO: 17816 - DNA, 20 bp, Artificial Sequence
  sgRNA
  Ddr2_10
tttccccgatagcagatcca

SEQ ID NO: 17817 - DNA, 20 bp, Artificial Sequence
  sgRNA
  Ddr2_11
ggagaagagaaaccaagcac

SEQ ID NO: 17818 - DNA, 20 bp, Artificial Sequence
  sgRNA
  Ddr2_12
ggtgattactaccggatcca

SEQ ID NO: 17819 - DNA, 20 bp, Artificial Sequence
  sgRNA
  Ddr2_13
agtcatagccaggccacacg

SEQ ID NO: 17820 - DNA, 20 bp, Artificial Sequence
  sgRNA
  Ddr2_14
cctcccatatttggcagccg

SEQ ID NO: 17821 - DNA, 20 bp, Artificial Sequence
  sgRNA
  Ddr2_15
ccacggctgccaaatatggg

SEQ ID NO: 17822 - DNA, 20 bp, Artificial Sequence
  sgRNA
  Ddr2_16
tcatccacgtgtcggcaaaa

SEQ ID NO: 17823 - DNA, 20 bp, Artificial Sequence
  sgRNA
  Ddr2_17
tattccgtgatcatgcagag

SEQ ID NO: 17824 - DNA, 20 bp, Artificial Sequence
  sgRNA
  Ddr2_18
tctcctggcgtaaccggcat

SEQ ID NO: 17825 - DNA, 20 bp, Artificial Sequence
  sgRNA
  Ddr2_19
cttagctgtgtgcatcactg

SEQ ID NO: 17826 - DNA, 20 bp, Artificial Sequence
  sgRNA
  Ddr2_20
ggcccacacatcacttgccg

SEQ ID NO: 17827 - DNA, 20 bp, Artificial Sequence
  sgRNA
  Dgcr2_1
gggcagtttgcatgtcacgg

SEQ ID NO: 17828 - DNA, 20 bp, Artificial Sequence
  sgRNA
  Dgcr2_2
agaggcccgtccttatggga

SEQ ID NO: 17829 - DNA, 20 bp, Artificial Sequence
  sgRNA
  Dgcr2_3
ttcctagggaaatgcccaag

SEQ ID NO: 17830 - DNA, 20 bp, Artificial Sequence
  sgRNA
  Dgcr2_4
cggtactgctgacacccctg

SEQ ID NO: 17831 - DNA, 20 bp, Artificial Sequence
  sgRNA
  Dgcr2_5
gggttctacttcactcccaa

SEQ ID NO: 17832 - DNA, 20 bp, Artificial Sequence
  sgRNA
  Dgcr2_6
gggttgatagacgcctcata

SEQ ID NO: 17833 - DNA, 20 bp, Artificial Sequence
  sgRNA
  Dgcr2_7
ccgtcgtcagaaagatgtag

SEQ ID NO: 17834 - DNA, 20 bp, Artificial Sequence
  sgRNA
  Dgcr2_8
tcactcttatcctcacacgt

SEQ ID NO: 17835 - DNA, 20 bp, Artificial Sequence
  sgRNA
  Dgcr2_9
acagtgttgagggaagcacg

SEQ ID NO: 17836 - DNA, 20 bp, Artificial Sequence
  sgRNA
  Dgcr2_10
actacatctttctgacgacg

SEQ ID NO: 17837 - DNA, 20 bp, Artificial Sequence
  sgRNA
  Dgcr2_11
tgagctgtacctgccatcga

SEQ ID NO: 17838 - DNA, 20 bp, Artificial Sequence
  sgRNA
  Dgcr2_12
tggtccaccggctacgccag

SEQ ID NO: 17839 - DNA, 20 bp, Artificial Sequence
  sgRNA
  Dgcr2_13
gctttgactatggtccagat

SEQ ID NO: 17840 - DNA, 20 bp, Artificial Sequence
  sgRNA
  Dgcr2_14
gaaactgtggatctgcggca

SEQ ID NO: 17841 - DNA, 20 bp, Artificial Sequence
  sgRNA
  Dgcr2_15
ggggtgtcagcagtaccgca

SEQ ID NO: 17842 - DNA, 20 bp, Artificial Sequence
  sgRNA
  Dgcr2_16
gctacagaagcaccgccagg

SEQ ID NO: 17843 - DNA, 20 bp, Artificial Sequence
  sgRNA
  Dgcr2_17
gaccagccagagcggagctt

SEQ ID NO: 17844 - DNA, 20 bp, Artificial Sequence
  sgRNA
  Dgcr2_18
gtggaggtcatggtgcctca

SEQ ID NO: 17845 - DNA, 20 bp, Artificial Sequence
  sgRNA
  Dgcr2_19
cggtgacagtgagaaccagc

SEQ ID NO: 17846 - DNA, 20 bp, Artificial Sequence
  sgRNA
  Dgcr2_20
cgtgacatgcaaactgccca

SEQ ID NO: 17847 - DNA, 20 bp, Artificial Sequence
  sgRNA
  Dirc2_1
gaaacgcacacgctccaccg

SEQ ID NO: 17848 - DNA, 20 bp, Artificial Sequence
  sgRNA
  Dirc2_2
ggcgccgcattcatgacagt

SEQ ID NO: 17849 - DNA, 20 bp, Artificial Sequence
  sgRNA
  Dirc2_3
gccagcggctgagttaccgg

SEQ ID NO: 17850 - DNA, 20 bp, Artificial Sequence
  sgRNA
  Dirc2_4
ggcgcccgtacaccctcccg

SEQ ID NO: 17851 - DNA, 20 bp, Artificial Sequence
  sgRNA
  Dirc2_5
gggctaccctgtcgtccacg

SEQ ID NO: 17852 - DNA, 20 bp, Artificial Sequence
  sgRNA
  Dirc2_6
gtgtcgctgctgcgagccag

SEQ ID NO: 17853 - DNA, 20 bp, Artificial Sequence
  sgRNA
  Dirc2_7
gcatcaatgctgagttacct

SEQ ID NO: 17854 - DNA, 20 bp, Artificial Sequence
  sgRNA
  Dirc2_8
tgttcaggaacactcccagg

SEQ ID NO: 17855 - DNA, 20 bp, Artificial Sequence
  sgRNA
  Dirc2_9
ggtgaaccacgtggacgaca

SEQ ID NO: 17856 - DNA, 20 bp, Artificial Sequence
  sgRNA
  Dirc2_10
gttgggagctggaacaacca

SEQ ID NO: 17857 - DNA, 20 bp, Artificial Sequence
  sgRNA
  Dirc2_11
gggcggaaaataagctagcg

SEQ ID NO: 17858 - DNA, 20 bp, Artificial Sequence
  sgRNA
  Dirc2_12
cgccattcctctctacgacg

SEQ ID NO: 17859 - DNA, 20 bp, Artificial Sequence
  sgRNA
  Dirc2_13
gctactctccgcagcgagaa

SEQ ID NO: 17860 - DNA, 20 bp, Artificial Sequence
  sgRNA
  Dirc2_14
aggtgatcccttctggaacg

SEQ ID NO: 17861 - DNA, 20 bp, Artificial Sequence
  sgRNA
  Dirc2_15
agccacatgaacgcgaagca

SEQ ID NO: 17862 - DNA, 20 bp, Artificial Sequence
  sgRNA
  Dirc2_16
ttagcatacgcaataccact

SEQ ID NO: 17863 - DNA, 20 bp, Artificial Sequence
  sgRNA
  Dirc2_17
gggtagccccagaaaacagg

SEQ ID NO: 17864 - DNA, 20 bp, Artificial Sequence
  sgRNA
  Dirc2_18
ctactctccgcagcgagaag

SEQ ID NO: 17865 - DNA, 20 bp, Artificial Sequence
  sgRNA
  Dirc2_19
tgacagactctaccttgacg

SEQ ID NO: 17866 - DNA, 20 bp, Artificial Sequence
  sgRNA
  Dirc2_20
catgggggacagatactgaa

SEQ ID NO: 17867 - DNA, 20 bp, Artificial Sequence
  sgRNA
  Disp1_1
gagggaccacgataggacag

SEQ ID NO: 17868 - DNA, 20 bp, Artificial Sequence
  sgRNA
  Disp1_2
actcgaagttaaagacgact

SEQ ID NO: 17869 - DNA, 20 bp, Artificial Sequence
  sgRNA
  Disp1_3
gacgtaattcaccaatatgg

SEQ ID NO: 17870 - DNA, 20 bp, Artificial Sequence
  sgRNA
  Disp1_4
ggcgtagtcagccgtctttg

SEQ ID NO: 17871 - DNA, 20 bp, Artificial Sequence
  sgRNA
  Disp1_5
ctacggggtggcgtaccgct

SEQ ID NO: 17872 - DNA, 20 bp, Artificial Sequence
  sgRNA
  Disp1_6
gcagtgcgcagcctgataca

SEQ ID NO: 17873 - DNA, 20 bp, Artificial Sequence
  sgRNA
  Disp1_7
gcgacacgaggccaaagcgg

SEQ ID NO: 17874 - DNA, 20 bp, Artificial Sequence
  sgRNA
  Disp1_8
catcaacgacaccatcaggg

SEQ ID NO: 17875 - DNA, 20 bp, Artificial Sequence
  sgRNA
  Disp1_9
gcgccgtgaggttcataaag

SEQ ID NO: 17876 - DNA, 20 bp, Artificial Sequence
  sgRNA
  Disp1_10
tgtccagattcagagttcgg

SEQ ID NO: 17877 - DNA, 20 bp, Artificial Sequence
  sgRNA
  Disp1_11
ggtgcttcggggtgtacgcg

SEQ ID NO: 17878 - DNA, 20 bp, Artificial Sequence
  sgRNA
  Disp1_12
gtacgccaccccgtagtgga

SEQ ID NO: 17879 - DNA, 20 bp, Artificial Sequence
  sgRNA
  Disp1_13
gctctgtcagaagtgccgca

SEQ ID NO: 17880 - DNA, 20 bp, Artificial Sequence
  sgRNA
  Disp1_14
ccaggatgatgagcgccgtg

SEQ ID NO: 17881 - DNA, 20 bp, Artificial Sequence
  sgRNA
  Disp1_15
tgcgacacgaggccaaagcg

SEQ ID NO: 17882 - DNA, 20 bp, Artificial Sequence
  sgRNA
  Disp1_16
gcagcgggtccgagaagtcg

SEQ ID NO: 17883 - DNA, 20 bp, Artificial Sequence
  sgRNA
  Disp1_17
agttcagcgatctctgccag

SEQ ID NO: 17884 - DNA, 20 bp, Artificial Sequence
  sgRNA
  Disp1_18
atgtggctgcatgcgacacg

SEQ ID NO: 17885 - DNA, 20 bp, Artificial Sequence
  sgRNA
  Disp1_19
tgtagttccagacgtcgcac

SEQ ID NO: 17886 - DNA, 20 bp, Artificial Sequence
  sgRNA
  Disp1_20
acggcaccctcatcgccatg

SEQ ID NO: 17887 - DNA, 20 bp, Artificial Sequence
  sgRNA
  Disp2_1
caagtgtaccggaagcaacg

SEQ ID NO: 17888 - DNA, 20 bp, Artificial Sequence
  sgRNA
  Disp2_2
gcttccactaaacacagcgt

SEQ ID NO: 17889 - DNA, 20 bp, Artificial Sequence
  sgRNA
  Disp2_3
ctacagtacagagtacggcc

SEQ ID NO: 17890 - DNA, 20 bp, Artificial Sequence
  sgRNA
  Disp2_4
cgaaacttaatgacaccaca

SEQ ID NO: 17891 - DNA, 20 bp, Artificial Sequence
  sgRNA
  Disp2_5
ggacaccccatacttgagcg

SEQ ID NO: 17892 - DNA, 20 bp, Artificial Sequence
  sgRNA
  Disp2_6
ttaccatgtggcattccgca

SEQ ID NO: 17893 - DNA, 20 bp, Artificial Sequence
  sgRNA
  Disp2_7
gcacctcctggcctcaacca

SEQ ID NO: 17894 - DNA, 20 bp, Artificial Sequence
  sgRNA
  Disp2_8
tctgcgtcaaagcgttcaaa

SEQ ID NO: 17895 - DNA, 20 bp, Artificial Sequence
  sgRNA
  Disp2_9
gtagcgctcatggagcacca

SEQ ID NO: 17896 - DNA, 20 bp, Artificial Sequence
  sgRNA
  Disp2_10
gcgcctcaagactatcaaga

SEQ ID NO: 17897 - DNA, 20 bp, Artificial Sequence
  sgRNA
  Disp2_11
ggttgccatgagtatcgaag

SEQ ID NO: 17898 - DNA, 20 bp, Artificial Sequence
  sgRNA
  Disp2_12
gaggatctgcctccaaacga

SEQ ID NO: 17899 - DNA, 20 bp, Artificial Sequence
  sgRNA
  Disp2_13
ccaccagcaagctttcccat

SEQ ID NO: 17900 - DNA, 20 bp, Artificial Sequence
  sgRNA
  Disp2_14
atactgctctatcggaagct

SEQ ID NO: 17901 - DNA, 20 bp, Artificial Sequence
  sgRNA
  Disp2_15
gagcctcgagacacagagat

SEQ ID NO: 17902 - DNA, 20 bp, Artificial Sequence
  sgRNA
  Disp2_16
cggacaatcagaattcccct

SEQ ID NO: 17903 - DNA, 20 bp, Artificial Sequence
  sgRNA
  Disp2_17
gctgatctgacgtaaagaga

SEQ ID NO: 17904 - DNA, 20 bp, Artificial Sequence
  sgRNA
  Disp2_18
tgacactacaggtacacgaa

SEQ ID NO: 17905 - DNA, 20 bp, Artificial Sequence
  sgRNA
  Disp2_19
tcatctcggttgacaaccag

SEQ ID NO: 17906 - DNA, 20 bp, Artificial Sequence
  sgRNA
  Disp2_20
cctgtggtgtcattaagttt

SEQ ID NO: 17907 - DNA, 20 bp, Artificial Sequence
  sgRNA
  Dlk1_1
cctaacccatgcgagaacga

SEQ ID NO: 17908 - DNA, 20 bp, Artificial Sequence
  sgRNA
  Dlk1_2
tatttacccattgatcacgc

SEQ ID NO: 17909 - DNA, 20 bp, Artificial Sequence
  sgRNA
  Dlk1_3
cctcgcagaatccatactgg

SEQ ID NO: 17910 - DNA, 20 bp, Artificial Sequence
  sgRNA
  Dlk1_4
cacgtgggacccatgaacgg

SEQ ID NO: 17911 - DNA, 20 bp, Artificial Sequence
  sgRNA
  Dlk1_5
agtggcccgtgccagaacgg

SEQ ID NO: 17912 - DNA, 20 bp, Artificial Sequence
  sgRNA
  Dlk1_6
tggcgcagttgctcaccggg

SEQ ID NO: 17913 - DNA, 20 bp, Artificial Sequence
  sgRNA
  Dlk1_7
gcccgagcaacacatcctga

SEQ ID NO: 17914 - DNA, 20 bp, Artificial Sequence
  sgRNA
  Dlk1_8
gagtacccctctcctcaccg

SEQ ID NO: 17915 - DNA, 20 bp, Artificial Sequence
  sgRNA
  Dlk1_9
taggtgagcccatagccgct

SEQ ID NO: 17916 - DNA, 20 bp, Artificial Sequence
  sgRNA
  Dlk1_10
cacgtgcgcgaagaagcgcg

SEQ ID NO: 17917 - DNA, 20 bp, Artificial Sequence
  sgRNA
  Dlk1_11
agacgccatcgttctcgcat

SEQ ID NO: 17918 - DNA, 20 bp, Artificial Sequence
  sgRNA
  Dlk1_12
cgacaagacctgcagccgcc

SEQ ID NO: 17919 - DNA, 20 bp, Artificial Sequence
  sgRNA
  Dlk1_13
agtacccctctcctcaccga

SEQ ID NO: 17920 - DNA, 20 bp, Artificial Sequence
  sgRNA
  Dlk1_14
gactccattgacacagccag

SEQ ID NO: 17921 - DNA, 20 bp, Artificial Sequence
  sgRNA
  Dlk1_15
gttgcagtataacagcggcg

SEQ ID NO: 17922 - DNA, 20 bp, Artificial Sequence
  sgRNA
  Dlk1_16
gctctttcatggacaccttc

SEQ ID NO: 17923 - DNA, 20 bp, Artificial Sequence
  sgRNA
  Dlk1_17
tggtcatgtcaatcttctcg

SEQ ID NO: 17924 - DNA, 20 bp, Artificial Sequence
  sgRNA
  Dlk1_18
tctcaacaagtgcgaaacct

SEQ ID NO: 17925 - DNA, 20 bp, Artificial Sequence
  sgRNA
  Dlk1_19
gttgagaaagacgatggcca

SEQ ID NO: 17926 - DNA, 20 bp, Artificial Sequence
  sgRNA
  Dlk1_20
gagcaagaggacgcgcagga

SEQ ID NO: 17927 - DNA, 20 bp, Artificial Sequence
  sgRNA
  Dlk2_1
atgtggacgactgtctgatg

SEQ ID NO: 17928 - DNA, 20 bp, Artificial Sequence
  sgRNA
  Dlk2_2
ggccagtgtgtgtatgacgg

SEQ ID NO: 17929 - DNA, 20 bp, Artificial Sequence
  sgRNA
  Dlk2_3
tgaagttgagggcaaaaccc

SEQ ID NO: 17930 - DNA, 20 bp, Artificial Sequence
  sgRNA
  Dlk2_4
tggacgtggctgtgagcgca

SEQ ID NO: 17931 - DNA, 20 bp, Artificial Sequence
  sgRNA
  Dlk2_5
gcagcggcatgtgaagttga

SEQ ID NO: 17932 - DNA, 20 bp, Artificial Sequence
  sgRNA
  Dlk2_6
gcttcccgtgccggaatgga

SEQ ID NO: 17933 - DNA, 20 bp, Artificial Sequence
  sgRNA
  Dlk2_7
ggtacaactacagctgaggt

SEQ ID NO: 17934 - DNA, 20 bp, Artificial Sequence
  sgRNA
  Dlk2_8
ccggaactgaccatgcccag

SEQ ID NO: 17935 - DNA, 20 bp, Artificial Sequence
  sgRNA
  Dlk2_9
ggcacacgagatttaggcag

SEQ ID NO: 17936 - DNA, 20 bp, Artificial Sequence
  sgRNA
  Dlk2_10
tttaggcagcggcagccgct

SEQ ID NO: 17937 - DNA, 20 bp, Artificial Sequence
  sgRNA
  Dlk2_11
ctgccaggcttccatggacg

SEQ ID NO: 17938 - DNA, 20 bp, Artificial Sequence
  sgRNA
  Dlk2_12
tcccactgtgacctggccca

SEQ ID NO: 17939 - DNA, 20 bp, Artificial Sequence
  sgRNA
  Dlk2_13
gagagacccaaacaccacca

SEQ ID NO: 17940 - DNA, 20 bp, Artificial Sequence
  sgRNA
  Dlk2_14
ctgtagttgtacctgccacg

SEQ ID NO: 17941 - DNA, 20 bp, Artificial Sequence
  sgRNA
  Dlk2_15
cacggctgctgcgctcctga

SEQ ID NO: 17942 - DNA, 20 bp, Artificial Sequence
  sgRNA
  Dlk2_16
catgtggcaccattggcgca

SEQ ID NO: 17943 - DNA, 20 bp, Artificial Sequence
  sgRNA
  Dlk2_17
agacacctgtgggatggcac

SEQ ID NO: 17944 - DNA, 20 bp, Artificial Sequence
  sgRNA
  Dlk2_18
acgcttctgcaccatcaacc

SEQ ID NO: 17945 - DNA, 20 bp, Artificial Sequence
  sgRNA
  Dlk2_19
ggctgggaagcggcttgacg

SEQ ID NO: 17946 - DNA, 20 bp, Artificial Sequence
  sgRNA
  Dlk2_20
gtgcctgctgtgcatcctgg

SEQ ID NO: 17947 - DNA, 20 bp, Artificial Sequence
  sgRNA
  Dll1_1
aggtgccatggagacaacct

SEQ ID NO: 17948 - DNA, 20 bp, Artificial Sequence
  sgRNA
  Dll1_2
gcactgccgtaggtgcaggg

SEQ ID NO: 17949 - DNA, 20 bp, Artificial Sequence
  sgRNA
  Dll1_3
cagttggcacctgtataccc

SEQ ID NO: 17950 - DNA, 20 bp, Artificial Sequence
  sgRNA
  Dll1_4
ggtgccaagtgtgtggacct

SEQ ID NO: 17951 - DNA, 20 bp, Artificial Sequence
  sgRNA
  Dll1_5
tggatactgtgacaaaccag

SEQ ID NO: 17952 - DNA, 20 bp, Artificial Sequence
  sgRNA
  Dll1_6
aggagttcgtcaacaagaag

SEQ ID NO: 17953 - DNA, 20 bp, Artificial Sequence
  sgRNA
  Dll1_7
aaccccatccgattcccctt

SEQ ID NO: 17954 - DNA, 20 bp, Artificial Sequence
  sgRNA
  Dll1_8
gaaccgcaactgctgccgcg

SEQ ID NO: 17955 - DNA, 20 bp, Artificial Sequence
  sgRNA
  Dll1_9
tgttcagataaccctgacgg

SEQ ID NO: 17956 - DNA, 20 bp, Artificial Sequence
  sgRNA
  Dll1_10
gctgtgtgtatccctgaccg

SEQ ID NO: 17957 - DNA, 20 bp, Artificial Sequence
  sgRNA
  Dll1_11
gtgtgtgacgagcactacta

SEQ ID NO: 17958 - DNA, 20 bp, Artificial Sequence
  sgRNA
  Dll1_12
gtagcggccgcacagacctc

SEQ ID NO: 17959 - DNA, 20 bp, Artificial Sequence
  sgRNA
  Dll1_13
gtttctgtctctcccccaca

SEQ ID NO: 17960 - DNA, 20 bp, Artificial Sequence
  sgRNA
  Dll1_14
ggatggggttgctgaaggcg

SEQ ID NO: 17961 - DNA, 20 bp, Artificial Sequence
  sgRNA
  Dll1_15
accttgccatagaagccggg

SEQ ID NO: 17962 - DNA, 20 bp, Artificial Sequence
  sgRNA
  Dll1_16
caaaccggtaagagtaccgg

SEQ ID NO: 17963 - DNA, 20 bp, Artificial Sequence
  sgRNA
  Dll1_17
cagcttcagctcaaatacgc

SEQ ID NO: 17964 - DNA, 20 bp, Artificial Sequence
  sgRNA
  Dll1_18
ctttggccacttcacctgcg

SEQ ID NO: 17965 - DNA, 20 bp, Artificial Sequence
  sgRNA
  Dll1_19
tggccaaaggcgtcatcccg

SEQ ID NO: 17966 - DNA, 20 bp, Artificial Sequence
  sgRNA
  Dll1_20
ttgaagccagagaagcccaa

SEQ ID NO: 17967 - DNA, 20 bp, Artificial Sequence
  sgRNA
  Dll3_1
ggtcggccgtagacgcctgg

SEQ ID NO: 17968 - DNA, 20 bp, Artificial Sequence
  sgRNA
  Dll3_2
gcagccatgtcagaatggtg

SEQ ID NO: 17969 - DNA, 20 bp, Artificial Sequence
  sgRNA
  Dll3_3
accggccaagcatcgcggaa

SEQ ID NO: 17970 - DNA, 20 bp, Artificial Sequence
  sgRNA
  Dll3_4
tcccgggccacaccgcgagg

SEQ ID NO: 17971 - DNA, 20 bp, Artificial Sequence
  sgRNA
  Dll3_5
cgaagcccgtagaatccccg

SEQ ID NO: 17972 - DNA, 20 bp, Artificial Sequence
  sgRNA
  Dll3_6
tctccaggtttcaatgacga

SEQ ID NO: 17973 - DNA, 20 bp, Artificial Sequence
  sgRNA
  Dll3_7
gcttcgatgtgaggtgagcg

SEQ ID NO: 17974 - DNA, 20 bp, Artificial Sequence
  sgRNA
  Dll3_8
tgtagctcgaagacaccagc

SEQ ID NO: 17975 - DNA, 20 bp, Artificial Sequence
  sgRNA
  Dll3_9
tgatgaatgccgttgcctgg

SEQ ID NO: 17976 - DNA, 20 bp, Artificial Sequence
  sgRNA
  Dll3_10
tgcacttctcctaccgcgcg

SEQ ID NO: 17977 - DNA, 20 bp, Artificial Sequence
  sgRNA
  Dll3_11
tctccctcgtcattgaaacc

SEQ ID NO: 17978 - DNA, 20 bp, Artificial Sequence
  sgRNA
  Dll3_12
acgtgctagcaggttccagg

SEQ ID NO: 17979 - DNA, 20 bp, Artificial Sequence
  sgRNA
  Dll3_13
gagttcgctgtgcgcccgga

SEQ ID NO: 17980 - DNA, 20 bp, Artificial Sequence
  sgRNA
  Dll3_14
tccaggtcgtgctcgcagcg

SEQ ID NO: 17981 - DNA, 20 bp, Artificial Sequence
  sgRNA
  Dll3_15
tatcctggccaggacctcgg

SEQ ID NO: 17982 - DNA, 20 bp, Artificial Sequence
  sgRNA
  Dll3_16
cgtacgaggccatcaggcag

SEQ ID NO: 17983 - DNA, 20 bp, Artificial Sequence
  sgRNA
  Dll3_17
aggtgggcaatgacagacat

SEQ ID NO: 17984 - DNA, 20 bp, Artificial Sequence
  sgRNA
  Dll3_18
cagtagctgcctgaactcca

SEQ ID NO: 17985 - DNA, 20 bp, Artificial Sequence
  sgRNA
  Dll3_19
tgtgcagcgcacaggcacat

SEQ ID NO: 17986 - DNA, 20 bp, Artificial Sequence
  sgRNA
  Dll3_20
cggatgcactcaacaacctg

SEQ ID NO: 17987 - DNA, 20 bp, Artificial Sequence
  sgRNA
  Dll4_1
aatgaatgtatcccccacaa

SEQ ID NO: 17988 - DNA, 20 bp, Artificial Sequence
  sgRNA
  Dll4_2
caggagttcgtcaaccagcg

SEQ ID NO: 17989 - DNA, 20 bp, Artificial Sequence
  sgRNA
  Dll4_3
gcatagtaccttgacctgcg

SEQ ID NO: 17990 - DNA, 20 bp, Artificial Sequence
  sgRNA
  Dll4_4
ggcactcataatgtccgaag

SEQ ID NO: 17991 - DNA, 20 bp, Artificial Sequence
  sgRNA
  Dll4_5
gttggtgcccaataccggcg

SEQ ID NO: 17992 - DNA, 20 bp, Artificial Sequence
  sgRNA
  Dll4_6
agcccacgggaaactcgcag

SEQ ID NO: 17993 - DNA, 20 bp, Artificial Sequence
  sgRNA
  Dll4_7
attggactacaatctagccc

SEQ ID NO: 17994 - DNA, 20 bp, Artificial Sequence
  sgRNA
  Dll4_8
cagctgccaccatttcgaca

SEQ ID NO: 17995 - DNA, 20 bp, Artificial Sequence
  sgRNA
  Dll4_9
ccagcgagacagctacccag

SEQ ID NO: 17996 - DNA, 20 bp, Artificial Sequence
  sgRNA
  Dll4_10
cctaagctcttgtcactgtg

SEQ ID NO: 17997 - DNA, 20 bp, Artificial Sequence
  sgRNA
  Dll4_11
attcttgtccctgacgacga

SEQ ID NO: 17998 - DNA, 20 bp, Artificial Sequence
  sgRNA
  Dll4_12
gttagagccggtaaagttgg

SEQ ID NO: 17999 - DNA, 20 bp, Artificial Sequence
  sgRNA
  Dll4_13
agcgcggtatgctggccaat

SEQ ID NO: 18000 - DNA, 20 bp, Artificial Sequence
  sgRNA
  Dll4_14
agccgctgcgagtttcccgt

SEQ ID NO: 18001 - DNA, 20 bp, Artificial Sequence
  sgRNA
  Dll4_15
cattatgagtgccagccaga

SEQ ID NO: 18002 - DNA, 20 bp, Artificial Sequence
  sgRNA
  Dll4_16
gaggcccgatgacgagagca

SEQ ID NO: 18003 - DNA, 20 bp, Artificial Sequence
  sgRNA
  Dll4_17
ctgtgaatccaggccggcag

SEQ ID NO: 18004 - DNA, 20 bp, Artificial Sequence
  sgRNA
  Dll4_18
gatcaacgtgttccaacagt

SEQ ID NO: 18005 - DNA, 20 bp, Artificial Sequence
  sgRNA
  Dll4_19
catccaagcttggcacacac

SEQ ID NO: 18006 - DNA, 20 bp, Artificial Sequence
  sgRNA
  Dll4_20
gtagctgtctcgctgggcgt

SEQ ID NO: 18007 - DNA, 20 bp, Artificial Sequence
  sgRNA
  Dner_1
aacactctaagtcatttgag

SEQ ID NO: 18008 - DNA, 20 bp, Artificial Sequence
  sgRNA
  Dner_2
cattcccacaggcaacatca

SEQ ID NO: 18009 - DNA, 20 bp, Artificial Sequence
  sgRNA
  Dner_3
gaacaatggcacttgctacg

SEQ ID NO: 18010 - DNA, 20 bp, Artificial Sequence
  sgRNA
  Dner_4
cacacttcgaccatctatga

SEQ ID NO: 18011 - DNA, 20 bp, Artificial Sequence
  sgRNA
  Dner_5
gcaatgccatcgcatccatc

SEQ ID NO: 18012 - DNA, 20 bp, Artificial Sequence
  sgRNA
  Dner_6
agagcctcaccaacatgcct

SEQ ID NO: 18013 - DNA, 20 bp, Artificial Sequence
  sgRNA
  Dner_7
tcttggtcggtcaccgaacg

SEQ ID NO: 18014 - DNA, 20 bp, Artificial Sequence
  sgRNA
  Dner_8
atcagccgcatcgagtacca

SEQ ID NO: 18015 - DNA, 20 bp, Artificial Sequence
  sgRNA
  Dner_9
actgtaatcctcgtaggcaa

SEQ ID NO: 18016 - DNA, 20 bp, Artificial Sequence
  sgRNA
  Dner_10
atgatgtagagggagtgccg

SEQ ID NO: 18017 - DNA, 20 bp, Artificial Sequence
  sgRNA
  Dner_11
gattatgtcaggctcctggg

SEQ ID NO: 18018 - DNA, 20 bp, Artificial Sequence
  sgRNA
  Dner_12
gctgcagcccaggcttcaca

SEQ ID NO: 18019 - DNA, 20 bp, Artificial Sequence
  sgRNA
  Dner_13
tgaactcactgtcaatgctg

SEQ ID NO: 18020 - DNA, 20 bp, Artificial Sequence
  sgRNA
  Dner_14
gcacgtgcatctgtgcaccc

SEQ ID NO: 18021 - DNA, 20 bp, Artificial Sequence
  sgRNA
  Dner_15
gaggtacctgtgacagcgag

SEQ ID NO: 18022 - DNA, 20 bp, Artificial Sequence
  sgRNA
  Dner_16
aggctagcaactgtgttccg

SEQ ID NO: 18023 - DNA, 20 bp, Artificial Sequence
  sgRNA
  Dner_17
tttgctcccacccagccatg

SEQ ID NO: 18024 - DNA, 20 bp, Artificial Sequence
  sgRNA
  Dner_18
gccatgagcacacggactga

SEQ ID NO: 18025 - DNA, 20 bp, Artificial Sequence
  sgRNA
  Dner_19
cagtcccgatgacaaaccct

SEQ ID NO: 18026 - DNA, 20 bp, Artificial Sequence
  sgRNA
  Dner_20
agacagctgatgttagcaca

SEQ ID NO: 18027 - DNA, 20 bp, Artificial Sequence
  sgRNA
  Dpep1_1
tcacccgtcgatgaccggtg

SEQ ID NO: 18028 - DNA, 20 bp, Artificial Sequence
  sgRNA
  Dpep1_2
gacaactggcttgtggacag

SEQ ID NO: 18029 - DNA, 20 bp, Artificial Sequence
  sgRNA
  Dpep1_3
agtggccagtctgatcggcg

SEQ ID NO: 18030 - DNA, 20 bp, Artificial Sequence
  sgRNA
  Dpep1_4
atgtatgcggaccagaactg

SEQ ID NO: 18031 - DNA, 20 bp, Artificial Sequence
  sgRNA
  Dpep1_5
ggtcaatcatgacacccaag

SEQ ID NO: 18032 - DNA, 20 bp, Artificial Sequence
  sgRNA
  Dpep1_6
catcctacaggctttccgga

SEQ ID NO: 18033 - DNA, 20 bp, Artificial Sequence
  sgRNA
  Dpep1_7
ggctatcatgagaaccacac

SEQ ID NO: 18034 - DNA, 20 bp, Artificial Sequence
  sgRNA
  Dpep1_8
gtagccatagtatgtcctgc

SEQ ID NO: 18035 - DNA, 20 bp, Artificial Sequence
  sgRNA
  Dpep1_9
agaaccacaccggtcatcga

SEQ ID NO: 18036 - DNA, 20 bp, Artificial Sequence
  sgRNA
  Dpep1_10
ccacctggaccacatcaaga

SEQ ID NO: 18037 - DNA, 20 bp, Artificial Sequence
  sgRNA
  Dpep1_11
gaaacatcctccagtcccac

SEQ ID NO: 18038 - DNA, 20 bp, Artificial Sequence
  sgRNA
  Dpep1_12
cctggaccacatcaagaagg

SEQ ID NO: 18039 - DNA, 20 bp, Artificial Sequence
  sgRNA
  Dpep1_13
agtctgatcggcgtggaagg

SEQ ID NO: 18040 - DNA, 20 bp, Artificial Sequence
  sgRNA
  Dpep1_14
ggacgctttgcagatctcca

SEQ ID NO: 18041 - DNA, 20 bp, Artificial Sequence
  sgRNA
  Dpep1_15
acatcctacaggctttccgg

SEQ ID NO: 18042 - DNA, 20 bp, Artificial Sequence
  sgRNA
  Dpep1_16
cgtgttgcaattgtgggtga

SEQ ID NO: 18043 - DNA, 20 bp, Artificial Sequence
  sgRNA
  Dpep1_17
gctgaacgagatgaaccgct

SEQ ID NO: 18044 - DNA, 20 bp, Artificial Sequence
  sgRNA
  Dpep1_18
gctagctgacaacctgattc

SEQ ID NO: 18045 - DNA, 20 bp, Artificial Sequence
  sgRNA
  Dpep1_19
gaatgagtccgaagcacaga

SEQ ID NO: 18046 - DNA, 20 bp, Artificial Sequence
  sgRNA
  Dpep1_20
ctgcaaagcgtccttcatgg

SEQ ID NO: 18047 - DNA, 20 bp, Artificial Sequence
  sgRNA
  Dpep2_1
caagcacccaatgacccttg

SEQ ID NO: 18048 - DNA, 20 bp, Artificial Sequence
  sgRNA
  Dpep2_2
agaaacttcgaagcacagcg

SEQ ID NO: 18049 - DNA, 20 bp, Artificial Sequence
  sgRNA
  Dpep2_3
ttacgtaccatgccagacgc

SEQ ID NO: 18050 - DNA, 20 bp, Artificial Sequence
  sgRNA
  Dpep2_4
aggagttcccgcttatagat

SEQ ID NO: 18051 - DNA, 20 bp, Artificial Sequence
  sgRNA
  Dpep2_5
ataaggtcgcaacaatggcg

SEQ ID NO: 18052 - DNA, 20 bp, Artificial Sequence
  sgRNA
  Dpep2_6
gatattctggagtctccggt

SEQ ID NO: 18053 - DNA, 20 bp, Artificial Sequence
  sgRNA
  Dpep2_7
ggatacttccaaggcccgcc

SEQ ID NO: 18054 - DNA, 20 bp, Artificial Sequence
  sgRNA
  Dpep2_8
tccgagttcatcggaattgg

SEQ ID NO: 18055 - DNA, 20 bp, Artificial Sequence
  sgRNA
  Dpep2_9
atgtcgctcacgggcctcaa

SEQ ID NO: 18056 - DNA, 20 bp, Artificial Sequence
  sgRNA
  Dpep2_10
ggtttcctcgaaggatgcct

SEQ ID NO: 18057 - DNA, 20 bp, Artificial Sequence
  sgRNA
  Dpep2_11
ctgctccagagtgagacgca

SEQ ID NO: 18058 - DNA, 20 bp, Artificial Sequence
  sgRNA
  Dpep2_12
cctggaagacatgatcccag

SEQ ID NO: 18059 - DNA, 20 bp, Artificial Sequence
  sgRNA
  Dpep2_13
gtcatcggatccgagttcat

SEQ ID NO: 18060 - DNA, 20 bp, Artificial Sequence
  sgRNA
  Dpep2_14
tgacctcagttaaagttaag

SEQ ID NO: 18061 - DNA, 20 bp, Artificial Sequence
  sgRNA
  Dpep2_15
caggagttcccgcttataga

SEQ ID NO: 18062 - DNA, 20 bp, Artificial Sequence
  sgRNA
  Dpep2_16
gtagaatgcgtggacaccct

SEQ ID NO: 18063 - DNA, 20 bp, Artificial Sequence
  sgRNA
  Dpep2_17
tgacactgctgtagaatgcg

SEQ ID NO: 18064 - DNA, 20 bp, Artificial Sequence
  sgRNA
  Dpep2_18
gcatccagaaaagaaccaac

SEQ ID NO: 18065 - DNA, 20 bp, Artificial Sequence
  sgRNA
  Dpep2_19
tttctcccactccgctgcca

SEQ ID NO: 18066 - DNA, 20 bp, Artificial Sequence
  sgRNA
  Dpep2_20
ggctgcagcatccgagacgt

SEQ ID NO: 18067 - DNA, 20 bp, Artificial Sequence
  sgRNA
  Dpep3_1
aatctgcgcaatttcacccg

SEQ ID NO: 18068 - DNA, 20 bp, Artificial Sequence
  sgRNA
  Dpep3_2
tgatggtgacactatccatg

SEQ ID NO: 18069 - DNA, 20 bp, Artificial Sequence
  sgRNA
  Dpep3_3
agtctatcatcatgcccaga

SEQ ID NO: 18070 - DNA, 20 bp, Artificial Sequence
  sgRNA
  Dpep3_4
catacgcacccatccacaag

SEQ ID NO: 18071 - DNA, 20 bp, Artificial Sequence
  sgRNA
  Dpep3_5
gcgtggaccctcaagacccg

SEQ ID NO: 18072 - DNA, 20 bp, Artificial Sequence
  sgRNA
  Dpep3_6
gtgcttgctctcgaaggcga

SEQ ID NO: 18073 - DNA, 20 bp, Artificial Sequence
  sgRNA
  Dpep3_7
gctatgttgctctggccaca

SEQ ID NO: 18074 - DNA, 20 bp, Artificial Sequence
  sgRNA
  Dpep3_8
ggatcggtggaagctatgac

SEQ ID NO: 18075 - DNA, 20 bp, Artificial Sequence
  sgRNA
  Dpep3_9
tgtgatcttctcacactcgg

SEQ ID NO: 18076 - DNA, 20 bp, Artificial Sequence
  sgRNA
  Dpep3_10
ccttcacctgcagcacaccg

SEQ ID NO: 18077 - DNA, 20 bp, Artificial Sequence
  sgRNA
  Dpep3_11
gccgagtgtgagaagatcac

SEQ ID NO: 18078 - DNA, 20 bp, Artificial Sequence
  sgRNA
  Dpep3_12
agaaactgcgcaacacagcg

SEQ ID NO: 18079 - DNA, 20 bp, Artificial Sequence
  sgRNA
  Dpep3_13
cgtggaccctcaagacccgc

SEQ ID NO: 18080 - DNA, 20 bp, Artificial Sequence
  sgRNA
  Dpep3_14
gtagccatgaggcctggcaa

SEQ ID NO: 18081 - DNA, 20 bp, Artificial Sequence
  sgRNA
  Dpep3_15
gatgtaggctgaccagaact

SEQ ID NO: 18082 - DNA, 20 bp, Artificial Sequence
  sgRNA
  Dpep3_16
tctgagttcattgggatcgg

SEQ ID NO: 18083 - DNA, 20 bp, Artificial Sequence
  sgRNA
  Dpep3_17
atacatcctccagtccctga

SEQ ID NO: 18084 - DNA, 20 bp, Artificial Sequence
  sgRNA
  Dpep3_18
ctggaaacttgacctccaca

SEQ ID NO: 18085 - DNA, 20 bp, Artificial Sequence
  sgRNA
  Dpep3_19
atttctacaccaacattagt

SEQ ID NO: 18086 - DNA, 20 bp, Artificial Sequence
  sgRNA
  Dpep3_20
ctccagtgctccgacaacac

SEQ ID NO: 18087 - DNA, 20 bp, Artificial Sequence
  sgRNA
  Dpp10_1
tacagtgctccagtaaaccg

SEQ ID NO: 18088 - DNA, 20 bp, Artificial Sequence
  sgRNA
  Dpp10_2
gagaacatactttaaatctg

SEQ ID NO: 18089 - DNA, 20 bp, Artificial Sequence
  sgRNA
  Dpp10_3
agaaacaagactgtcactag

SEQ ID NO: 18090 - DNA, 20 bp, Artificial Sequence
  sgRNA
  Dpp10_4
tggtagattcacagagtgtg

SEQ ID NO: 18091 - DNA, 20 bp, Artificial Sequence
  sgRNA
  Dpp10_5
gctttctctgaacggtacct

SEQ ID NO: 18092 - DNA, 20 bp, Artificial Sequence
  sgRNA
  Dpp10_6
cttgatttaaaaatgtcggg

SEQ ID NO: 18093 - DNA, 20 bp, Artificial Sequence
  sgRNA
  Dpp10_7
ataccaccaagatcaccagc

SEQ ID NO: 18094 - DNA, 20 bp, Artificial Sequence
  sgRNA
  Dpp10_8
aaagcagtacccatacccca

SEQ ID NO: 18095 - DNA, 20 bp, Artificial Sequence
  sgRNA
  Dpp10_9
ggagcagcaacccaccccag

SEQ ID NO: 18096 - DNA, 20 bp, Artificial Sequence
  sgRNA
  Dpp10_10
actctgtgaatctaccaccg

SEQ ID NO: 18097 - DNA, 20 bp, Artificial Sequence
  sgRNA
  Dpp10_11
tgcctaacatgatcatacct

SEQ ID NO: 18098 - DNA, 20 bp, Artificial Sequence
  sgRNA
  Dpp10_12
ttaaatgggtgagcaacacg

SEQ ID NO: 18099 - DNA, 20 bp, Artificial Sequence
  sgRNA
  Dpp10_13
attctcatatcgcccactgg

SEQ ID NO: 18100 - DNA, 20 bp, Artificial Sequence
  sgRNA
  Dpp10_14
gtatggaccaactcatactt

SEQ ID NO: 18101 - DNA, 20 bp, Artificial Sequence
  sgRNA
  Dpp10_15
acactctgtgaatctaccac

SEQ ID NO: 18102 - DNA, 20 bp, Artificial Sequence
  sgRNA
  Dpp10_16
gttgctcacccatttaacca

SEQ ID NO: 18103 - DNA, 20 bp, Artificial Sequence
  sgRNA
  Dpp10_17
gtatgggtactgctttgctt

SEQ ID NO: 18104 - DNA, 20 bp, Artificial Sequence
  sgRNA
  Dpp10_18
ggaccaggaacatagctatg

SEQ ID NO: 18105 - DNA, 20 bp, Artificial Sequence
  sgRNA
  Dpp10_19
cctctctgcccgcttcccca

SEQ ID NO: 18106 - DNA, 20 bp, Artificial Sequence
  sgRNA
  Dpp10_20
gtaccgttcagagaaagctg

SEQ ID NO: 18107 - DNA, 20 bp, Artificial Sequence
  sgRNA
  Dpp4_1
ctacgatgtagagtgtagag

SEQ ID NO: 18108 - DNA, 20 bp, Artificial Sequence
  sgRNA
  Dpp4_2
cttggaatacaactacgtga

SEQ ID NO: 18109 - DNA, 20 bp, Artificial Sequence
  sgRNA
  Dpp4_3
gtcgatgtgatcctatgact

SEQ ID NO: 18110 - DNA, 20 bp, Artificial Sequence
  sgRNA
  Dpp4_4
tagaaggagtattcaatgag

SEQ ID NO: 18111 - DNA, 20 bp, Artificial Sequence
  sgRNA
  Dpp4_5
gtgtacacagagcgttacat

SEQ ID NO: 18112 - DNA, 20 bp, Artificial Sequence
  sgRNA
  Dpp4_6
gctcagcagaactattggca

SEQ ID NO: 18113 - DNA, 20 bp, Artificial Sequence
  sgRNA
  Dpp4_7
ctacactctacatcgtagca

SEQ ID NO: 18114 - DNA, 20 bp, Artificial Sequence
  sgRNA
  Dpp4_8
attccaagagaacaaacagt

SEQ ID NO: 18115 - DNA, 20 bp, Artificial Sequence
  sgRNA
  Dpp4_9
gttcaagtgcggaatagctg

SEQ ID NO: 18116 - DNA, 20 bp, Artificial Sequence
  sgRNA
  Dpp4_10
gctacgatgtagagtgtaga

SEQ ID NO: 18117 - DNA, 20 bp, Artificial Sequence
  sgRNA
  Dpp4_11
agtgtggattccatacccaa

SEQ ID NO: 18118 - DNA, 20 bp, Artificial Sequence
  sgRNA
  Dpp4_12
ctgtgctgctagcgatcccg

SEQ ID NO: 18119 - DNA, 20 bp, Artificial Sequence
  sgRNA
  Dpp4_13
agagtaggacttgacccgaa

SEQ ID NO: 18120 - DNA, 20 bp, Artificial Sequence
  sgRNA
  Dpp4_14
gtacctccttattcatggaa

SEQ ID NO: 18121 - DNA, 20 bp, Artificial Sequence
  sgRNA
  Dpp4_15
tgtggcacctgtgtcacggt

SEQ ID NO: 18122 - DNA, 20 bp, Artificial Sequence
  sgRNA
  Dpp4_16
tgcggtatcatttagtaaag

SEQ ID NO: 18123 - DNA, 20 bp, Artificial Sequence
  sgRNA
  Dpp4_17
atagcaagcgagttgcaatt

SEQ ID NO: 18124 - DNA, 20 bp, Artificial Sequence
  sgRNA
  Dpp4_18
ctgccgttccatgaataagg

SEQ ID NO: 18125 - DNA, 20 bp, Artificial Sequence
  sgRNA
  Dpp4_19
ggatcactatttatgtgatg

SEQ ID NO: 18126 - DNA, 20 bp, Artificial Sequence
  sgRNA
  Dpp4_20
tagtactcccaccgtgacac

SEQ ID NO: 18127 - DNA, 20 bp, Artificial Sequence
  sgRNA
  Dpp6_1
gtgaccaccaatgagcgatg

SEQ ID NO: 18128 - DNA, 20 bp, Artificial Sequence
  sgRNA
  Dpp6_2
gcggagcgactgtgacgagg

SEQ ID NO: 18129 - DNA, 20 bp, Artificial Sequence
  sgRNA
  Dpp6_3
tttgccttctattaacaccg

SEQ ID NO: 18130 - DNA, 20 bp, Artificial Sequence
  sgRNA
  Dpp6_4
ggtgttatgcacagtaacag

SEQ ID NO: 18131 - DNA, 20 bp, Artificial Sequence
  sgRNA
  Dpp6_5
gccgtcacacttgaccacca

SEQ ID NO: 18132 - DNA, 20 bp, Artificial Sequence
  sgRNA
  Dpp6_6
tggggagtaatcctccacag

SEQ ID NO: 18133 - DNA, 20 bp, Artificial Sequence
  sgRNA
  Dpp6_7
ggtcctccagtgctgacact

SEQ ID NO: 18134 - DNA, 20 bp, Artificial Sequence
  sgRNA
  Dpp6_8
cagtaacagtgggtacgcca

SEQ ID NO: 18135 - DNA, 20 bp, Artificial Sequence
  sgRNA
  Dpp6_9
ttgcgttgctgacttctggt

SEQ ID NO: 18136 - DNA, 20 bp, Artificial Sequence
  sgRNA
  Dpp6_10
ctgtagagatgtcgtctccg

SEQ ID NO: 18137 - DNA, 20 bp, Artificial Sequence
  sgRNA
  Dpp6_11
gccgcctccgtacttcctgt

SEQ ID NO: 18138 - DNA, 20 bp, Artificial Sequence
  sgRNA
  Dpp6_12
gcgcgaggtgttgatcttgc

SEQ ID NO: 18139 - DNA, 20 bp, Artificial Sequence
  sgRNA
  Dpp6_13
atagtggtagggcttcacag

SEQ ID NO: 18140 - DNA, 20 bp, Artificial Sequence
  sgRNA
  Dpp6_14
caattcgagtggtctctaca

SEQ ID NO: 18141 - DNA, 20 bp, Artificial Sequence
  sgRNA
  Dpp6_15
acttacatcctcccagccaa

SEQ ID NO: 18142 - DNA, 20 bp, Artificial Sequence
  sgRNA
  Dpp6_16
gctggtggcccatttcacca

SEQ ID NO: 18143 - DNA, 20 bp, Artificial Sequence
  sgRNA
  Dpp6_17
acttgaccaccacggctcca

SEQ ID NO: 18144 - DNA, 20 bp, Artificial Sequence
  sgRNA
  Dpp6_18
gtataccaacactcccacac

SEQ ID NO: 18145 - DNA, 20 bp, Artificial Sequence
  sgRNA
  Dpp6_19
ctcatcacgcagctgatcaa

SEQ ID NO: 18146 - DNA, 20 bp, Artificial Sequence
  sgRNA
  Dpp6_20
agctcctacaggaagtacgg

SEQ ID NO: 18147 - DNA, 20 bp, Artificial Sequence
  sgRNA
  Drd1_1
aggatgacaactgtgacacg

SEQ ID NO: 18148 - DNA, 20 bp, Artificial Sequence
  sgRNA
  Drd1_2
tcatcaggtttcgacacctg

SEQ ID NO: 18149 - DNA, 20 bp, Artificial Sequence
  sgRNA
  Drd1_3
agtgcagctaagctggcaca

SEQ ID NO: 18150 - DNA, 20 bp, Artificial Sequence
  sgRNA
  Drd1_4
taacctctgtgtgatcagcg

SEQ ID NO: 18151 - DNA, 20 bp, Artificial Sequence
  sgRNA
  Drd1_5
ggtgtaagtgacgatcataa

SEQ ID NO: 18152 - DNA, 20 bp, Artificial Sequence
  sgRNA
  Drd1_6
tgacgatcataatggctacg

SEQ ID NO: 18153 - DNA, 20 bp, Artificial Sequence
  sgRNA
  Drd1_7
ctgattgagagcattcgaca

SEQ ID NO: 18154 - DNA, 20 bp, Artificial Sequence
  sgRNA
  Drd1_8
tacttccctggaagatgccg

SEQ ID NO: 18155 - DNA, 20 bp, Artificial Sequence
  sgRNA
  Drd1_9
tctgattgagagcattcgac

SEQ ID NO: 18156 - DNA, 20 bp, Artificial Sequence
  sgRNA
  Drd1_10
gagtctatagcatcctaaga

SEQ ID NO: 18157 - DNA, 20 bp, Artificial Sequence
  sgRNA
  Drd1_11
tgtaagcatcaacaacaacg

SEQ ID NO: 18158 - DNA, 20 bp, Artificial Sequence
  sgRNA
  Drd1_12
gtgtcgaaacctgatgacag

SEQ ID NO: 18159 - DNA, 20 bp, Artificial Sequence
  sgRNA
  Drd1_13
gaggttaaggatggatgccg

SEQ ID NO: 18160 - DNA, 20 bp, Artificial Sequence
  sgRNA
  Drd1_14
ctatggcattattcgttgta

SEQ ID NO: 18161 - DNA, 20 bp, Artificial Sequence
  sgRNA
  Drd1_15
gatcacacagaggttaagga

SEQ ID NO: 18162 - DNA, 20 bp, Artificial Sequence
  sgRNA
  Drd1_16
tgtccacgctgatcacacag

SEQ ID NO: 18163 - DNA, 20 bp, Artificial Sequence
  sgRNA
  Drd1_17
tcatcctgattagcgtagca

SEQ ID NO: 18164 - DNA, 20 bp, Artificial Sequence
  sgRNA
  Drd1_18
tctccaaagctgagatgcgc

SEQ ID NO: 18165 - DNA, 20 bp, Artificial Sequence
  sgRNA
  Drd1_19
gtctcctcagagccacagaa

SEQ ID NO: 18166 - DNA, 20 bp, Artificial Sequence
  sgRNA
  Drd1_20
ccaatatgaccgataaggcc

SEQ ID NO: 18167 - DNA, 20 bp, Artificial Sequence
  sgRNA
  Drd2_1
tggcgatcatgacagtaact

SEQ ID NO: 18168 - DNA, 20 bp, Artificial Sequence
  sgRNA
  Drd2_2
tacctccagatagacgaccc

SEQ ID NO: 18169 - DNA, 20 bp, Artificial Sequence
  sgRNA
  Drd2_3
atggcatagtagttgtagtg

SEQ ID NO: 18170 - DNA, 20 bp, Artificial Sequence
  sgRNA
  Drd2_4
tgacccgcttccgacgcttg

SEQ ID NO: 18171 - DNA, 20 bp, Artificial Sequence
  sgRNA
  Drd2_5
acatcgttctccgcaagcgt

SEQ ID NO: 18172 - DNA, 20 bp, Artificial Sequence
  sgRNA
  Drd2_6
ttcccttcggacccattgaa

SEQ ID NO: 18173 - DNA, 20 bp, Artificial Sequence
  sgRNA
  Drd2_7
acctccagatagacgaccca

SEQ ID NO: 18174 - DNA, 20 bp, Artificial Sequence
  sgRNA
  Drd2_8
aggagtagaccacgaaggca

SEQ ID NO: 18175 - DNA, 20 bp, Artificial Sequence
  sgRNA
  Drd2_9
ggcccttcaatgggtccgaa

SEQ ID NO: 18176 - DNA, 20 bp, Artificial Sequence
  sgRNA
  Drd2_10
gcggctcatcgtcttaaggg

SEQ ID NO: 18177 - DNA, 20 bp, Artificial Sequence
  sgRNA
  Drd2_11
cttcaacattgagttccgca

SEQ ID NO: 18178 - DNA, 20 bp, Artificial Sequence
  sgRNA
  Drd2_12
cagggttgctatgtagaccg

SEQ ID NO: 18179 - DNA, 20 bp, Artificial Sequence
  sgRNA
  Drd2_13
ggtacgatgatgatctggag

SEQ ID NO: 18180 - DNA, 20 bp, Artificial Sequence
  sgRNA
  Drd2_14
ccatgcccaatggcaaaacc

SEQ ID NO: 18181 - DNA, 20 bp, Artificial Sequence
  sgRNA
  Drd2_15
tcgtaccaggacaggttcag

SEQ ID NO: 18182 - DNA, 20 bp, Artificial Sequence
  sgRNA
  Drd2_16
ccagaagatcggccacagcg

SEQ ID NO: 18183 - DNA, 20 bp, Artificial Sequence
  sgRNA
  Drd2_17
tgttgagtccaaagagcagt

SEQ ID NO: 18184 - DNA, 20 bp, Artificial Sequence
  sgRNA
  Drd2_18
tgtgtgccatcagcatcgac

SEQ ID NO: 18185 - DNA, 20 bp, Artificial Sequence
  sgRNA
  Drd2_19
tagcgtgtgttatacaacat

SEQ ID NO: 18186 - DNA, 20 bp, Artificial Sequence
  sgRNA
  Drd2_20
gttgctatgtagaccgtggt

SEQ ID NO: 18187 - DNA, 20 bp, Artificial Sequence
  sgRNA
  Drd3_1
tgtacacatcatgacatcca

SEQ ID NO: 18188 - DNA, 20 bp, Artificial Sequence
  sgRNA
  Drd3_2
gcagagctcctgtcgacgtg

SEQ ID NO: 18189 - DNA, 20 bp, Artificial Sequence
  sgRNA
  Drd3_3
actggctgttctgtcgagtg

SEQ ID NO: 18190 - DNA, 20 bp, Artificial Sequence
  sgRNA
  Drd3_4
gacagggcgtagtaggcatg

SEQ ID NO: 18191 - DNA, 20 bp, Artificial Sequence
  sgRNA
  Drd3_5
tctcgaagtggtactccccg

SEQ ID NO: 18192 - DNA, 20 bp, Artificial Sequence
  sgRNA
  Drd3_6
ccttattgaaaactgccgaa

SEQ ID NO: 18193 - DNA, 20 bp, Artificial Sequence
  sgRNA
  Drd3_7
gaccaccaccaactacctag

SEQ ID NO: 18194 - DNA, 20 bp, Artificial Sequence
  sgRNA
  Drd3_8
agaacgtgagtcaagaagaa

SEQ ID NO: 18195 - DNA, 20 bp, Artificial Sequence
  sgRNA
  Drd3_9
tctgtgccatcagcatagac

SEQ ID NO: 18196 - DNA, 20 bp, Artificial Sequence
  sgRNA
  Drd3_10
aatgggatgcagccgcagac

SEQ ID NO: 18197 - DNA, 20 bp, Artificial Sequence
  sgRNA
  Drd3_11
gtctgcggctgcatcccatt

SEQ ID NO: 18198 - DNA, 20 bp, Artificial Sequence
  sgRNA
  Drd3_12
ccacagccaggctcaccact

SEQ ID NO: 18199 - DNA, 20 bp, Artificial Sequence
  sgRNA
  Drd3_13
tgtggggcagaaaactccac

SEQ ID NO: 18200 - DNA, 20 bp, Artificial Sequence
  sgRNA
  Drd3_14
cgaacctctaagctgagctt

SEQ ID NO: 18201 - DNA, 20 bp, Artificial Sequence
  sgRNA
  Drd3_15
ttatccacatccctgaagct

SEQ ID NO: 18202 - DNA, 20 bp, Artificial Sequence
  sgRNA
  Drd3_16
accaggacagtcaccccaaa

SEQ ID NO: 18203 - DNA, 20 bp, Artificial Sequence
  sgRNA
  Drd3_17
acgtcgacaggagctctgcc

SEQ ID NO: 18204 - DNA, 20 bp, Artificial Sequence
  sgRNA
  Drd3_18
tgttgaaaccaaagaggaga

SEQ ID NO: 18205 - DNA, 20 bp, Artificial Sequence
  sgRNA
  Drd3_19
gaggttcgaaaactcagcaa

SEQ ID NO: 18206 - DNA, 20 bp, Artificial Sequence
  sgRNA
  Drd3_20
gcatccaaacttcgaaggag

SEQ ID NO: 18207 - DNA, 20 bp, Artificial Sequence
  sgRNA
  Drd4_1
cactggcgaagccaccgcgg

SEQ ID NO: 18208 - DNA, 20 bp, Artificial Sequence
  sgRNA
  Drd4_2
ccctgagtagggtccgacac

SEQ ID NO: 18209 - DNA, 20 bp, Artificial Sequence
  sgRNA
  Drd4_3
acgagtagaccacatagtct

SEQ ID NO: 18210 - DNA, 20 bp, Artificial Sequence
  sgRNA
  Drd4_4
ggcgtgggccagaatccctg

SEQ ID NO: 18211 - DNA, 20 bp, Artificial Sequence
  sgRNA
  Drd4_5
gagtagggtccgacaccggc

SEQ ID NO: 18212 - DNA, 20 bp, Artificial Sequence
  sgRNA
  Drd4_6
gcagcgctactgaggacggt

SEQ ID NO: 18213 - DNA, 20 bp, Artificial Sequence
  sgRNA
  Drd4_7
gaggcagcaccagcaccgcg

SEQ ID NO: 18214 - DNA, 20 bp, Artificial Sequence
  sgRNA
  Drd4_8
tcgaaactccgcgttgaaga

SEQ ID NO: 18215 - DNA, 20 bp, Artificial Sequence
  sgRNA
  Drd4_9
tgctgctcatcgccgccacg

SEQ ID NO: 18216 - DNA, 20 bp, Artificial Sequence
  sgRNA
  Drd4_10
catcagcgagcagacacccg

SEQ ID NO: 18217 - DNA, 20 bp, Artificial Sequence
  sgRNA
  Drd4_11
gcctctctttgtctactccg

SEQ ID NO: 18218 - DNA, 20 bp, Artificial Sequence
  sgRNA
  Drd4_12
cttcgtggtgcacatcacgc

SEQ ID NO: 18219 - DNA, 20 bp, Artificial Sequence
  sgRNA
  Drd4_13
gccgctgcgctacaaccagc

SEQ ID NO: 18220 - DNA, 20 bp, Artificial Sequence
  sgRNA
  Drd4_14
tcttcgtggtgcacatcacg

SEQ ID NO: 18221 - DNA, 20 bp, Artificial Sequence
  sgRNA
  Drd4_15
gtgacggcactgaccaggcg

SEQ ID NO: 18222 - DNA, 20 bp, Artificial Sequence
  sgRNA
  Drd4_16
gctcacgatgaagtagttgg

SEQ ID NO: 18223 - DNA, 20 bp, Artificial Sequence
  sgRNA
  Drd4_17
catctacaccatcttcaacg

SEQ ID NO: 18224 - DNA, 20 bp, Artificial Sequence
  sgRNA
  Drd4_18
caaggcaatgagagtcctgc

SEQ ID NO: 18225 - DNA, 20 bp, Artificial Sequence
  sgRNA
  Drd4_19
gctgctcatcggcttggtgt

SEQ ID NO: 18226 - DNA, 20 bp, Artificial Sequence
  sgRNA
  Drd4_20
tgagcgtgtcacagagacgg

SEQ ID NO: 18227 - DNA, 20 bp, Artificial Sequence
  sgRNA
  Drd5_1
aatgcggtagatgcgcgtgt

SEQ ID NO: 18228 - DNA, 20 bp, Artificial Sequence
  sgRNA
  Drd5_2
gaatctgtgtatcatcagcg

SEQ ID NO: 18229 - DNA, 20 bp, Artificial Sequence
  sgRNA
  Drd5_3
tgtgccaattgagttggacc

SEQ ID NO: 18230 - DNA, 20 bp, Artificial Sequence
  sgRNA
  Drd5_4
tcagagttgccggagccgtg

SEQ ID NO: 18231 - DNA, 20 bp, Artificial Sequence
  sgRNA
  Drd5_5
atagaagctgatgagcgacg

SEQ ID NO: 18232 - DNA, 20 bp, Artificial Sequence
  sgRNA
  Drd5_6
tgatgtttaccgtctgcacg

SEQ ID NO: 18233 - DNA, 20 bp, Artificial Sequence
  sgRNA
  Drd5_7
gggtcatcttgcgctcgtag

SEQ ID NO: 18234 - DNA, 20 bp, Artificial Sequence
  sgRNA
  Drd5_8
ctttaatgcagacttccgga

SEQ ID NO: 18235 - DNA, 20 bp, Artificial Sequence
  sgRNA
  Drd5_9
ggtcatgccttggaaggccg

SEQ ID NO: 18236 - DNA, 20 bp, Artificial Sequence
  sgRNA
  Drd5_10
gcgcatctaccgcattgcac

SEQ ID NO: 18237 - DNA, 20 bp, Artificial Sequence
  sgRNA
  Drd5_11
atggcaccgcacatcgggcg

SEQ ID NO: 18238 - DNA, 20 bp, Artificial Sequence
  sgRNA
  Drd5_12
gcatctccactgctgcagaa

SEQ ID NO: 18239 - DNA, 20 bp, Artificial Sequence
  sgRNA
  Drd5_13
gcggtgccattgcgcccagg

SEQ ID NO: 18240 - DNA, 20 bp, Artificial Sequence
  sgRNA
  Drd5_14
tatttcctacaaccaagaca

SEQ ID NO: 18241 - DNA, 20 bp, Artificial Sequence
  sgRNA
  Drd5_15
ccgtatctcctccctagaaa

SEQ ID NO: 18242 - DNA, 20 bp, Artificial Sequence
  sgRNA
  Drd5_16
gatgtttaccgtctgcacgg

SEQ ID NO: 18243 - DNA, 20 bp, Artificial Sequence
  sgRNA
  Drd5_17
aggtggtctcgctgacacaa

SEQ ID NO: 18244 - DNA, 20 bp, Artificial Sequence
  sgRNA
  Drd5_18
ccaccttcgacatattcgtc

SEQ ID NO: 18245 - DNA, 20 bp, Artificial Sequence
  sgRNA
  Drd5_19
tgtccacatgatcccaaatg

SEQ ID NO: 18246 - DNA, 20 bp, Artificial Sequence
  sgRNA
  Drd5_20
atacagttcaggatgaagaa

SEQ ID NO: 18247 - DNA, 20 bp, Artificial Sequence
  sgRNA
  Dsc1_1
caaccgcagtaagagaagat

SEQ ID NO: 18248 - DNA, 20 bp, Artificial Sequence
  sgRNA
  Dsc1_2
gatggaggtacgagacatgg

SEQ ID NO: 18249 - DNA, 20 bp, Artificial Sequence
  sgRNA
  Dsc1_3
gtataccgccttcgagtggg

SEQ ID NO: 18250 - DNA, 20 bp, Artificial Sequence
  sgRNA
  Dsc1_4
tcgggtacaatagatgtccc

SEQ ID NO: 18251 - DNA, 20 bp, Artificial Sequence
  sgRNA
  Dsc1_5
tcttcaaccttaaacagcag

SEQ ID NO: 18252 - DNA, 20 bp, Artificial Sequence
  sgRNA
  Dsc1_6
gagcaaagatggactgccag

SEQ ID NO: 18253 - DNA, 20 bp, Artificial Sequence
  sgRNA
  Dsc1_7
cttagagaaggtgctccctg

SEQ ID NO: 18254 - DNA, 20 bp, Artificial Sequence
  sgRNA
  Dsc1_8
gtggacccagagacaagcag

SEQ ID NO: 18255 - DNA, 20 bp, Artificial Sequence
  sgRNA
  Dsc1_9
tgtataccgccttcgagtgg

SEQ ID NO: 18256 - DNA, 20 bp, Artificial Sequence
  sgRNA
  Dsc1_10
ttgaccatctgagagcaaga

SEQ ID NO: 18257 - DNA, 20 bp, Artificial Sequence
  sgRNA
  Dsc1_11
tcttgctctcagatggtcaa

SEQ ID NO: 18258 - DNA, 20 bp, Artificial Sequence
  sgRNA
  Dsc1_12
ttgtgtataccgccttcgag

SEQ ID NO: 18259 - DNA, 20 bp, Artificial Sequence
  sgRNA
  Dsc1_13
gttgtggtgcacattgttgg

SEQ ID NO: 18260 - DNA, 20 bp, Artificial Sequence
  sgRNA
  Dsc1_14
cctgtggtgaacagaccaaa

SEQ ID NO: 18261 - DNA, 20 bp, Artificial Sequence
  sgRNA
  Dsc1_15
gtttcagccttaagatgaga

SEQ ID NO: 18262 - DNA, 20 bp, Artificial Sequence
  sgRNA
  Dsc1_16
ggcggtatacacaatcctaa

SEQ ID NO: 18263 - DNA, 20 bp, Artificial Sequence
  sgRNA
  Dsc1_17
ccgatcttgcacaggaacac

SEQ ID NO: 18264 - DNA, 20 bp, Artificial Sequence
  sgRNA
  Dsc1_18
tctggcccatctaaatctat

SEQ ID NO: 18265 - DNA, 20 bp, Artificial Sequence
  sgRNA
  Dsc1_19
gccgtcttctagaattctga

SEQ ID NO: 18266 - DNA, 20 bp, Artificial Sequence
  sgRNA
  Dsc1_20
cgggaacttcaaaatcacaa

SEQ ID NO: 18267 - DNA, 20 bp, Artificial Sequence
  sgRNA
  Dsc2_1
tggtgtgatcactaccacgt

SEQ ID NO: 18268 - DNA, 20 bp, Artificial Sequence
  sgRNA
  Dsc2_2
gcattggagggatacactcg

SEQ ID NO: 18269 - DNA, 20 bp, Artificial Sequence
  sgRNA
  Dsc2_3
tcttacctgcatctaacgca

SEQ ID NO: 18270 - DNA, 20 bp, Artificial Sequence
  sgRNA
  Dsc2_4
tcatctcacttacctctact

SEQ ID NO: 18271 - DNA, 20 bp, Artificial Sequence
  sgRNA
  Dsc2_5
cagcctctcgatccaacgct

SEQ ID NO: 18272 - DNA, 20 bp, Artificial Sequence
  sgRNA
  Dsc2_6
ctatgcccaacagtatagca

SEQ ID NO: 18273 - DNA, 20 bp, Artificial Sequence
  sgRNA
  Dsc2_7
agtaaagcttctttgccccg

SEQ ID NO: 18274 - DNA, 20 bp, Artificial Sequence
  sgRNA
  Dsc2_8
tgccgttcttcatagtccag

SEQ ID NO: 18275 - DNA, 20 bp, Artificial Sequence
  sgRNA
  Dsc2_9
attcatacccaagcagacag

SEQ ID NO: 18276 - DNA, 20 bp, Artificial Sequence
  sgRNA
  Dsc2_10
gcatttgcaacaactccaga

SEQ ID NO: 18277 - DNA, 20 bp, Artificial Sequence
  sgRNA
  Dsc2_11
tttccgagcgttggatcgag

SEQ ID NO: 18278 - DNA, 20 bp, Artificial Sequence
  sgRNA
  Dsc2_12
ggaactggagtcaaaagtgg

SEQ ID NO: 18279 - DNA, 20 bp, Artificial Sequence
  sgRNA
  Dsc2_13
gtagtgatcacaccagtgct

SEQ ID NO: 18280 - DNA, 20 bp, Artificial Sequence
  sgRNA
  Dsc2_14
tctcggcaggtagttcagag

SEQ ID NO: 18281 - DNA, 20 bp, Artificial Sequence
  sgRNA
  Dsc2_15
ggtgtcccaggccgaaggca

SEQ ID NO: 18282 - DNA, 20 bp, Artificial Sequence
  sgRNA
  Dsc2_16
gagatatctgtccatttaga

SEQ ID NO: 18283 - DNA, 20 bp, Artificial Sequence
  sgRNA
  Dsc2_17
tctgtccagctgagccgacg

SEQ ID NO: 18284 - DNA, 20 bp, Artificial Sequence
  sgRNA
  Dsc2_18
agtctgtctgtaactcgaat

SEQ ID NO: 18285 - DNA, 20 bp, Artificial Sequence
  sgRNA
  Dsc2_19
attaactactccaatttgca

SEQ ID NO: 18286 - DNA, 20 bp, Artificial Sequence
  sgRNA
  Dsc2_20
gcagacagtggtgatatgca

SEQ ID NO: 18287 - DNA, 20 bp, Artificial Sequence
  sgRNA
  Dsc3_1
aacacttgcagtgaacatcg

SEQ ID NO: 18288 - DNA, 20 bp, Artificial Sequence
  sgRNA
  Dsc3_2
agcccccagagcaatatgtg

SEQ ID NO: 18289 - DNA, 20 bp, Artificial Sequence
  sgRNA
  Dsc3_3
gacaatacaacagctctggt

SEQ ID NO: 18290 - DNA, 20 bp, Artificial Sequence
  sgRNA
  Dsc3_4
gtcaggctcatctttatccg

SEQ ID NO: 18291 - DNA, 20 bp, Artificial Sequence
  sgRNA
  Dsc3_5
cagcaacctacagagccggc

SEQ ID NO: 18292 - DNA, 20 bp, Artificial Sequence
  sgRNA
  Dsc3_6
catgtactgtaaccatagcc

SEQ ID NO: 18293 - DNA, 20 bp, Artificial Sequence
  sgRNA
  Dsc3_7
tatggtgatgcccggccaca

SEQ ID NO: 18294 - DNA, 20 bp, Artificial Sequence
  sgRNA
  Dsc3_8
tttgctgcgctaaatcttca

SEQ ID NO: 18295 - DNA, 20 bp, Artificial Sequence
  sgRNA
  Dsc3_9
gaccttggactcctgccgtg

SEQ ID NO: 18296 - DNA, 20 bp, Artificial Sequence
  sgRNA
  Dsc3_10
tcatgtaccttcaacactag

SEQ ID NO: 18297 - DNA, 20 bp, Artificial Sequence
  sgRNA
  Dsc3_11
tcatattcctcacgatccac

SEQ ID NO: 18298 - DNA, 20 bp, Artificial Sequence
  sgRNA
  Dsc3_12
ctagaggcagacaagatcat

SEQ ID NO: 18299 - DNA, 20 bp, Artificial Sequence
  sgRNA
  Dsc3_13
tatcaaataccgaagcacct

SEQ ID NO: 18300 - DNA, 20 bp, Artificial Sequence
  sgRNA
  Dsc3_14
tgctgaatagccatctgcag

SEQ ID NO: 18301 - DNA, 20 bp, Artificial Sequence
  sgRNA
  Dsc3_15
gatcctgatgaacctatcca

SEQ ID NO: 18302 - DNA, 20 bp, Artificial Sequence
  sgRNA
  Dsc3_16
acatgattaacactgccaac

SEQ ID NO: 18303 - DNA, 20 bp, Artificial Sequence
  sgRNA
  Dsc3_17
cctgtcctatcagaaaactg

SEQ ID NO: 18304 - DNA, 20 bp, Artificial Sequence
  sgRNA
  Dsc3_18
gggtgcacagaaaaaagccc

SEQ ID NO: 18305 - DNA, 20 bp, Artificial Sequence
  sgRNA
  Dsc3_19
gaaggcagagggtctccggc

SEQ ID NO: 18306 - DNA, 20 bp, Artificial Sequence
  sgRNA
  Dsc3_20
actgcagcaacctacagagc

SEQ ID NO: 18307 - DNA, 20 bp, Artificial Sequence
  sgRNA
  Dscam_1
aatacggatagccaattacg

SEQ ID NO: 18308 - DNA, 20 bp, Artificial Sequence
  sgRNA
  Dscam_2
acttacgtttcacgtacagg

SEQ ID NO: 18309 - DNA, 20 bp, Artificial Sequence
  sgRNA
  Dscam_3
tgttgtcaatggttactccg

SEQ ID NO: 18310 - DNA, 20 bp, Artificial Sequence
  sgRNA
  Dscam_4
ggagccctatacagtccgtg

SEQ ID NO: 18311 - DNA, 20 bp, Artificial Sequence
  sgRNA
  Dscam_5
gccaaatgatcacgtccgag

SEQ ID NO: 18312 - DNA, 20 bp, Artificial Sequence
  sgRNA
  Dscam_6
catctgcagttcataccacg

SEQ ID NO: 18313 - DNA, 20 bp, Artificial Sequence
  sgRNA
  Dscam_7
tctttgatctcaatctcggg

SEQ ID NO: 18314 - DNA, 20 bp, Artificial Sequence
  sgRNA
  Dscam_8
tcggaccctgaaacgcccca

SEQ ID NO: 18315 - DNA, 20 bp, Artificial Sequence
  sgRNA
  Dscam_9
tcaaccctggaaaaaacgtg

SEQ ID NO: 18316 - DNA, 20 bp, Artificial Sequence
  sgRNA
  Dscam_10
gtagctgaccacgttcccct

SEQ ID NO: 18317 - DNA, 20 bp, Artificial Sequence
  sgRNA
  Dscam_11
ctaccgggagtacagcacgg

SEQ ID NO: 18318 - DNA, 20 bp, Artificial Sequence
  sgRNA
  Dscam_12
gatccattataaggtttgcg

SEQ ID NO: 18319 - DNA, 20 bp, Artificial Sequence
  sgRNA
  Dscam_13
gcatcggagacatccacgag

SEQ ID NO: 18320 - DNA, 20 bp, Artificial Sequence
  sgRNA
  Dscam_14
gcatcaataccacccgagtg

SEQ ID NO: 18321 - DNA, 20 bp, Artificial Sequence
  sgRNA
  Dscam_15
gcttcctttcaaccaccgcc

SEQ ID NO: 18322 - DNA, 20 bp, Artificial Sequence
  sgRNA
  Dscam_16
ccatgctatcaattcatacg

SEQ ID NO: 18323 - DNA, 20 bp, Artificial Sequence
  sgRNA
  Dscam_17
cacctgcattgcgagaaacg

SEQ ID NO: 18324 - DNA, 20 bp, Artificial Sequence
  sgRNA
  Dscam_18
aagggctgacaaccaacgaa

SEQ ID NO: 18325 - DNA, 20 bp, Artificial Sequence
  sgRNA
  Dscam_19
gcacggatcctcacgttcag

SEQ ID NO: 18326 - DNA, 20 bp, Artificial Sequence
  sgRNA
  Dscam_20
agcatcggagacatccacga

SEQ ID NO: 18327 - DNA, 20 bp, Artificial Sequence
  sgRNA
  Dscaml1_1
gaagttcgctcagtacggcg

SEQ ID NO: 18328 - DNA, 20 bp, Artificial Sequence
  sgRNA
  Dscaml1_2
aaggtcaatgcgtggcaacg

SEQ ID NO: 18329 - DNA, 20 bp, Artificial Sequence
  sgRNA
  Dscaml1_3
gcggattggcatgtcccccg

SEQ ID NO: 18330 - DNA, 20 bp, Artificial Sequence
  sgRNA
  Dscaml1_4
caggacgtggcgtatcagca

SEQ ID NO: 18331 - DNA, 20 bp, Artificial Sequence
  sgRNA
  Dscaml1_5
cctttgatcctccacccgga

SEQ ID NO: 18332 - DNA, 20 bp, Artificial Sequence
  sgRNA
  Dscaml1_6
gctgcccgataaccaccgcc

SEQ ID NO: 18333 - DNA, 20 bp, Artificial Sequence
  sgRNA
  Dscaml1_7
ggaaccctacaccgtccggg

SEQ ID NO: 18334 - DNA, 20 bp, Artificial Sequence
  sgRNA
  Dscaml1_8
gctgggctaagcgcattaca

SEQ ID NO: 18335 - DNA, 20 bp, Artificial Sequence
  sgRNA
  Dscaml1_9
ctgaaggatgagacgatgcg

SEQ ID NO: 18336 - DNA, 20 bp, Artificial Sequence
  sgRNA
  Dscaml1_10
tgtgttgcggtaccaacgga

SEQ ID NO: 18337 - DNA, 20 bp, Artificial Sequence
  sgRNA
  Dscaml1_11
gcggcccatcataatccgct

SEQ ID NO: 18338 - DNA, 20 bp, Artificial Sequence
  sgRNA
  Dscaml1_12
catactgtcagcgttctcgt

SEQ ID NO: 18339 - DNA, 20 bp, Artificial Sequence
  sgRNA
  Dscaml1_13
ggaatgtcgatgtggagccg

SEQ ID NO: 18340 - DNA, 20 bp, Artificial Sequence
  sgRNA
  Dscaml1_14
cagaacttcgagaggctacg

SEQ ID NO: 18341 - DNA, 20 bp, Artificial Sequence
  sgRNA
  Dscaml1_15
gcaccgggtgatattgctgg

SEQ ID NO: 18342 - DNA, 20 bp, Artificial Sequence
  sgRNA
  Dscaml1_16
gcccgataaccaccgccagg

SEQ ID NO: 18343 - DNA, 20 bp, Artificial Sequence
  sgRNA
  Dscaml1_17
gcgcatcagcgagatcatcg

SEQ ID NO: 18344 - DNA, 20 bp, Artificial Sequence
  sgRNA
  Dscaml1_18
gcatgcttccacatcacctt

SEQ ID NO: 18345 - DNA, 20 bp, Artificial Sequence
  sgRNA
  Dscaml1_19
gaacccccagcaatatcacc

SEQ ID NO: 18346 - DNA, 20 bp, Artificial Sequence
  sgRNA
  Dscaml1_20
gggagtcatttacaaagtag

SEQ ID NO: 18347 - DNA, 20 bp, Artificial Sequence
  sgRNA
  Dsg1a_1
aacgttgtctccatagagag

SEQ ID NO: 18348 - DNA, 20 bp, Artificial Sequence
  sgRNA
  Dsg1a_2
gtaactggttcagaaagtgg

SEQ ID NO: 18349 - DNA, 20 bp, Artificial Sequence
  sgRNA
  Dsg1a_3
aatggaagcaaatcacagag

SEQ ID NO: 18350 - DNA, 20 bp, Artificial Sequence
  sgRNA
  Dsg1a_4
gacttagcacttacttcatg

SEQ ID NO: 18351 - DNA, 20 bp, Artificial Sequence
  sgRNA
  Dsg1a_5
ctaacactaaccctttccaa

SEQ ID NO: 18352 - DNA, 20 bp, Artificial Sequence
  sgRNA
  Dsg1a_6
taacactaaccctttccaag

SEQ ID NO: 18353 - DNA, 20 bp, Artificial Sequence
  sgRNA
  Dsg1a_7
gacgcgttgtgggttctcag

SEQ ID NO: 18354 - DNA, 20 bp, Artificial Sequence
  sgRNA
  Dsg1a_8
aggcactgccggattagggg

SEQ ID NO: 18355 - DNA, 20 bp, Artificial Sequence
  sgRNA
  Dsg1a_9
tctggcactgggctgaacat

SEQ ID NO: 18356 - DNA, 20 bp, Artificial Sequence
  sgRNA
  Dsg1a_10
gggtttcatcaggatcccct

SEQ ID NO: 18357 - DNA, 20 bp, Artificial Sequence
  sgRNA
  Dsg1a_11
ttagagatacctgacttaag

SEQ ID NO: 18358 - DNA, 20 bp, Artificial Sequence
  sgRNA
  Dsg1a_12
gctgtactccaggtccagag

SEQ ID NO: 18359 - DNA, 20 bp, Artificial Sequence
  sgRNA
  Dsg1a_13
acaacgcgtcacaggatcat

SEQ ID NO: 18360 - DNA, 20 bp, Artificial Sequence
  sgRNA
  Dsg1a_14
ttcgacttcgagccatgctg

SEQ ID NO: 18361 - DNA, 20 bp, Artificial Sequence
  sgRNA
  Dsg1a_15
gaacgttgtctccatagaga

SEQ ID NO: 18362 - DNA, 20 bp, Artificial Sequence
  sgRNA
  Dsg1a_16
tcgaatcacaaagtacaata

SEQ ID NO: 18363 - DNA, 20 bp, Artificial Sequence
  sgRNA
  Dsg1a_17
ctacatttgaggtctcttga

SEQ ID NO: 18364 - DNA, 20 bp, Artificial Sequence
  sgRNA
  Dsg1a_18
gcaggcactgccggattagg

SEQ ID NO: 18365 - DNA, 20 bp, Artificial Sequence
  sgRNA
  Dsg1a_19
tgaacgttgtctccatagag

SEQ ID NO: 18366 - DNA, 20 bp, Artificial Sequence
  sgRNA
  Dsg1a_20
caacgcgtcacaggatcatg

SEQ ID NO: 18367 - DNA, 20 bp, Artificial Sequence
  sgRNA
  Dsg1b_1
gagttaacaacactcccggt

SEQ ID NO: 18368 - DNA, 20 bp, Artificial Sequence
  sgRNA
  Dsg1b_2
gacttagcacttacatcgtg

SEQ ID NO: 18369 - DNA, 20 bp, Artificial Sequence
  sgRNA
  Dsg1b_3
actgtgttaaatgtcatcga

SEQ ID NO: 18370 - DNA, 20 bp, Artificial Sequence
  sgRNA
  Dsg1b_4
ggagcttagagtcagagtga

SEQ ID NO: 18371 - DNA, 20 bp, Artificial Sequence
  sgRNA
  Dsg1b_5
ggtggatatccactacccag

SEQ ID NO: 18372 - DNA, 20 bp, Artificial Sequence
  sgRNA
  Dsg1b_6
gtaccaggttcagatggtgg

SEQ ID NO: 18373 - DNA, 20 bp, Artificial Sequence
  sgRNA
  Dsg1b_7
ggagtcacttcaagtggtgg

SEQ ID NO: 18374 - DNA, 20 bp, Artificial Sequence
  sgRNA
  Dsg1b_8
aggtggatatccactaccca

SEQ ID NO: 18375 - DNA, 20 bp, Artificial Sequence
  sgRNA
  Dsg1b_9
ccactttcatgataaccagc

SEQ ID NO: 18376 - DNA, 20 bp, Artificial Sequence
  sgRNA
  Dsg1b_10
ttgtcttctgtgatgtcaaa

SEQ ID NO: 18377 - DNA, 20 bp, Artificial Sequence
  sgRNA
  Dsg1b_11
gcaacgcgtcacaggatcag

SEQ ID NO: 18378 - DNA, 20 bp, Artificial Sequence
  sgRNA
  Dsg1b_12
agaggatcaggaattggcaa

SEQ ID NO: 18379 - DNA, 20 bp, Artificial Sequence
  sgRNA
  Dsg1b_13
agatgcggtatgttactggt

SEQ ID NO: 18380 - DNA, 20 bp, Artificial Sequence
  sgRNA
  Dsg1b_14
gatggtggtggcagttccag

SEQ ID NO: 18381 - DNA, 20 bp, Artificial Sequence
  sgRNA
  Dsg1b_15
gctggcactgggctgaatat

SEQ ID NO: 18382 - DNA, 20 bp, Artificial Sequence
  sgRNA
  Dsg1b_16
tcaagtggcactccatcaga

SEQ ID NO: 18383 - DNA, 20 bp, Artificial Sequence
  sgRNA
  Dsg1b_17
gcaaaggatgctgtactcca

SEQ ID NO: 18384 - DNA, 20 bp, Artificial Sequence
  sgRNA
  Dsg1b_18
ttcacacgtgggccatagaa

SEQ ID NO: 18385 - DNA, 20 bp, Artificial Sequence
  sgRNA
  Dsg1b_19
ccaccacatttgaagcctgc

SEQ ID NO: 18386 - DNA, 20 bp, Artificial Sequence
  sgRNA
  Dsg1b_20
gcaaatcagcaccagggacg

SEQ ID NO: 18387 - DNA, 20 bp, Artificial Sequence
  sgRNA
  Dsg1c_1
aatggaagcaaatcacacag

SEQ ID NO: 18388 - DNA, 20 bp, Artificial Sequence
  sgRNA
  Dsg1c_2
tagagtcacaggtttctcag

SEQ ID NO: 18389 - DNA, 20 bp, Artificial Sequence
  sgRNA
  Dsg1c_3
ttagcacttacaccaggctg

SEQ ID NO: 18390 - DNA, 20 bp, Artificial Sequence
  sgRNA
  Dsg1c_4
ttcacggcttcataatctag

SEQ ID NO: 18391 - DNA, 20 bp, Artificial Sequence
  sgRNA
  Dsg1c_5
agaggatcaggaattagcat

SEQ ID NO: 18392 - DNA, 20 bp, Artificial Sequence
  sgRNA
  Dsg1c_6
gcataggatgctgtactcca

SEQ ID NO: 18393 - DNA, 20 bp, Artificial Sequence
  sgRNA
  Dsg1c_7
ggaggaggagaacgaaccac

SEQ ID NO: 18394 - DNA, 20 bp, Artificial Sequence
  sgRNA
  Dsg1c_8
gatctcctgtgattgtggag

SEQ ID NO: 18395 - DNA, 20 bp, Artificial Sequence
  sgRNA
  Dsg1c_9
tgatctcctgtgattgtgga

SEQ ID NO: 18396 - DNA, 20 bp, Artificial Sequence
  sgRNA
  Dsg1c_10
actgtgttaaatgttgtcaa

SEQ ID NO: 18397 - DNA, 20 bp, Artificial Sequence
  sgRNA
  Dsg1c_11
gctatggtaatatcactgtg

SEQ ID NO: 18398 - DNA, 20 bp, Artificial Sequence
  sgRNA
  Dsg1c_12
ggagtgatggatagagtcac

SEQ ID NO: 18399 - DNA, 20 bp, Artificial Sequence
  sgRNA
  Dsg1c_13
ccctgtgcaggtcctctgaa

SEQ ID NO: 18400 - DNA, 20 bp, Artificial Sequence
  sgRNA
  Dsg1c_14
ccagcaagcttcaaatgtgg

SEQ ID NO: 18401 - DNA, 20 bp, Artificial Sequence
  sgRNA
  Dsg1c_15
gaattgggtaaacttgagcc

SEQ ID NO: 18402 - DNA, 20 bp, Artificial Sequence
  sgRNA
  Dsg1c_16
ctatggtaatatcactgtga

SEQ ID NO: 18403 - DNA, 20 bp, Artificial Sequence
  sgRNA
  Dsg1c_17
ttagctacagactgtgaaac

SEQ ID NO: 18404 - DNA, 20 bp, Artificial Sequence
  sgRNA
  Dsg1c_18
gcaagttgctccatatgctg

SEQ ID NO: 18405 - DNA, 20 bp, Artificial Sequence
  sgRNA
  Dsg1c_19
ggtttctcagtggatgttgt

SEQ ID NO: 18406 - DNA, 20 bp, Artificial Sequence
  sgRNA
  Dsg1c_20
catatggagcaacttgctag

SEQ ID NO: 18407 - DNA, 20 bp, Artificial Sequence
  sgRNA
  Dsg2_1
gtcttcaacagtgataacga

SEQ ID NO: 18408 - DNA, 20 bp, Artificial Sequence
  sgRNA
  Dsg2_2
tctgtgtgtcagtctcaatg

SEQ ID NO: 18409 - DNA, 20 bp, Artificial Sequence
  sgRNA
  Dsg2_3
gaagtggaaaataacgcacc

SEQ ID NO: 18410 - DNA, 20 bp, Artificial Sequence
  sgRNA
  Dsg2_4
tcaaagacgaatatgccgaa

SEQ ID NO: 18411 - DNA, 20 bp, Artificial Sequence
  sgRNA
  Dsg2_5
cagcagctattccttgacgg

SEQ ID NO: 18412 - DNA, 20 bp, Artificial Sequence
  sgRNA
  Dsg2_6
gcacagtatgacaactacgt

SEQ ID NO: 18413 - DNA, 20 bp, Artificial Sequence
  sgRNA
  Dsg2_7
ccgtaaggacaagagccacg

SEQ ID NO: 18414 - DNA, 20 bp, Artificial Sequence
  sgRNA
  Dsg2_8
ggaattacagaaccgccttt

SEQ ID NO: 18415 - DNA, 20 bp, Artificial Sequence
  sgRNA
  Dsg2_9
gtcgtcttccccattgtagg

SEQ ID NO: 18416 - DNA, 20 bp, Artificial Sequence
  sgRNA
  Dsg2_10
tcacttggttcgtcaaaaga

SEQ ID NO: 18417 - DNA, 20 bp, Artificial Sequence
  sgRNA
  Dsg2_11
cgagtgatccagcctaatgg

SEQ ID NO: 18418 - DNA, 20 bp, Artificial Sequence
  sgRNA
  Dsg2_12
tggctgtcggaaatgaggaa

SEQ ID NO: 18419 - DNA, 20 bp, Artificial Sequence
  sgRNA
  Dsg2_13
catgtctctggaagaccccg

SEQ ID NO: 18420 - DNA, 20 bp, Artificial Sequence
  sgRNA
  Dsg2_14
cgtttactctcaggaagaca

SEQ ID NO: 18421 - DNA, 20 bp, Artificial Sequence
  sgRNA
  Dsg2_15
gccgtgatggaggtttcact

SEQ ID NO: 18422 - DNA, 20 bp, Artificial Sequence
  sgRNA
  Dsg2_16
tgatcggccaccagaagcga

SEQ ID NO: 18423 - DNA, 20 bp, Artificial Sequence
  sgRNA
  Dsg2_17
ctacctaaataaagacacgg

SEQ ID NO: 18424 - DNA, 20 bp, Artificial Sequence
  sgRNA
  Dsg2_18
tcgctgccaacgaagccgta

SEQ ID NO: 18425 - DNA, 20 bp, Artificial Sequence
  sgRNA
  Dsg2_19
gctcagcttccgttaccaaa

SEQ ID NO: 18426 - DNA, 20 bp, Artificial Sequence
  sgRNA
  Dsg2_20
gtatgcgagtgtctgaaggg

SEQ ID NO: 18427 - DNA, 20 bp, Artificial Sequence
  sgRNA
  Dsg3_1
aagacgaaacccaattgcca

SEQ ID NO: 18428 - DNA, 20 bp, Artificial Sequence
  sgRNA
  Dsg3_2
ctggacaggggtaaatacac

SEQ ID NO: 18429 - DNA, 20 bp, Artificial Sequence
  sgRNA
  Dsg3_3
gacataccaagctactgatg

SEQ ID NO: 18430 - DNA, 20 bp, Artificial Sequence
  sgRNA
  Dsg3_4
gtgagcggtgcagacaacga

SEQ ID NO: 18431 - DNA, 20 bp, Artificial Sequence
  sgRNA
  Dsg3_5
gaaatcactcgcctatgccg

SEQ ID NO: 18432 - DNA, 20 bp, Artificial Sequence
  sgRNA
  Dsg3_6
gctccattggttgtaactgg

SEQ ID NO: 18433 - DNA, 20 bp, Artificial Sequence
  sgRNA
  Dsg3_7
ggtttcctcacgatcaacta

SEQ ID NO: 18434 - DNA, 20 bp, Artificial Sequence
  sgRNA
  Dsg3_8
tagtgcctccagcagtatag

SEQ ID NO: 18435 - DNA, 20 bp, Artificial Sequence
  sgRNA
  Dsg3_9
tggtttgtgaaaatattgga

SEQ ID NO: 18436 - DNA, 20 bp, Artificial Sequence
  sgRNA
  Dsg3_10
acaacaaagatcccaaaggg

SEQ ID NO: 18437 - DNA, 20 bp, Artificial Sequence
  sgRNA
  Dsg3_11
gttcctccagttacaaccaa

SEQ ID NO: 18438 - DNA, 20 bp, Artificial Sequence
  sgRNA
  Dsg3_12
gtatgagcctcgcagttctg

SEQ ID NO: 18439 - DNA, 20 bp, Artificial Sequence
  sgRNA
  Dsg3_13
cattgttcctgaataaccca

SEQ ID NO: 18440 - DNA, 20 bp, Artificial Sequence
  sgRNA
  Dsg3_14
gatctacgatgatgaaggcg

SEQ ID NO: 18441 - DNA, 20 bp, Artificial Sequence
  sgRNA
  Dsg3_15
agtagttcccaagctgtaga

SEQ ID NO: 18442 - DNA, 20 bp, Artificial Sequence
  sgRNA
  Dsg3_16
gtaagcactaacaaattagt

SEQ ID NO: 18443 - DNA, 20 bp, Artificial Sequence
  sgRNA
  Dsg3_17
ggcatttaggatcattacca

SEQ ID NO: 18444 - DNA, 20 bp, Artificial Sequence
  sgRNA
  Dsg3_18
tcttctcgaggacaactgac

SEQ ID NO: 18445 - DNA, 20 bp, Artificial Sequence
  sgRNA
  Dsg3_19
ctgcaccgctcacaaccaga

SEQ ID NO: 18446 - DNA, 20 bp, Artificial Sequence
  sgRNA
  Dsg3_20
gcaacatcaggagtcctagc

SEQ ID NO: 18447 - DNA, 20 bp, Artificial Sequence
  sgRNA
  Dsg4_1
ggagttaggcagtcaaacgt

SEQ ID NO: 18448 - DNA, 20 bp, Artificial Sequence
  sgRNA
  Dsg4_2
atgacatttagtctacgagg

SEQ ID NO: 18449 - DNA, 20 bp, Artificial Sequence
  sgRNA
  Dsg4_3
aatgacgggacagtaatcgt

SEQ ID NO: 18450 - DNA, 20 bp, Artificial Sequence
  sgRNA
  Dsg4_4
ttgatggtgaacactccgta

SEQ ID NO: 18451 - DNA, 20 bp, Artificial Sequence
  sgRNA
  Dsg4_5
tgcccatgtcaggtatacca

SEQ ID NO: 18452 - DNA, 20 bp, Artificial Sequence
  sgRNA
  Dsg4_6
aagtaattaggccccagcag

SEQ ID NO: 18453 - DNA, 20 bp, Artificial Sequence
  sgRNA
  Dsg4_7
gagtgttcaccatcaaccct

SEQ ID NO: 18454 - DNA, 20 bp, Artificial Sequence
  sgRNA
  Dsg4_8
ggttgtgactgtccttcacg

SEQ ID NO: 18455 - DNA, 20 bp, Artificial Sequence
  sgRNA
  Dsg4_9
ataggaccagtgatgagcgg

SEQ ID NO: 18456 - DNA, 20 bp, Artificial Sequence
  sgRNA
  Dsg4_10
gatcctgacagacgaagcat

SEQ ID NO: 18457 - DNA, 20 bp, Artificial Sequence
  sgRNA
  Dsg4_11
tattgatttctccagtccga

SEQ ID NO: 18458 - DNA, 20 bp, Artificial Sequence
  sgRNA
  Dsg4_12
gtttcggtcacgactacgtt

SEQ ID NO: 18459 - DNA, 20 bp, Artificial Sequence
  sgRNA
  Dsg4_13
tgtataggaccagtgatgag

SEQ ID NO: 18460 - DNA, 20 bp, Artificial Sequence
  sgRNA
  Dsg4_14
agtctacgaggaggaatgag

SEQ ID NO: 18461 - DNA, 20 bp, Artificial Sequence
  sgRNA
  Dsg4_15
tccatgacatttagtctacg

SEQ ID NO: 18462 - DNA, 20 bp, Artificial Sequence
  sgRNA
  Dsg4_16
aatgcgatcttgggtattag

SEQ ID NO: 18463 - DNA, 20 bp, Artificial Sequence
  sgRNA
  Dsg4_17
tgagccccctctattctcca

SEQ ID NO: 18464 - DNA, 20 bp, Artificial Sequence
  sgRNA
  Dsg4_18
gattctgcagtcacattcag

SEQ ID NO: 18465 - DNA, 20 bp, Artificial Sequence
  sgRNA
  Dsg4_19
tgggtattagaggctgtcat

SEQ ID NO: 18466 - DNA, 20 bp, Artificial Sequence
  sgRNA
  Dsg4_20
gttgtcctcgccctcccgac

SEQ ID NO: 18467 - DNA, 20 bp, Artificial Sequence
  sgRNA
  Duox1_1
gcagtgaccaggcaacaacg

SEQ ID NO: 18468 - DNA, 20 bp, Artificial Sequence
  sgRNA
  Duox1_2
catgtcggagaagcttgtag

SEQ ID NO: 18469 - DNA, 20 bp, Artificial Sequence
  sgRNA
  Duox1_3
ctcctcaagagattcgacgg

SEQ ID NO: 18470 - DNA, 20 bp, Artificial Sequence
  sgRNA
  Duox1_4
cagaaatggacggtatcctg

SEQ ID NO: 18471 - DNA, 20 bp, Artificial Sequence
  sgRNA
  Duox1_5
gcatgtcctcaaccaccacg

SEQ ID NO: 18472 - DNA, 20 bp, Artificial Sequence
  sgRNA
  Duox1_6
gctgcaccgtttggtggcgg

SEQ ID NO: 18473 - DNA, 20 bp, Artificial Sequence
  sgRNA
  Duox1_7
gagagctctgggagtccgat

SEQ ID NO: 18474 - DNA, 20 bp, Artificial Sequence
  sgRNA
  Duox1_8
actcagcctgcacatccggg

SEQ ID NO: 18475 - DNA, 20 bp, Artificial Sequence
  sgRNA
  Duox1_9
cagccactagaatgtcccgt

SEQ ID NO: 18476 - DNA, 20 bp, Artificial Sequence
  sgRNA
  Duox1_10
acattcttggtcatgccagg

SEQ ID NO: 18477 - DNA, 20 bp, Artificial Sequence
  sgRNA
  Duox1_11
gcctgaccctgctttcccat

SEQ ID NO: 18478 - DNA, 20 bp, Artificial Sequence
  sgRNA
  Duox1_12
aagtccacggcagcatcgaa

SEQ ID NO: 18479 - DNA, 20 bp, Artificial Sequence
  sgRNA
  Duox1_13
gcgagcctcctacatcagcc

SEQ ID NO: 18480 - DNA, 20 bp, Artificial Sequence
  sgRNA
  Duox1_14
actgacttctgcaccccacg

SEQ ID NO: 18481 - DNA, 20 bp, Artificial Sequence
  sgRNA
  Duox1_15
agaccgccagagcatcatgt

SEQ ID NO: 18482 - DNA, 20 bp, Artificial Sequence
  sgRNA
  Duox1_16
aggtacagcgatttgatgga

SEQ ID NO: 18483 - DNA, 20 bp, Artificial Sequence
  sgRNA
  Duox1_17
aggacaatagtgctgaaaag

SEQ ID NO: 18484 - DNA, 20 bp, Artificial Sequence
  sgRNA
  Duox1_18
gatgaggcgatggaagtcca

SEQ ID NO: 18485 - DNA, 20 bp, Artificial Sequence
  sgRNA
  Duox1_19
gtagatttccctgaggcgag

SEQ ID NO: 18486 - DNA, 20 bp, Artificial Sequence
  sgRNA
  Duox1_20
gttactggtttgaaaacacc

SEQ ID NO: 18487 - DNA, 20 bp, Artificial Sequence
  sgRNA
  Duox2_1
cgaacaccgggtccccacgt

SEQ ID NO: 18488 - DNA, 20 bp, Artificial Sequence
  sgRNA
  Duox2_2
taccagtacatcccgcaagg

SEQ ID NO: 18489 - DNA, 20 bp, Artificial Sequence
  sgRNA
  Duox2_3
tcatttccggaaattcccga

SEQ ID NO: 18490 - DNA, 20 bp, Artificial Sequence
  sgRNA
  Duox2_4
ctctccccggctgtacacgg

SEQ ID NO: 18491 - DNA, 20 bp, Artificial Sequence
  sgRNA
  Duox2_5
ggtggtttcttcgatgtccg

SEQ ID NO: 18492 - DNA, 20 bp, Artificial Sequence
  sgRNA
  Duox2_6
aatctgaagtaccaccagcg

SEQ ID NO: 18493 - DNA, 20 bp, Artificial Sequence
  sgRNA
  Duox2_7
acagcctcggcaactcacaa

SEQ ID NO: 18494 - DNA, 20 bp, Artificial Sequence
  sgRNA
  Duox2_8
cagcatcgcttagccggcga

SEQ ID NO: 18495 - DNA, 20 bp, Artificial Sequence
  sgRNA
  Duox2_9
cctcggcaactcacaacgga

SEQ ID NO: 18496 - DNA, 20 bp, Artificial Sequence
  sgRNA
  Duox2_10
attctctcgcacagactacg

SEQ ID NO: 18497 - DNA, 20 bp, Artificial Sequence
  sgRNA
  Duox2_11
ctgtcgctaagggcaaagca

SEQ ID NO: 18498 - DNA, 20 bp, Artificial Sequence
  sgRNA
  Duox2_12
agaacattgctctataccaa

SEQ ID NO: 18499 - DNA, 20 bp, Artificial Sequence
  sgRNA
  Duox2_13
gcaatggctacatatccttc

SEQ ID NO: 18500 - DNA, 20 bp, Artificial Sequence
  sgRNA
  Duox2_14
tgggaagtgcagcgctacga

SEQ ID NO: 18501 - DNA, 20 bp, Artificial Sequence
  sgRNA
  Duox2_15
acagtaacaggcgcacactg

SEQ ID NO: 18502 - DNA, 20 bp, Artificial Sequence
  sgRNA
  Duox2_16
catccacctcagctatgtgg

SEQ ID NO: 18503 - DNA, 20 bp, Artificial Sequence
  sgRNA
  Duox2_17
tttaactctgaagaggaccg

SEQ ID NO: 18504 - DNA, 20 bp, Artificial Sequence
  sgRNA
  Duox2_18
agagcactccagttcttagg

SEQ ID NO: 18505 - DNA, 20 bp, Artificial Sequence
  sgRNA
  Duox2_19
agtgcctccgtgtacagccg

SEQ ID NO: 18506 - DNA, 20 bp, Artificial Sequence
  sgRNA
  Duox2_20
tcttcagctgtggtcctcca

SEQ ID NO: 18507 - DNA, 20 bp, Artificial Sequence
  sgRNA
  Duoxa1_1
actacaatgaggcattcgca

SEQ ID NO: 18508 - DNA, 20 bp, Artificial Sequence
  sgRNA
  Duoxa1_2
ggtgaccagcttattcatcg

SEQ ID NO: 18509 - DNA, 20 bp, Artificial Sequence
  sgRNA
  Duoxa1_3
cattggccagtagccagcag

SEQ ID NO: 18510 - DNA, 20 bp, Artificial Sequence
  sgRNA
  Duoxa1_4
ggctaacgtgatccagaaag

SEQ ID NO: 18511 - DNA, 20 bp, Artificial Sequence
  sgRNA
  Duoxa1_5
ttatcctgcctggcatccgt

SEQ ID NO: 18512 - DNA, 20 bp, Artificial Sequence
  sgRNA
  Duoxa1_6
tggcatcgacaacatcacat

SEQ ID NO: 18513 - DNA, 20 bp, Artificial Sequence
  sgRNA
  Duoxa1_7
tctcagccaggtatagcact

SEQ ID NO: 18514 - DNA, 20 bp, Artificial Sequence
  sgRNA
  Duoxa1_8
ggcttggtgccagtgtagaa

SEQ ID NO: 18515 - DNA, 20 bp, Artificial Sequence
  sgRNA
  Duoxa1_9
ggactgctgtgtattctgct

SEQ ID NO: 18516 - DNA, 20 bp, Artificial Sequence
  sgRNA
  Duoxa1_10
gtagtgtccattggaaaggt

SEQ ID NO: 18517 - DNA, 20 bp, Artificial Sequence
  sgRNA
  Duoxa1_11
gctaacgtgatccagaaagc

SEQ ID NO: 18518 - DNA, 20 bp, Artificial Sequence
  sgRNA
  Duoxa1_12
aggcatagtgtcctgccagg

SEQ ID NO: 18519 - DNA, 20 bp, Artificial Sequence
  sgRNA
  Duoxa1_13
ggtatagcactgggtctgga

SEQ ID NO: 18520 - DNA, 20 bp, Artificial Sequence
  sgRNA
  Duoxa1_14
acagggcgatatgagtgacg

SEQ ID NO: 18521 - DNA, 20 bp, Artificial Sequence
  sgRNA
  Duoxa1_15
gatgcagcctcacagactga

SEQ ID NO: 18522 - DNA, 20 bp, Artificial Sequence
  sgRNA
  Duoxa1_16
ctgtgaacttcagttctgag

SEQ ID NO: 18523 - DNA, 20 bp, Artificial Sequence
  sgRNA
  Duoxa1_17
acagcagtgcccaagcgcag

SEQ ID NO: 18524 - DNA, 20 bp, Artificial Sequence
  sgRNA
  Duoxa1_18
gtctggaaggcccttctcca

SEQ ID NO: 18525 - DNA, 20 bp, Artificial Sequence
  sgRNA
  Duoxa1_19
gcactgggtcctctgaactc

SEQ ID NO: 18526 - DNA, 20 bp, Artificial Sequence
  sgRNA
  Duoxa1_20
atgccagtgctggtttatgg

SEQ ID NO: 18527 - DNA, 20 bp, Artificial Sequence
  sgRNA
  Ebp_1
gaaaggcaatcactacccat

SEQ ID NO: 18528 - DNA, 20 bp, Artificial Sequence
  sgRNA
  Ebp_2
ggggcctaattgtgatcacg

SEQ ID NO: 18529 - DNA, 20 bp, Artificial Sequence
  sgRNA
  Ebp_3
ccaggatatgcgaagtcggg

SEQ ID NO: 18530 - DNA, 20 bp, Artificial Sequence
  sgRNA
  Ebp_4
aagctgtaggacaaagcgga

SEQ ID NO: 18531 - DNA, 20 bp, Artificial Sequence
  sgRNA
  Ebp_5
gcatcaagcacaaggatgct

SEQ ID NO: 18532 - DNA, 20 bp, Artificial Sequence
  sgRNA
  Ebp_6
ttcctgacagagctacacga

SEQ ID NO: 18533 - DNA, 20 bp, Artificial Sequence
  sgRNA
  Ebp_7
agtcgccgcccagctccaag

SEQ ID NO: 18534 - DNA, 20 bp, Artificial Sequence
  sgRNA
  Ebp_8
acagccacgtgatcacaatt

SEQ ID NO: 18535 - DNA, 20 bp, Artificial Sequence
  sgRNA
  Ebp_9
aatagaaccagaaataaacg

SEQ ID NO: 18536 - DNA, 20 bp, Artificial Sequence
  sgRNA
  Ebp_10
ctggggaccactcagcctat

SEQ ID NO: 18537 - DNA, 20 bp, Artificial Sequence
  sgRNA
  Ebp_11
gtcgccgcccagctccaagt

SEQ ID NO: 18538 - DNA, 20 bp, Artificial Sequence
  sgRNA
  Ebp_12
tacacgaaggactccagcat

SEQ ID NO: 18539 - DNA, 20 bp, Artificial Sequence
  sgRNA
  Ebp_13
ccatagacaccacaagctgt

SEQ ID NO: 18540 - DNA, 20 bp, Artificial Sequence
  sgRNA
  Ebp_14
ttcattcaccttgtgatcga

SEQ ID NO: 18541 - DNA, 20 bp, Artificial Sequence
  sgRNA
  Ebp_15
caagtgggacgacggaagct

SEQ ID NO: 18542 - DNA, 20 bp, Artificial Sequence
  sgRNA
  Ebp_16
ccacaagctgtaggacaaag

SEQ ID NO: 18543 - DNA, 20 bp, Artificial Sequence
  sgRNA
  Ebp_17
agaaccagccctcgatcaca

SEQ ID NO: 18544 - DNA, 20 bp, Artificial Sequence
  sgRNA
  Ebp_18
ttcaccttgtgatcgagggc

SEQ ID NO: 18545 - DNA, 20 bp, Artificial Sequence
  sgRNA
  Ebp_19
ccgacttcgcatatcctggt

SEQ ID NO: 18546 - DNA, 20 bp, Artificial Sequence
  sgRNA
  Ebp_20
ggctggttctctctctacaa

SEQ ID NO: 18547 - DNA, 20 bp, Artificial Sequence
  sgRNA
  Ece1_1
gcacgcacggtagtacactt

SEQ ID NO: 18548 - DNA, 20 bp, Artificial Sequence
  sgRNA
  Ece1_2
agtgacacggaaaacaacct

SEQ ID NO: 18549 - DNA, 20 bp, Artificial Sequence
  sgRNA
  Ece1_3
caatgagtctgagccaatcg

SEQ ID NO: 18550 - DNA, 20 bp, Artificial Sequence
  sgRNA
  Ece1_4
cttctctgtttatgtcagcg

SEQ ID NO: 18551 - DNA, 20 bp, Artificial Sequence
  sgRNA
  Ece1_5
cagcaactacagcgtgaacg

SEQ ID NO: 18552 - DNA, 20 bp, Artificial Sequence
  sgRNA
  Ece1_6
ggagaacattgccgacaacg

SEQ ID NO: 18553 - DNA, 20 bp, Artificial Sequence
  sgRNA
  Ece1_7
acggacgagttcttccacca

SEQ ID NO: 18554 - DNA, 20 bp, Artificial Sequence
  sgRNA
  Ece1_8
gcctccgtcagacataccgg

SEQ ID NO: 18555 - DNA, 20 bp, Artificial Sequence
  sgRNA
  Ece1_9
ctgctgcttgaacgcctcca

SEQ ID NO: 18556 - DNA, 20 bp, Artificial Sequence
  sgRNA
  Ece1_10
gaacggtcgacacaccctcg

SEQ ID NO: 18557 - DNA, 20 bp, Artificial Sequence
  sgRNA
  Ece1_11
aacgagatcgtgtttccagc

SEQ ID NO: 18558 - DNA, 20 bp, Artificial Sequence
  sgRNA
  Ece1_12
cgccgacgagaagttcatgg

SEQ ID NO: 18559 - DNA, 20 bp, Artificial Sequence
  sgRNA
  Ece1_13
tctggtggactcactctccg

SEQ ID NO: 18560 - DNA, 20 bp, Artificial Sequence
  sgRNA
  Ece1_14
tagtaagcgttcaccatggg

SEQ ID NO: 18561 - DNA, 20 bp, Artificial Sequence
  sgRNA
  Ece1_15
aacctccatgaacttctcgt

SEQ ID NO: 18562 - DNA, 20 bp, Artificial Sequence
  sgRNA
  Ece1_16
catcccccaggagaagcgca

SEQ ID NO: 18563 - DNA, 20 bp, Artificial Sequence
  sgRNA
  Ece1_17
gatctccatgatgatctcac

SEQ ID NO: 18564 - DNA, 20 bp, Artificial Sequence
  sgRNA
  Ece1_18
tgagaagttgaaaaagcgca

SEQ ID NO: 18565 - DNA, 20 bp, Artificial Sequence
  sgRNA
  Ece1_19
ctggtggaagaactcgtccg

SEQ ID NO: 18566 - DNA, 20 bp, Artificial Sequence
  sgRNA
  Ece1_20
tgaactacatggtccagctg

SEQ ID NO: 18567 - DNA, 20 bp, Artificial Sequence
  sgRNA
  Ecscr_1
atcagagtcagtgctaactg

SEQ ID NO: 18568 - DNA, 20 bp, Artificial Sequence
  sgRNA
  Ecscr_2
cacaggctgattggatacca

SEQ ID NO: 18569 - DNA, 20 bp, Artificial Sequence
  sgRNA
  Ecscr_3
gaaggacatcaagtcaggca

SEQ ID NO: 18570 - DNA, 20 bp, Artificial Sequence
  sgRNA
  Ecscr_4
tgcgaggtctgagttgtcgt

SEQ ID NO: 18571 - DNA, 20 bp, Artificial Sequence
  sgRNA
  Ecscr_5
gcatcacactcatctccatg

SEQ ID NO: 18572 - DNA, 20 bp, Artificial Sequence
  sgRNA
  Ecscr_6
ggatgatcactacaaccacc

SEQ ID NO: 18573 - DNA, 20 bp, Artificial Sequence
  sgRNA
  Ecscr_7
ctacacacccagctgatctg

SEQ ID NO: 18574 - DNA, 20 bp, Artificial Sequence
  sgRNA
  Ecscr_8
cagtgttgaccccagcccgt

SEQ ID NO: 18575 - DNA, 20 bp, Artificial Sequence
  sgRNA
  Ecscr_9
ttatccatggtgcttgacct

SEQ ID NO: 18576 - DNA, 20 bp, Artificial Sequence
  sgRNA
  Ecscr_10
cttgcccatcaactcccaca

SEQ ID NO: 18577 - DNA, 20 bp, Artificial Sequence
  sgRNA
  Ecscr_11
gttagcactgactctgatgt

SEQ ID NO: 18578 - DNA, 20 bp, Artificial Sequence
  sgRNA
  Ecscr_12
ggaaagggactgtttatcca

SEQ ID NO: 18579 - DNA, 20 bp, Artificial Sequence
  sgRNA
  Ecscr_13
gaagtcttctcaggtctcct

SEQ ID NO: 18580 - DNA, 20 bp, Artificial Sequence
  sgRNA
  Ecscr_14
gatgctgtctttctctccat

SEQ ID NO: 18581 - DNA, 20 bp, Artificial Sequence
  sgRNA
  Ecscr_15
gacaccaaggtcaagcacca

SEQ ID NO: 18582 - DNA, 20 bp, Artificial Sequence
  sgRNA
  Ecscr_16
gggagttgatgggcaagaag

SEQ ID NO: 18583 - DNA, 20 bp, Artificial Sequence
  sgRNA
  Ecscr_17
gagtgacctggagtcgccat

SEQ ID NO: 18584 - DNA, 20 bp, Artificial Sequence
  sgRNA
  Ecscr_18
gacatttctctggaagccca

SEQ ID NO: 18585 - DNA, 20 bp, Artificial Sequence
  sgRNA
  Ecscr_19
acatttctctggaagcccac

SEQ ID NO: 18586 - DNA, 20 bp, Artificial Sequence
  sgRNA
  Ecscr_20
agagtgacctggagtcgcca

SEQ ID NO: 18587 - DNA, 20 bp, Artificial Sequence
  sgRNA
  Eda_1
acaactgttatgggaccacc

SEQ ID NO: 18588 - DNA, 20 bp, Artificial Sequence
  sgRNA
  Eda_2
agttgcggtccgaattgcgg

SEQ ID NO: 18589 - DNA, 20 bp, Artificial Sequence
  sgRNA
  Eda_3
tgaaaaggcatattctgaag

SEQ ID NO: 18590 - DNA, 20 bp, Artificial Sequence
  sgRNA
  Eda_4
aaaggctgctgttgaaagga

SEQ ID NO: 18591 - DNA, 20 bp, Artificial Sequence
  sgRNA
  Eda_5
gttgcggtccgaattgcggc

SEQ ID NO: 18592 - DNA, 20 bp, Artificial Sequence
  sgRNA
  Eda_6
gcacccgcagcattgagaca

SEQ ID NO: 18593 - DNA, 20 bp, Artificial Sequence
  sgRNA
  Eda_7
cactgactttgccagctacg

SEQ ID NO: 18594 - DNA, 20 bp, Artificial Sequence
  sgRNA
  Eda_8
ccagctgtggtgcatctgca

SEQ ID NO: 18595 - DNA, 20 bp, Artificial Sequence
  sgRNA
  Eda_9
tgactttgccagctacgagg

SEQ ID NO: 18596 - DNA, 20 bp, Artificial Sequence
  sgRNA
  Eda_10
taaactacatccccgcagcg

SEQ ID NO: 18597 - DNA, 20 bp, Artificial Sequence
  sgRNA
  Eda_11
tgtgctgctacctagagttg

SEQ ID NO: 18598 - DNA, 20 bp, Artificial Sequence
  sgRNA
  Eda_12
tccgaattgcggcgggaacg

SEQ ID NO: 18599 - DNA, 20 bp, Artificial Sequence
  sgRNA
  Eda_13
gcaggtggagggccagcgag

SEQ ID NO: 18600 - DNA, 20 bp, Artificial Sequence
  sgRNA
  Eda_14
ggtagcagcacagcgtcagc

SEQ ID NO: 18601 - DNA, 20 bp, Artificial Sequence
  sgRNA
  Eda_15
cctcagagctacaagtacat

SEQ ID NO: 18602 - DNA, 20 bp, Artificial Sequence
  sgRNA
  Eda_16
tagagttgcggtccgaattg

SEQ ID NO: 18603 - DNA, 20 bp, Artificial Sequence
  sgRNA
  Eda_17
tttaaactacatccccgcag

SEQ ID NO: 18604 - DNA, 20 bp, Artificial Sequence
  sgRNA
  Eda_18
ggaattcctggaatccctgg

SEQ ID NO: 18605 - DNA, 20 bp, Artificial Sequence
  sgRNA
  Eda_19
ggatcttctcccggttccaa

SEQ ID NO: 18606 - DNA, 20 bp, Artificial Sequence
  sgRNA
  Eda_20
tcttccctgtctcaatgctg

SEQ ID NO: 18607 - DNA, 20 bp, Artificial Sequence
  sgRNA
  Eda2r_1
ctaccgaaagacacgcattg

SEQ ID NO: 18608 - DNA, 20 bp, Artificial Sequence
  sgRNA
  Eda2r_2
ccctggacaggagctctcga

SEQ ID NO: 18609 - DNA, 20 bp, Artificial Sequence
  sgRNA
  Eda2r_3
acaagtgtggcttccctagg

SEQ ID NO: 18610 - DNA, 20 bp, Artificial Sequence
  sgRNA
  Eda2r_4
acacactgaacctcggaaga

SEQ ID NO: 18611 - DNA, 20 bp, Artificial Sequence
  sgRNA
  Eda2r_5
gaatgagtaccgggaccaat

SEQ ID NO: 18612 - DNA, 20 bp, Artificial Sequence
  sgRNA
  Eda2r_6
tgtgtcacctgccaacaatg

SEQ ID NO: 18613 - DNA, 20 bp, Artificial Sequence
  sgRNA
  Eda2r_7
tcacttgtgctgtcatcaat

SEQ ID NO: 18614 - DNA, 20 bp, Artificial Sequence
  sgRNA
  Eda2r_8
cttccagttgagcttagtga

SEQ ID NO: 18615 - DNA, 20 bp, Artificial Sequence
  sgRNA
  Eda2r_9
aggtttcaggtccagtagag

SEQ ID NO: 18616 - DNA, 20 bp, Artificial Sequence
  sgRNA
  Eda2r_10
tgcacacactgttcccccta

SEQ ID NO: 18617 - DNA, 20 bp, Artificial Sequence
  sgRNA
  Eda2r_11
gatgactgcagctccactcg

SEQ ID NO: 18618 - DNA, 20 bp, Artificial Sequence
  sgRNA
  Eda2r_12
tgtcatcaatcgggtccaga

SEQ ID NO: 18619 - DNA, 20 bp, Artificial Sequence
  sgRNA
  Eda2r_13
cacccaggagtcctttacca

SEQ ID NO: 18620 - DNA, 20 bp, Artificial Sequence
  sgRNA
  Eda2r_14
ctaccttcactaagctcaac

SEQ ID NO: 18621 - DNA, 20 bp, Artificial Sequence
  sgRNA
  Eda2r_15
gtctccacagatagcattag

SEQ ID NO: 18622 - DNA, 20 bp, Artificial Sequence
  sgRNA
  Eda2r_16
ccttcgagagctcctgtcca

SEQ ID NO: 18623 - DNA, 20 bp, Artificial Sequence
  sgRNA
  Eda2r_17
caacaagtgtggcttcccta

SEQ ID NO: 18624 - DNA, 20 bp, Artificial Sequence
  sgRNA
  Eda2r_18
atatgaggctgaaaagacag

SEQ ID NO: 18625 - DNA, 20 bp, Artificial Sequence
  sgRNA
  Eda2r_19
tctcctggccaggtggtacg

SEQ ID NO: 18626 - DNA, 20 bp, Artificial Sequence
  sgRNA
  Eda2r_20
gggtatggacccattgagaa

SEQ ID NO: 18627 - DNA, 20 bp, Artificial Sequence
  sgRNA
  Edar_1
gcagttgctaagtcgcagtg

SEQ ID NO: 18628 - DNA, 20 bp, Artificial Sequence
  sgRNA
  Edar_2
ttctattcctacagacagtg

SEQ ID NO: 18629 - DNA, 20 bp, Artificial Sequence
  sgRNA
  Edar_3
cacacgcccacacttaccca

SEQ ID NO: 18630 - DNA, 20 bp, Artificial Sequence
  sgRNA
  Edar_4
catgtctacgatcttcatca

SEQ ID NO: 18631 - DNA, 20 bp, Artificial Sequence
  sgRNA
  Edar_5
ctttgaccgcatcagcaccg

SEQ ID NO: 18632 - DNA, 20 bp, Artificial Sequence
  sgRNA
  Edar_6
gcttctgcgctctttcctgg

SEQ ID NO: 18633 - DNA, 20 bp, Artificial Sequence
  sgRNA
  Edar_7
tgaccagtaacaagtctgct

SEQ ID NO: 18634 - DNA, 20 bp, Artificial Sequence
  sgRNA
  Edar_8
tagcaactgctcgttctcag

SEQ ID NO: 18635 - DNA, 20 bp, Artificial Sequence
  sgRNA
  Edar_9
gtcgctagttcacctggcca

SEQ ID NO: 18636 - DNA, 20 bp, Artificial Sequence
  sgRNA
  Edar_10
aataccacaaccagactacc

SEQ ID NO: 18637 - DNA, 20 bp, Artificial Sequence
  sgRNA
  Edar_11
caaagttggtgcagatcgag

SEQ ID NO: 18638 - DNA, 20 bp, Artificial Sequence
  sgRNA
  Edar_12
agacatggcaataatcaggg

SEQ ID NO: 18639 - DNA, 20 bp, Artificial Sequence
  sgRNA
  Edar_13
gagccggaggaaaaagatac

SEQ ID NO: 18640 - DNA, 20 bp, Artificial Sequence
  sgRNA
  Edar_14
gcagtcaaacggcaactcgg

SEQ ID NO: 18641 - DNA, 20 bp, Artificial Sequence
  sgRNA
  Edar_15
gttggtgcagatcgagcggc

SEQ ID NO: 18642 - DNA, 20 bp, Artificial Sequence
  sgRNA
  Edar_16
gatgatgaggacgatggcaa

SEQ ID NO: 18643 - DNA, 20 bp, Artificial Sequence
  sgRNA
  Edar_17
cactcatccagcacttccgg

SEQ ID NO: 18644 - DNA, 20 bp, Artificial Sequence
  sgRNA
  Edar_18
gcattcggcttgtcttctca

SEQ ID NO: 18645 - DNA, 20 bp, Artificial Sequence
  sgRNA
  Edar_19
gtgtcctccatgcagaccag

SEQ ID NO: 18646 - DNA, 20 bp, Artificial Sequence
  sgRNA
  Edar_20
gcatatctgataacctcctt

SEQ ID NO: 18647 - DNA, 20 bp, Artificial Sequence
  sgRNA
  Ednra_1
ccttggagaccttatctacg

SEQ ID NO: 18648 - DNA, 20 bp, Artificial Sequence
  sgRNA
  Ednra_2
gagagcacagaggttcaaga

SEQ ID NO: 18649 - DNA, 20 bp, Artificial Sequence
  sgRNA
  Ednra_3
aaggggtgaagtcttccatg

SEQ ID NO: 18650 - DNA, 20 bp, Artificial Sequence
  sgRNA
  Ednra_4
cctagcaatggctcaatgca

SEQ ID NO: 18651 - DNA, 20 bp, Artificial Sequence
  sgRNA
  Ednra_5
agctcgcccttgtattcgaa

SEQ ID NO: 18652 - DNA, 20 bp, Artificial Sequence
  sgRNA
  Ednra_6
gatggagacgatttcaatgg

SEQ ID NO: 18653 - DNA, 20 bp, Artificial Sequence
  sgRNA
  Ednra_7
cttcctgcagaagtcctccg

SEQ ID NO: 18654 - DNA, 20 bp, Artificial Sequence
  sgRNA
  Ednra_8
ggatcccgattccttgaact

SEQ ID NO: 18655 - DNA, 20 bp, Artificial Sequence
  sgRNA
  Ednra_9
ttgctgctaatggattacat

SEQ ID NO: 18656 - DNA, 20 bp, Artificial Sequence
  sgRNA
  Ednra_10
ttggccatcccggaagcaat

SEQ ID NO: 18657 - DNA, 20 bp, Artificial Sequence
  sgRNA
  Ednra_11
gctaggcagggccaaattag

SEQ ID NO: 18658 - DNA, 20 bp, Artificial Sequence
  sgRNA
  Ednra_12
tcagccaaaagtatgccgca

SEQ ID NO: 18659 - DNA, 20 bp, Artificial Sequence
  sgRNA
  Ednra_13
cgctaatctaagcagccaca

SEQ ID NO: 18660 - DNA, 20 bp, Artificial Sequence
  sgRNA
  Ednra_14
tgaatggaacgagtatccag

SEQ ID NO: 18661 - DNA, 20 bp, Artificial Sequence
  sgRNA
  Ednra_15
atttcaatggcggtaatcaa

SEQ ID NO: 18662 - DNA, 20 bp, Artificial Sequence
  sgRNA
  Ednra_16
agattagcgctgtatctctc

SEQ ID NO: 18663 - DNA, 20 bp, Artificial Sequence
  sgRNA
  Ednra_17
agaagctgagcagttcacac

SEQ ID NO: 18664 - DNA, 20 bp, Artificial Sequence
  sgRNA
  Ednra_18
ctaggcagggccaaattagg

SEQ ID NO: 18665 - DNA, 20 bp, Artificial Sequence
  sgRNA
  Ednra_19
ccagatggagacgatttcaa

SEQ ID NO: 18666 - DNA, 20 bp, Artificial Sequence
  sgRNA
  Ednra_20
aagattgctgtgcacaccaa

SEQ ID NO: 18667 - DNA, 20 bp, Artificial Sequence
  sgRNA
  Ednrb_1
tcaatatttcgttggcacgg

SEQ ID NO: 18668 - DNA, 20 bp, Artificial Sequence
  sgRNA
  Ednrb_2
gtagatgattcttagcagcg

SEQ ID NO: 18669 - DNA, 20 bp, Artificial Sequence
  sgRNA
  Ednrb_3
atgattacgtcggactacaa

SEQ ID NO: 18670 - DNA, 20 bp, Artificial Sequence
  sgRNA
  Ednrb_4
gtcacttctcgggactaaag

SEQ ID NO: 18671 - DNA, 20 bp, Artificial Sequence
  sgRNA
  Ednrb_5
gttgtcatatccgtgatcgt

SEQ ID NO: 18672 - DNA, 20 bp, Artificial Sequence
  sgRNA
  Ednrb_6
tgatgcctagcacgaacacg

SEQ ID NO: 18673 - DNA, 20 bp, Artificial Sequence
  sgRNA
  Ednrb_7
gcgttcctccgcacctgcgg

SEQ ID NO: 18674 - DNA, 20 bp, Artificial Sequence
  sgRNA
  Ednrb_8
ggactacattggtatcaaca

SEQ ID NO: 18675 - DNA, 20 bp, Artificial Sequence
  sgRNA
  Ednrb_9
gagcatttcgcaggtcatca

SEQ ID NO: 18676 - DNA, 20 bp, Artificial Sequence
  sgRNA
  Ednrb_10
ggtcacctccgcaggtgcgg

SEQ ID NO: 18677 - DNA, 20 bp, Artificial Sequence
  sgRNA
  Ednrb_11
ttaagcatgcagacccttag

SEQ ID NO: 18678 - DNA, 20 bp, Artificial Sequence
  sgRNA
  Ednrb_12
actaagacctcctggaccag

SEQ ID NO: 18679 - DNA, 20 bp, Artificial Sequence
  sgRNA
  Ednrb_13
gctggcctgtggcttcttgg

SEQ ID NO: 18680 - DNA, 20 bp, Artificial Sequence
  sgRNA
  Ednrb_14
agtcccgagaagtgacagcg

SEQ ID NO: 18681 - DNA, 20 bp, Artificial Sequence
  sgRNA
  Ednrb_15
tgatgacctgcgaaatgctc

SEQ ID NO: 18682 - DNA, 20 bp, Artificial Sequence
  sgRNA
  Ednrb_16
gttggaacctctggtccagg

SEQ ID NO: 18683 - DNA, 20 bp, Artificial Sequence
  sgRNA
  Ednrb_17
cttcttcctgagcatttcgc

SEQ ID NO: 18684 - DNA, 20 bp, Artificial Sequence
  sgRNA
  Ednrb_18
tgctgatctcaatatttcgt

SEQ ID NO: 18685 - DNA, 20 bp, Artificial Sequence
  sgRNA
  Ednrb_19
acagaagccttctgtatgaa

SEQ ID NO: 18686 - DNA, 20 bp, Artificial Sequence
  sgRNA
  Ednrb_20
tttacaagacagccaaagat

SEQ ID NO: 18687 - DNA, 20 bp, Artificial Sequence
  sgRNA
  Efna1_1
cagagtcgtcctcgtaatgt

SEQ ID NO: 18688 - DNA, 20 bp, Artificial Sequence
  sgRNA
  Efna1_2
gcccgggctcaggttccgtg

SEQ ID NO: 18689 - DNA, 20 bp, Artificial Sequence
  sgRNA
  Efna1_3
gcgatacacactgtacatgg

SEQ ID NO: 18690 - DNA, 20 bp, Artificial Sequence
  sgRNA
  Efna1_4
ggcatgccaaccccagtcca

SEQ ID NO: 18691 - DNA, 20 bp, Artificial Sequence
  sgRNA
  Efna1_5
catcatctgcccacattacg

SEQ ID NO: 18692 - DNA, 20 bp, Artificial Sequence
  sgRNA
  Efna1_6
gcaatactgcccagaccagt

SEQ ID NO: 18693 - DNA, 20 bp, Artificial Sequence
  sgRNA
  Efna1_7
gtacagtgtgtatcgctcca

SEQ ID NO: 18694 - DNA, 20 bp, Artificial Sequence
  sgRNA
  Efna1_8
tgttccagaagacgatgtgg

SEQ ID NO: 18695 - DNA, 20 bp, Artificial Sequence
  sgRNA
  Efna1_9
gcaccgtgtagtcctcctca

SEQ ID NO: 18696 - DNA, 20 bp, Artificial Sequence
  sgRNA
  Efna1_10
tgggccggttgcaattccaa

SEQ ID NO: 18697 - DNA, 20 bp, Artificial Sequence
  sgRNA
  Efna1_11
aggtccgttggaattgcaac

SEQ ID NO: 18698 - DNA, 20 bp, Artificial Sequence
  sgRNA
  Efna1_12
cttggagtctcttctcctgt

SEQ ID NO: 18699 - DNA, 20 bp, Artificial Sequence
  sgRNA
  Efna1_13
ggagcgatacacactgtaca

SEQ ID NO: 18700 - DNA, 20 bp, Artificial Sequence
  sgRNA
  Efna1_14
ccaggcccatgtcaacccac

SEQ ID NO: 18701 - DNA, 20 bp, Artificial Sequence
  sgRNA
  Efna1_15
gttccgtgaggaggactaca

SEQ ID NO: 18702 - DNA, 20 bp, Artificial Sequence
  sgRNA
  Efna1_16
ccaaccccagtccaaggacc

SEQ ID NO: 18703 - DNA, 20 bp, Artificial Sequence
  sgRNA
  Efna1_17
attccaacggacctggtcct

SEQ ID NO: 18704 - DNA, 20 bp, Artificial Sequence
  sgRNA
  Efna1_18
acattacgaggacgactctg

SEQ ID NO: 18705 - DNA, 20 bp, Artificial Sequence
  sgRNA
  Efna1_19
tcaagcactgggattcctga

SEQ ID NO: 18706 - DNA, 20 bp, Artificial Sequence
  sgRNA
  Efna1_20
cttctcctgtgggttgacat

SEQ ID NO: 18707 - DNA, 20 bp, Artificial Sequence
  sgRNA
  Efna2_1
ggttccagtagactgcgtat

SEQ ID NO: 18708 - DNA, 20 bp, Artificial Sequence
  sgRNA
  Efna2_2
tatctactgcccacactacg

SEQ ID NO: 18709 - DNA, 20 bp, Artificial Sequence
  sgRNA
  Efna2_3
gccgctgcgtgcgcgcaacg

SEQ ID NO: 18710 - DNA, 20 bp, Artificial Sequence
  sgRNA
  Efna2_4
tggcggcggctataccgtgg

SEQ ID NO: 18711 - DNA, 20 bp, Artificial Sequence
  sgRNA
  Efna2_5
gtatcggtcagcgttggccc

SEQ ID NO: 18712 - DNA, 20 bp, Artificial Sequence
  sgRNA
  Efna2_6
gatatctactgcccacacta

SEQ ID NO: 18713 - DNA, 20 bp, Artificial Sequence
  sgRNA
  Efna2_7
tgatggcggcggctataccg

SEQ ID NO: 18714 - DNA, 20 bp, Artificial Sequence
  sgRNA
  Efna2_8
gagaacttgaggggtccccc

SEQ ID NO: 18715 - DNA, 20 bp, Artificial Sequence
  sgRNA
  Efna2_9
ggagcggtacatcctgtaca

SEQ ID NO: 18716 - DNA, 20 bp, Artificial Sequence
  sgRNA
  Efna2_10
gagctgttactggtgaagat

SEQ ID NO: 18717 - DNA, 20 bp, Artificial Sequence
  sgRNA
  Efna2_11
tcctcgttgcgcgcacgcag

SEQ ID NO: 18718 - DNA, 20 bp, Artificial Sequence
  sgRNA
  Efna2_12
gcaggcagggtcggtccacg

SEQ ID NO: 18719 - DNA, 20 bp, Artificial Sequence
  sgRNA
  Efna2_13
gcttgaagcctcgctgccgg

SEQ ID NO: 18720 - DNA, 20 bp, Artificial Sequence
  sgRNA
  Efna2_14
aggccggaactcaaagccca

SEQ ID NO: 18721 - DNA, 20 bp, Artificial Sequence
  sgRNA
  Efna2_15
actggaaccgtagcaacccc

SEQ ID NO: 18722 - DNA, 20 bp, Artificial Sequence
  sgRNA
  Efna2_16
aacttctctgagaacttgag

SEQ ID NO: 18723 - DNA, 20 bp, Artificial Sequence
  sgRNA
  Efna2_17
gccacgcctcctgtgaccac

SEQ ID NO: 18724 - DNA, 20 bp, Artificial Sequence
  sgRNA
  Efna2_18
ggtcggtccacgaggttggg

SEQ ID NO: 18725 - DNA, 20 bp, Artificial Sequence
  sgRNA
  Efna2_19
tcaccaccgtccctgtgctg

SEQ ID NO: 18726 - DNA, 20 bp, Artificial Sequence
  sgRNA
  Efna2_20
gcagcgaggcttcaagcgct

SEQ ID NO: 18727 - DNA, 20 bp, Artificial Sequence
  sgRNA
  Efna3_1
tgttccagtataccgcatgc

SEQ ID NO: 18728 - DNA, 20 bp, Artificial Sequence
  sgRNA
  Efna3_2
agtagtattcttggccggca

SEQ ID NO: 18729 - DNA, 20 bp, Artificial Sequence
  sgRNA
  Efna3_3
ggccctgagctgttgtagtg

SEQ ID NO: 18730 - DNA, 20 bp, Artificial Sequence
  sgRNA
  Efna3_4
ctgtacatggtgaacctgag

SEQ ID NO: 18731 - DNA, 20 bp, Artificial Sequence
  sgRNA
  Efna3_5
tcagtgggaccagccccaag

SEQ ID NO: 18732 - DNA, 20 bp, Artificial Sequence
  sgRNA
  Efna3_6
gatgtagtagtattcttggc

SEQ ID NO: 18733 - DNA, 20 bp, Artificial Sequence
  sgRNA
  Efna3_7
ggtgaacgtgaacgactatc

SEQ ID NO: 18734 - DNA, 20 bp, Artificial Sequence
  sgRNA
  Efna3_8
gtcgttcacgttcacctgca

SEQ ID NO: 18735 - DNA, 20 bp, Artificial Sequence
  sgRNA
  Efna3_9
ctgatgctcttctcaagctt

SEQ ID NO: 18736 - DNA, 20 bp, Artificial Sequence
  sgRNA
  Efna3_10
agcttgagaagagcatcagt

SEQ ID NO: 18737 - DNA, 20 bp, Artificial Sequence
  sgRNA
  Efna3_11
gaacttgatggggctgtgcg

SEQ ID NO: 18738 - DNA, 20 bp, Artificial Sequence
  sgRNA
  Efna3_12
ggaacacctgcctctggccg

SEQ ID NO: 18739 - DNA, 20 bp, Artificial Sequence
  sgRNA
  Efna3_13
ggagcagtacgtgctgtaca

SEQ ID NO: 18740 - DNA, 20 bp, Artificial Sequence
  sgRNA
  Efna3_14
actctcccccagttcaccat

SEQ ID NO: 18741 - DNA, 20 bp, Artificial Sequence
  sgRNA
  Efna3_15
cttccagtgcaggttgtgag

SEQ ID NO: 18742 - DNA, 20 bp, Artificial Sequence
  sgRNA
  Efna3_16
ttggggcccatggtgaactg

SEQ ID NO: 18743 - DNA, 20 bp, Artificial Sequence
  sgRNA
  Efna3_17
cactctcccccagttcacca

SEQ ID NO: 18744 - DNA, 20 bp, Artificial Sequence
  sgRNA
  Efna3_18
gaattcatagcccagcgaga

SEQ ID NO: 18745 - DNA, 20 bp, Artificial Sequence
  sgRNA
  Efna3_19
cgttacagcgccttctcgct

SEQ ID NO: 18746 - DNA, 20 bp, Artificial Sequence
  sgRNA
  Efna3_20
ctgggctatgaattccatgc

SEQ ID NO: 18747 - DNA, 20 bp, Artificial Sequence
  sgRNA
  Efna4_1
ggtggactggtcaggctacg

SEQ ID NO: 18748 - DNA, 20 bp, Artificial Sequence
  sgRNA
  Efna4_2
gaatcgaacagggctgaaag

SEQ ID NO: 18749 - DNA, 20 bp, Artificial Sequence
  sgRNA
  Efna4_3
tgtgcccacaggttgctccg

SEQ ID NO: 18750 - DNA, 20 bp, Artificial Sequence
  sgRNA
  Efna4_4
gcccacattatgaaagccca

SEQ ID NO: 18751 - DNA, 20 bp, Artificial Sequence
  sgRNA
  Efna4_5
actggaactcctctaacccc

SEQ ID NO: 18752 - DNA, 20 bp, Artificial Sequence
  sgRNA
  Efna4_6
gcaagaactcaaagcccagc

SEQ ID NO: 18753 - DNA, 20 bp, Artificial Sequence
  sgRNA
  Efna4_7
gagaaagcggtacgtccggg

SEQ ID NO: 18754 - DNA, 20 bp, Artificial Sequence
  sgRNA
  Efna4_8
ctttctccaggactcccaac

SEQ ID NO: 18755 - DNA, 20 bp, Artificial Sequence
  sgRNA
  Efna4_9
gctccaccacggcatctcct

SEQ ID NO: 18756 - DNA, 20 bp, Artificial Sequence
  sgRNA
  Efna4_10
gcagcagcaagagacacagg

SEQ ID NO: 18757 - DNA, 20 bp, Artificial Sequence
  sgRNA
  Efna4_11
gttgaagcccagctccacca

SEQ ID NO: 18758 - DNA, 20 bp, Artificial Sequence
  sgRNA
  Efna4_12
catctcctcggagcaacctg

SEQ ID NO: 18759 - DNA, 20 bp, Artificial Sequence
  sgRNA
  Efna4_13
gcatcgagcaattccagcgc

SEQ ID NO: 18760 - DNA, 20 bp, Artificial Sequence
  sgRNA
  Efna4_14
ggcaagaactcaaagcccag

SEQ ID NO: 18761 - DNA, 20 bp, Artificial Sequence
  sgRNA
  Efna4_15
gcgctacacacccttcccgc

SEQ ID NO: 18762 - DNA, 20 bp, Artificial Sequence
  sgRNA
  Efna4_16
ccaggtgtctgtctgctgca

SEQ ID NO: 18763 - DNA, 20 bp, Artificial Sequence
  sgRNA
  Efna4_17
cagagcacagtccgcagcag

SEQ ID NO: 18764 - DNA, 20 bp, Artificial Sequence
  sgRNA
  Efna4_18
cgctacacacccttcccgct

SEQ ID NO: 18765 - DNA, 20 bp, Artificial Sequence
  sgRNA
  Efna4_19
tccagtagattgggtggcgg

SEQ ID NO: 18766 - DNA, 20 bp, Artificial Sequence
  sgRNA
  Efna4_20
gtcaggctacgaggcctgca

SEQ ID NO: 18767 - DNA, 20 bp, Artificial Sequence
  sgRNA
  Efna5_1
tgttccagtagacggcgtag

SEQ ID NO: 18768 - DNA, 20 bp, Artificial Sequence
  sgRNA
  Efna5_2
ggacagagtcctcatagtga

SEQ ID NO: 18769 - DNA, 20 bp, Artificial Sequence
  sgRNA
  Efna5_3
tccgttgtctgggattgcag

SEQ ID NO: 18770 - DNA, 20 bp, Artificial Sequence
  sgRNA
  Efna5_4
tgagcgctacgtcctgtaca

SEQ ID NO: 18771 - DNA, 20 bp, Artificial Sequence
  sgRNA
  Efna5_5
gccatcccgcggtgagaacg

SEQ ID NO: 18772 - DNA, 20 bp, Artificial Sequence
  sgRNA
  Efna5_6
cctgcgaccacacgtccaaa

SEQ ID NO: 18773 - DNA, 20 bp, Artificial Sequence
  sgRNA
  Efna5_7
tggctcggctgactcatgta

SEQ ID NO: 18774 - DNA, 20 bp, Artificial Sequence
  sgRNA
  Efna5_8
gcatcgccaggaggaacagt

SEQ ID NO: 18775 - DNA, 20 bp, Artificial Sequence
  sgRNA
  Efna5_9
gagaacttcagcggtccgtt

SEQ ID NO: 18776 - DNA, 20 bp, Artificial Sequence
  sgRNA
  Efna5_10
gccgcgttctcaccgcggga

SEQ ID NO: 18777 - DNA, 20 bp, Artificial Sequence
  sgRNA
  Efna5_11
tctgcgccgcgttctcaccg

SEQ ID NO: 18778 - DNA, 20 bp, Artificial Sequence
  sgRNA
  Efna5_12
gagtcagccgagccatcccg

SEQ ID NO: 18779 - DNA, 20 bp, Artificial Sequence
  sgRNA
  Efna5_13
gttgctgctgttccagtaga

SEQ ID NO: 18780 - DNA, 20 bp, Artificial Sequence
  sgRNA
  Efna5_14
aaccggcctcactccccaaa

SEQ ID NO: 18781 - DNA, 20 bp, Artificial Sequence
  sgRNA
  Efna5_15
gtagcggtcggcgacgactt

SEQ ID NO: 18782 - DNA, 20 bp, Artificial Sequence
  sgRNA
  Efna5_16
ggaacagtaggattgccaaa

SEQ ID NO: 18783 - DNA, 20 bp, Artificial Sequence
  sgRNA
  Efna5_17
acagtaggattgccaaaagg

SEQ ID NO: 18784 - DNA, 20 bp, Artificial Sequence
  sgRNA
  Efna5_18
cattgatacagacatcaatg

SEQ ID NO: 18785 - DNA, 20 bp, Artificial Sequence
  sgRNA
  Efna5_19
tcttgaaccctttggacgtg

SEQ ID NO: 18786 - DNA, 20 bp, Artificial Sequence
  sgRNA
  Efna5_20
ttcccatctcttgaaccctt

SEQ ID NO: 18787 - DNA, 20 bp, Artificial Sequence
  sgRNA
  Efnb1_1
cacatgtaatgtagtaatcg

SEQ ID NO: 18788 - DNA, 20 bp, Artificial Sequence
  sgRNA
  Efnb1_2
atcgttatgaaggttgggca

SEQ ID NO: 18789 - DNA, 20 bp, Artificial Sequence
  sgRNA
  Efnb1_3
tacagcttgtagtactcgta

SEQ ID NO: 18790 - DNA, 20 bp, Artificial Sequence
  sgRNA
  Efnb1_4
caggttcttggccaacggcg

SEQ ID NO: 18791 - DNA, 20 bp, Artificial Sequence
  sgRNA
  Efnb1_5
gtagcattgttcgcagccgt

SEQ ID NO: 18792 - DNA, 20 bp, Artificial Sequence
  sgRNA
  Efnb1_6
ccgagcagttgactaccagc

SEQ ID NO: 18793 - DNA, 20 bp, Artificial Sequence
  sgRNA
  Efnb1_7
tctgcccccgagcagaagca

SEQ ID NO: 18794 - DNA, 20 bp, Artificial Sequence
  sgRNA
  Efnb1_8
caagcatacacagcagcggg

SEQ ID NO: 18795 - DNA, 20 bp, Artificial Sequence
  sgRNA
  Efnb1_9
gtacagcttgtagtactcgt

SEQ ID NO: 18796 - DNA, 20 bp, Artificial Sequence
  sgRNA
  Efnb1_10
gagttcagccccaactacat

SEQ ID NO: 18797 - DNA, 20 bp, Artificial Sequence
  sgRNA
  Efnb1_11
gcatcctgtctacatcgtcc

SEQ ID NO: 18798 - DNA, 20 bp, Artificial Sequence
  sgRNA
  Efnb1_12
gcgacatcatcatcccctta

SEQ ID NO: 18799 - DNA, 20 bp, Artificial Sequence
  sgRNA
  Efnb1_13
tgttctctgtagtccgtaag

SEQ ID NO: 18800 - DNA, 20 bp, Artificial Sequence
  sgRNA
  Efnb1_14
gttgcaagtgaccagtacat

SEQ ID NO: 18801 - DNA, 20 bp, Artificial Sequence
  sgRNA
  Efnb1_15
atcgcaagcatacacagcag

SEQ ID NO: 18802 - DNA, 20 bp, Artificial Sequence
  sgRNA
  Efnb1_16
aaggggatgatgatgtcgct

SEQ ID NO: 18803 - DNA, 20 bp, Artificial Sequence
  sgRNA
  Efnb1_17
ggagggactggagaaccggg

SEQ ID NO: 18804 - DNA, 20 bp, Artificial Sequence
  sgRNA
  Efnb1_18
ttgttctctgtagtccgtaa

SEQ ID NO: 18805 - DNA, 20 bp, Artificial Sequence
  sgRNA
  Efnb1_19
gctcctggtcggggatccca

SEQ ID NO: 18806 - DNA, 20 bp, Artificial Sequence
  sgRNA
  Efnb1_20
ccagcttgtctccaatcttc

SEQ ID NO: 18807 - DNA, 20 bp, Artificial Sequence
  sgRNA
  Efnb2_1
ctggtactatacccacagat

SEQ ID NO: 18808 - DNA, 20 bp, Artificial Sequence
  sgRNA
  Efnb2_2
gaattcagccctaacctctg

SEQ ID NO: 18809 - DNA, 20 bp, Artificial Sequence
  sgRNA
  Efnb2_3
ggtctggcacagttgagcag

SEQ ID NO: 18810 - DNA, 20 bp, Artificial Sequence
  sgRNA
  Efnb2_4
gcaccgatggcaacagcgcg

SEQ ID NO: 18811 - DNA, 20 bp, Artificial Sequence
  sgRNA
  Efnb2_5
gcactacgagaaggtcagcg

SEQ ID NO: 18812 - DNA, 20 bp, Artificial Sequence
  sgRNA
  Efnb2_6
ataaggccacttcggaaccc

SEQ ID NO: 18813 - DNA, 20 bp, Artificial Sequence
  sgRNA
  Efnb2_7
tctggcacagttgagcagcg

SEQ ID NO: 18814 - DNA, 20 bp, Artificial Sequence
  sgRNA
  Efnb2_8
aagcgaggtggcaacaacaa

SEQ ID NO: 18815 - DNA, 20 bp, Artificial Sequence
  sgRNA
  Efnb2_9
ttgttgttgccacctcgctt

SEQ ID NO: 18816 - DNA, 20 bp, Artificial Sequence
  sgRNA
  Efnb2_10
agtggtatgataacgtcact

SEQ ID NO: 18817 - DNA, 20 bp, Artificial Sequence
  sgRNA
  Efnb2_11
tgtgctgtggagagtgtttg

SEQ ID NO: 18818 - DNA, 20 bp, Artificial Sequence
  sgRNA
  Efnb2_12
ccgcactacgagaaggtcag

SEQ ID NO: 18819 - DNA, 20 bp, Artificial Sequence
  sgRNA
  Efnb2_13
gcacccggtgtacatcgtgc

SEQ ID NO: 18820 - DNA, 20 bp, Artificial Sequence
  sgRNA
  Efnb2_14
gcctggataaccaggaggga

SEQ ID NO: 18821 - DNA, 20 bp, Artificial Sequence
  sgRNA
  Efnb2_15
aggtggcaacaacaatggct

SEQ ID NO: 18822 - DNA, 20 bp, Artificial Sequence
  sgRNA
  Efnb2_16
gagggcctggataaccagga

SEQ ID NO: 18823 - DNA, 20 bp, Artificial Sequence
  sgRNA
  Efnb2_17
atctcctgcacgatgtacac

SEQ ID NO: 18824 - DNA, 20 bp, Artificial Sequence
  sgRNA
  Efnb2_18
agacgtccagagctagaagc

SEQ ID NO: 18825 - DNA, 20 bp, Artificial Sequence
  sgRNA
  Efnb2_19
gtgacgttatcataccacta

SEQ ID NO: 18826 - DNA, 20 bp, Artificial Sequence
  sgRNA
  Efnb2_20
gttgccacctcgcttgggcg

SEQ ID NO: 18827 - DNA, 20 bp, Artificial Sequence
  sgRNA
  Efnb3_1
ggagggacaccataccaggt

SEQ ID NO: 18828 - DNA, 20 bp, Artificial Sequence
  sgRNA
  Efnb3_2
ggaggcgtgtgcctaaccag

SEQ ID NO: 18829 - DNA, 20 bp, Artificial Sequence
  sgRNA
  Efnb3_3
ggggacaaagtagatctagc

SEQ ID NO: 18830 - DNA, 20 bp, Artificial Sequence
  sgRNA
  Efnb3_4
aattatgtagtaatcgtggt

SEQ ID NO: 18831 - DNA, 20 bp, Artificial Sequence
  sgRNA
  Efnb3_5
ggaacttgatggtgaagcgg

SEQ ID NO: 18832 - DNA, 20 bp, Artificial Sequence
  sgRNA
  Efnb3_6
tacctggtagagggtgccca

SEQ ID NO: 18833 - DNA, 20 bp, Artificial Sequence
  sgRNA
  Efnb3_7
cgtgctttatcctcagatcg

SEQ ID NO: 18834 - DNA, 20 bp, Artificial Sequence
  sgRNA
  Efnb3_8
gagctaggaatagccctgcg

SEQ ID NO: 18835 - DNA, 20 bp, Artificial Sequence
  sgRNA
  Efnb3_9
cgcaaaacctaacagcagca

SEQ ID NO: 18836 - DNA, 20 bp, Artificial Sequence
  sgRNA
  Efnb3_10
tgagttctacaaactgtacc

SEQ ID NO: 18837 - DNA, 20 bp, Artificial Sequence
  sgRNA
  Efnb3_11
gctggtatctggactcagcc

SEQ ID NO: 18838 - DNA, 20 bp, Artificial Sequence
  sgRNA
  Efnb3_12
gcaccctgtgtacattgtgc

SEQ ID NO: 18839 - DNA, 20 bp, Artificial Sequence
  sgRNA
  Efnb3_13
actggaactcggcgaataag

SEQ ID NO: 18840 - DNA, 20 bp, Artificial Sequence
  sgRNA
  Efnb3_14
cctcactacgagaaggtgag

SEQ ID NO: 18841 - DNA, 20 bp, Artificial Sequence
  sgRNA
  Efnb3_15
tccccaggctcagcttcccg

SEQ ID NO: 18842 - DNA, 20 bp, Artificial Sequence
  sgRNA
  Efnb3_16
accttcttctcacatgtgac

SEQ ID NO: 18843 - DNA, 20 bp, Artificial Sequence
  sgRNA
  Efnb3_17
agaaggtgagcggtgactat

SEQ ID NO: 18844 - DNA, 20 bp, Artificial Sequence
  sgRNA
  Efnb3_18
catcctgcacaatgtacaca

SEQ ID NO: 18845 - DNA, 20 bp, Artificial Sequence
  sgRNA
  Efnb3_19
cagaggggcagctcacagcg

SEQ ID NO: 18846 - DNA, 20 bp, Artificial Sequence
  sgRNA
  Efnb3_20
cagagaccctcccctcccaa

SEQ ID NO: 18847 - DNA, 20 bp, Artificial Sequence
  sgRNA
  Egf_1
tcaccgtaacagatatgaca

SEQ ID NO: 18848 - DNA, 20 bp, Artificial Sequence
  sgRNA
  Egf_2
agactgttctggacggacgt

SEQ ID NO: 18849 - DNA, 20 bp, Artificial Sequence
  sgRNA
  Egf_3
tgttcatcgcctgacaatgg

SEQ ID NO: 18850 - DNA, 20 bp, Artificial Sequence
  sgRNA
  Egf_4
gtgtcacaaaggatggatgg

SEQ ID NO: 18851 - DNA, 20 bp, Artificial Sequence
  sgRNA
  Egf_5
tgttcacccttattaccgat

SEQ ID NO: 18852 - DNA, 20 bp, Artificial Sequence
  sgRNA
  Egf_6
gagagaatctcgaggccgcg

SEQ ID NO: 18853 - DNA, 20 bp, Artificial Sequence
  sgRNA
  Egf_7
cttcccttcaaggttccgac

SEQ ID NO: 18854 - DNA, 20 bp, Artificial Sequence
  sgRNA
  Egf_8
ggatgcacagctattcctcg

SEQ ID NO: 18855 - DNA, 20 bp, Artificial Sequence
  sgRNA
  Egf_9
acatccgtcaaatatagcag

SEQ ID NO: 18856 - DNA, 20 bp, Artificial Sequence
  sgRNA
  Egf_10
agacttatccagaacgacgt

SEQ ID NO: 18857 - DNA, 20 bp, Artificial Sequence
  sgRNA
  Egf_11
tagtcaatcgtgattccact

SEQ ID NO: 18858 - DNA, 20 bp, Artificial Sequence
  sgRNA
  Egf_12
gcaccattcgtaccatccgc

SEQ ID NO: 18859 - DNA, 20 bp, Artificial Sequence
  sgRNA
  Egf_13
ggatagccaacaaacacacg

SEQ ID NO: 18860 - DNA, 20 bp, Artificial Sequence
  sgRNA
  Egf_14
ttgatgcctgataagacgga

SEQ ID NO: 18861 - DNA, 20 bp, Artificial Sequence
  sgRNA
  Egf_15
ggaagcagaacaaatcctgt

SEQ ID NO: 18862 - DNA, 20 bp, Artificial Sequence
  sgRNA
  Egf_16
gctacacgttaagccgagac

SEQ ID NO: 18863 - DNA, 20 bp, Artificial Sequence
  sgRNA
  Egf_17
cctccattcctgtataagca

SEQ ID NO: 18864 - DNA, 20 bp, Artificial Sequence
  sgRNA
  Egf_18
atattgacgagtgccagcgg

SEQ ID NO: 18865 - DNA, 20 bp, Artificial Sequence
  sgRNA
  Egf_19
tgtactggtgtgacaccaag

SEQ ID NO: 18866 - DNA, 20 bp, Artificial Sequence
  sgRNA
  Egf_20
ctcggattgggctatcccat

SEQ ID NO: 18867 - DNA, 20 bp, Artificial Sequence
  sgRNA
  Egfr_1
accagacagtcactctctcg

SEQ ID NO: 18868 - DNA, 20 bp, Artificial Sequence
  sgRNA
  Egfr_2
tgggcctgactactacgaag

SEQ ID NO: 18869 - DNA, 20 bp, Artificial Sequence
  sgRNA
  Egfr_3
catgaataggccaatcccaa

SEQ ID NO: 18870 - DNA, 20 bp, Artificial Sequence
  sgRNA
  Egfr_4
gagaacctagaaataatacg

SEQ ID NO: 18871 - DNA, 20 bp, Artificial Sequence
  sgRNA
  Egfr_5
ggatagtatccatattgcag

SEQ ID NO: 18872 - DNA, 20 bp, Artificial Sequence
  sgRNA
  Egfr_6
cctcattgccctcaacaccg

SEQ ID NO: 18873 - DNA, 20 bp, Artificial Sequence
  sgRNA
  Egfr_7
acatcgatggtgcagatagg

SEQ ID NO: 18874 - DNA, 20 bp, Artificial Sequence
  sgRNA
  Egfr_8
agaaagaatatcatgccgag

SEQ ID NO: 18875 - DNA, 20 bp, Artificial Sequence
  sgRNA
  Egfr_9
ccaggaggcggcatacatga

SEQ ID NO: 18876 - DNA, 20 bp, Artificial Sequence
  sgRNA
  Egfr_10
gattctctccacggtgttga

SEQ ID NO: 18877 - DNA, 20 bp, Artificial Sequence
  sgRNA
  Egfr_11
atactgcactgccatcagcg

SEQ ID NO: 18878 - DNA, 20 bp, Artificial Sequence
  sgRNA
  Egfr_12
ctttctggatccagagtgca

SEQ ID NO: 18879 - DNA, 20 bp, Artificial Sequence
  sgRNA
  Egfr_13
tcaacagcccgtccacgtcg

SEQ ID NO: 18880 - DNA, 20 bp, Artificial Sequence
  sgRNA
  Egfr_14
aatcctttatgctcctcgga

SEQ ID NO: 18881 - DNA, 20 bp, Artificial Sequence
  sgRNA
  Egfr_15
gccacaaccaatgtgctgcg

SEQ ID NO: 18882 - DNA, 20 bp, Artificial Sequence
  sgRNA
  Egfr_16
ttagaatttctagttctcgt

SEQ ID NO: 18883 - DNA, 20 bp, Artificial Sequence
  sgRNA
  Egfr_17
atatggatactatccagtgg

SEQ ID NO: 18884 - DNA, 20 bp, Artificial Sequence
  sgRNA
  Egfr_18
tcaactctcggaactttggg

SEQ ID NO: 18885 - DNA, 20 bp, Artificial Sequence
  sgRNA
  Egfr_19
gtatccatattgcagaggat

SEQ ID NO: 18886 - DNA, 20 bp, Artificial Sequence
  sgRNA
  Egfr_20
attacacagctcatgcccta

SEQ ID NO: 18887 - DNA, 20 bp, Artificial Sequence
  sgRNA
  Elfn1_1
ctacattgaagtgcgcacgg

SEQ ID NO: 18888 - DNA, 20 bp, Artificial Sequence
  sgRNA
  Elfn1_2
gtttccgaagcggctcaggg

SEQ ID NO: 18889 - DNA, 20 bp, Artificial Sequence
  sgRNA
  Elfn1_3
caccaactacacatactgcg

SEQ ID NO: 18890 - DNA, 20 bp, Artificial Sequence
  sgRNA
  Elfn1_4
cctacaggccaacctcatcg

SEQ ID NO: 18891 - DNA, 20 bp, Artificial Sequence
  sgRNA
  Elfn1_5
attactgcctgcgcaagcgg

SEQ ID NO: 18892 - DNA, 20 bp, Artificial Sequence
  sgRNA
  Elfn1_6
acccgcgtgcagtaacgtgg

SEQ ID NO: 18893 - DNA, 20 bp, Artificial Sequence
  sgRNA
  Elfn1_7
gcgcaagcggaggcgacaag

SEQ ID NO: 18894 - DNA, 20 bp, Artificial Sequence
  sgRNA
  Elfn1_8
gttaagccgcaggtccacga

SEQ ID NO: 18895 - DNA, 20 bp, Artificial Sequence
  sgRNA
  Elfn1_9
gcagcggcaccacagtgtgg

SEQ ID NO: 18896 - DNA, 20 bp, Artificial Sequence
  sgRNA
  Elfn1_10
ccacctccacccactcacga

SEQ ID NO: 18897 - DNA, 20 bp, Artificial Sequence
  sgRNA
  Elfn1_11
gttcaaccgcatgtacacgc

SEQ ID NO: 18898 - DNA, 20 bp, Artificial Sequence
  sgRNA
  Elfn1_12
gcacgggtggggtacagcgt

SEQ ID NO: 18899 - DNA, 20 bp, Artificial Sequence
  sgRNA
  Elfn1_13
aagcactcgtcatcagcgca

SEQ ID NO: 18900 - DNA, 20 bp, Artificial Sequence
  sgRNA
  Elfn1_14
cctcagcccggaaggtgcga

SEQ ID NO: 18901 - DNA, 20 bp, Artificial Sequence
  sgRNA
  Elfn1_15
agggccagcacttcatccag

SEQ ID NO: 18902 - DNA, 20 bp, Artificial Sequence
  sgRNA
  Elfn1_16
cggctgcgcaacctcacgga

SEQ ID NO: 18903 - DNA, 20 bp, Artificial Sequence
  sgRNA
  Elfn1_17
catcatccttgtgtctccgt

SEQ ID NO: 18904 - DNA, 20 bp, Artificial Sequence
  sgRNA
  Elfn1_18
gccgccacgttactgcacgc

SEQ ID NO: 18905 - DNA, 20 bp, Artificial Sequence
  sgRNA
  Elfn1_19
aggctgggtcagcttggaca

SEQ ID NO: 18906 - DNA, 20 bp, Artificial Sequence
  sgRNA
  Elfn1_20
gatggtcatgatgtagtggg

SEQ ID NO: 18907 - DNA, 20 bp, Artificial Sequence
  sgRNA
  Elfn2_1
gaacgagatttcctacatcg

SEQ ID NO: 18908 - DNA, 20 bp, Artificial Sequence
  sgRNA
  Elfn2_2
gcaccaagtcaccttcacct

SEQ ID NO: 18909 - DNA, 20 bp, Artificial Sequence
  sgRNA
  Elfn2_3
gatagtcatgatgtagtgcg

SEQ ID NO: 18910 - DNA, 20 bp, Artificial Sequence
  sgRNA
  Elfn2_4
cctattccacggatgcgcag

SEQ ID NO: 18911 - DNA, 20 bp, Artificial Sequence
  sgRNA
  Elfn2_5
ccatgtatacctcctcgcga

SEQ ID NO: 18912 - DNA, 20 bp, Artificial Sequence
  sgRNA
  Elfn2_6
gctgactgctggctcatcga

SEQ ID NO: 18913 - DNA, 20 bp, Artificial Sequence
  sgRNA
  Elfn2_7
gatgcgctatggcgctgacg

SEQ ID NO: 18914 - DNA, 20 bp, Artificial Sequence
  sgRNA
  Elfn2_8
gcaggtcttacggctcactg

SEQ ID NO: 18915 - DNA, 20 bp, Artificial Sequence
  sgRNA
  Elfn2_9
cctcctcgtagtagagagcg

SEQ ID NO: 18916 - DNA, 20 bp, Artificial Sequence
  sgRNA
  Elfn2_10
tcaccccacaccctattcca

SEQ ID NO: 18917 - DNA, 20 bp, Artificial Sequence
  sgRNA
  Elfn2_11
acagcactgtgcatgacctg

SEQ ID NO: 18918 - DNA, 20 bp, Artificial Sequence
  sgRNA
  Elfn2_12
ccatcgcgaggaggtataca

SEQ ID NO: 18919 - DNA, 20 bp, Artificial Sequence
  sgRNA
  Elfn2_13
tggtgaggttgaggtccgtg

SEQ ID NO: 18920 - DNA, 20 bp, Artificial Sequence
  sgRNA
  Elfn2_14
gaactggaccttcttacgca

SEQ ID NO: 18921 - DNA, 20 bp, Artificial Sequence
  sgRNA
  Elfn2_15
ggtccgtgaggttcccgaag

SEQ ID NO: 18922 - DNA, 20 bp, Artificial Sequence
  sgRNA
  Elfn2_16
cttccccgctctctactacg

SEQ ID NO: 18923 - DNA, 20 bp, Artificial Sequence
  sgRNA
  Elfn2_17
tcctgacgagatcctctcgg

SEQ ID NO: 18924 - DNA, 20 bp, Artificial Sequence
  sgRNA
  Elfn2_18
gcctgcagtgtgagtcaccg

SEQ ID NO: 18925 - DNA, 20 bp, Artificial Sequence
  sgRNA
  Elfn2_19
taagaaggtccagttcgcga

SEQ ID NO: 18926 - DNA, 20 bp, Artificial Sequence
  sgRNA
  Elfn2_20
tctcgcttagagcgggtcag

SEQ ID NO: 18927 - DNA, 20 bp, Artificial Sequence
  sgRNA
  Emb_1
agtcgttgatcgcttacgtg

SEQ ID NO: 18928 - DNA, 20 bp, Artificial Sequence
  sgRNA
  Emb_2
aagtcacccgtagtctcaag

SEQ ID NO: 18929 - DNA, 20 bp, Artificial Sequence
  sgRNA
  Emb_3
acaccttaaccagtcagtac

SEQ ID NO: 18930 - DNA, 20 bp, Artificial Sequence
  sgRNA
  Emb_4
ttaaattggacttggtacat

SEQ ID NO: 18931 - DNA, 20 bp, Artificial Sequence
  sgRNA
  Emb_5
gttcccatgccaatgaaaca

SEQ ID NO: 18932 - DNA, 20 bp, Artificial Sequence
  sgRNA
  Emb_6
gaaggtggcacgacaccagt

SEQ ID NO: 18933 - DNA, 20 bp, Artificial Sequence
  sgRNA
  Emb_7
aggaagatggaggatcctac

SEQ ID NO: 18934 - DNA, 20 bp, Artificial Sequence
  sgRNA
  Emb_8
tcattcgagtgagcgtcaat

SEQ ID NO: 18935 - DNA, 20 bp, Artificial Sequence
  sgRNA
  Emb_9
ccgccagaagacatagaagg

SEQ ID NO: 18936 - DNA, 20 bp, Artificial Sequence
  sgRNA
  Emb_10
gtttgcagcccacacacaaa

SEQ ID NO: 18937 - DNA, 20 bp, Artificial Sequence
  sgRNA
  Emb_11
atcgtcctgccctcaatagg

SEQ ID NO: 18938 - DNA, 20 bp, Artificial Sequence
  sgRNA
  Emb_12
gcatagaaaacaatgtcccc

SEQ ID NO: 18939 - DNA, 20 bp, Artificial Sequence
  sgRNA
  Emb_13
gcagaatgatggccaccaag

SEQ ID NO: 18940 - DNA, 20 bp, Artificial Sequence
  sgRNA
  Emb_14
gaagtcacccgtagtctcaa

SEQ ID NO: 18941 - DNA, 20 bp, Artificial Sequence
  sgRNA
  Emb_15
gagctgtaatatctcagtga

SEQ ID NO: 18942 - DNA, 20 bp, Artificial Sequence
  sgRNA
  Emb_16
gtaaaccacctattgagggc

SEQ ID NO: 18943 - DNA, 20 bp, Artificial Sequence
  sgRNA
  Emb_17
ttgtgtaaaccacctattga

SEQ ID NO: 18944 - DNA, 20 bp, Artificial Sequence
  sgRNA
  Emb_18
acctattgagggcaggacga

SEQ ID NO: 18945 - DNA, 20 bp, Artificial Sequence
  sgRNA
  Emb_19
gtatggccagaaatggcttg

SEQ ID NO: 18946 - DNA, 20 bp, Artificial Sequence
  sgRNA
  Emb_20
acgcgccctgatccggctga

SEQ ID NO: 18947 - DNA, 20 bp, Artificial Sequence
  sgRNA
  Emcn_1
gaatgactctattccaacac

SEQ ID NO: 18948 - DNA, 20 bp, Artificial Sequence
  sgRNA
  Emcn_2
tcagagttcaatcagaacaa

SEQ ID NO: 18949 - DNA, 20 bp, Artificial Sequence
  sgRNA
  Emcn_3
ctgacaacaccaaaacatga

SEQ ID NO: 18950 - DNA, 20 bp, Artificial Sequence
  sgRNA
  Emcn_4
aatgctaattcaacgctacc

SEQ ID NO: 18951 - DNA, 20 bp, Artificial Sequence
  sgRNA
  Emcn_5
gcagatggaacacctcccga

SEQ ID NO: 18952 - DNA, 20 bp, Artificial Sequence
  sgRNA
  Emcn_6
tttgttgtggaagtttctgc

SEQ ID NO: 18953 - DNA, 20 bp, Artificial Sequence
  sgRNA
  Emcn_7
ctcttggtatttactctggt

SEQ ID NO: 18954 - DNA, 20 bp, Artificial Sequence
  sgRNA
  Emcn_8
acactctctttatcggactg

SEQ ID NO: 18955 - DNA, 20 bp, Artificial Sequence
  sgRNA
  Emcn_9
tttgtcactgacacgatgcc

SEQ ID NO: 18956 - DNA, 20 bp, Artificial Sequence
  sgRNA
  Emcn_10
agtggaactttcattcctta

SEQ ID NO: 18957 - DNA, 20 bp, Artificial Sequence
  sgRNA
  Emcn_11
aatcctaacaaaccagcaga

SEQ ID NO: 18958 - DNA, 20 bp, Artificial Sequence
  sgRNA
  Emcn_12
tttgcctgtggttatcgcgc

SEQ ID NO: 18959 - DNA, 20 bp, Artificial Sequence
  sgRNA
  Emcn_13
acaaccagcgcgataaccac

SEQ ID NO: 18960 - DNA, 20 bp, Artificial Sequence
  sgRNA
  Emcn_14
tgacgtatcccaaacatctt

SEQ ID NO: 18961 - DNA, 20 bp, Artificial Sequence
  sgRNA
  Emcn_15
gttgaattagcatttgaagt

SEQ ID NO: 18962 - DNA, 20 bp, Artificial Sequence
  sgRNA
  Emcn_16
tgtttgggatacgtcacttt

SEQ ID NO: 18963 - DNA, 20 bp, Artificial Sequence
  sgRNA
  Emcn_17
agtctctgccacagtgagga

SEQ ID NO: 18964 - DNA, 20 bp, Artificial Sequence
  sgRNA
  Emcn_18
aaagcctctgtcacaatacc

SEQ ID NO: 18965 - DNA, 20 bp, Artificial Sequence
  sgRNA
  Emcn_19
caacagtctctgccacagtg

SEQ ID NO: 18966 - DNA, 20 bp, Artificial Sequence
  sgRNA
  Emcn_20
tgggtttgtatcgaatatgc

SEQ ID NO: 18967 - DNA, 20 bp, Artificial Sequence
  sgRNA
  Emp1_1
atgcataccttcattgccgt

SEQ ID NO: 18968 - DNA, 20 bp, Artificial Sequence
  sgRNA
  Emp1_2
attacgcaaatgcatctgta

SEQ ID NO: 18969 - DNA, 20 bp, Artificial Sequence
  sgRNA
  Emp1_3
atactcacagcacaccagca

SEQ ID NO: 18970 - DNA, 20 bp, Artificial Sequence
  sgRNA
  Emp1_4
gcataatggcagtggcaatg

SEQ ID NO: 18971 - DNA, 20 bp, Artificial Sequence
  sgRNA
  Emp1_5
atcattacgcccacagcgaa

SEQ ID NO: 18972 - DNA, 20 bp, Artificial Sequence
  sgRNA
  Emp1_6
agttgaagttcccttcgctg

SEQ ID NO: 18973 - DNA, 20 bp, Artificial Sequence
  sgRNA
  Emp1_7
gcatactctatatggtcctg

SEQ ID NO: 18974 - DNA, 20 bp, Artificial Sequence
  sgRNA
  Emp1_8
ctggaacacgaagaccacaa

SEQ ID NO: 18975 - DNA, 20 bp, Artificial Sequence
  sgRNA
  Emp1_9
tgcactggtggtaactgcga

SEQ ID NO: 18976 - DNA, 20 bp, Artificial Sequence
  sgRNA
  Emp1_10
tcaggatgaaacaatagcct

SEQ ID NO: 18977 - DNA, 20 bp, Artificial Sequence
  sgRNA
  Emp1_11
gctggaacacgaagaccaca

SEQ ID NO: 18978 - DNA, 20 bp, Artificial Sequence
  sgRNA
  Emp1_12
cgtgttccagctcttcacta

SEQ ID NO: 18979 - DNA, 20 bp, Artificial Sequence
  sgRNA
  Emp1_13
ggtggagacaaacagcataa

SEQ ID NO: 18980 - DNA, 20 bp, Artificial Sequence
  sgRNA
  Emp1_14
tgtagattgacactccaacc

SEQ ID NO: 18981 - DNA, 20 bp, Artificial Sequence
  sgRNA
  Emp1_15
gctactggctggtctctttg

SEQ ID NO: 18982 - DNA, 20 bp, Artificial Sequence
  sgRNA
  Emp1_16
cagctcttcactatggagaa

SEQ ID NO: 18983 - DNA, 20 bp, Artificial Sequence
  sgRNA
  Emp1_17
gacaaacagcataatggcag

SEQ ID NO: 18984 - DNA, 20 bp, Artificial Sequence
  sgRNA
  Emp1_18
gctgaaacagaagcagatcc

SEQ ID NO: 18985 - DNA, 20 bp, Artificial Sequence
  sgRNA
  Emp1_19
gatgatggagaggatcatga

SEQ ID NO: 18986 - DNA, 20 bp, Artificial Sequence
  sgRNA
  Emp1_20
tgcgacggctccctgtccta

SEQ ID NO: 18987 - DNA, 20 bp, Artificial Sequence
  sgRNA
  Emp2_1
ggagtgccgtggacacgatg

SEQ ID NO: 18988 - DNA, 20 bp, Artificial Sequence
  sgRNA
  Emp2_2
aggttattctgtgatgcagg

SEQ ID NO: 18989 - DNA, 20 bp, Artificial Sequence
  sgRNA
  Emp2_3
acaggaacttacattgtcaa

SEQ ID NO: 18990 - DNA, 20 bp, Artificial Sequence
  sgRNA
  Emp2_4
tgagctggatgatggacgtc

SEQ ID NO: 18991 - DNA, 20 bp, Artificial Sequence
  sgRNA
  Emp2_5
tgttggtgcacactctccag

SEQ ID NO: 18992 - DNA, 20 bp, Artificial Sequence
  sgRNA
  Emp2_6
cagctcttccgcctcaagca

SEQ ID NO: 18993 - DNA, 20 bp, Artificial Sequence
  sgRNA
  Emp2_7
tgtcttccacatcgtgtcca

SEQ ID NO: 18994 - DNA, 20 bp, Artificial Sequence
  sgRNA
  Emp2_8
gttggtgaaggtcttggcgc

SEQ ID NO: 18995 - DNA, 20 bp, Artificial Sequence
  sgRNA
  Emp2_9
gagcttccatctatacagac

SEQ ID NO: 18996 - DNA, 20 bp, Artificial Sequence
  sgRNA
  Emp2_10
agaaatgaacaggagtgccg

SEQ ID NO: 18997 - DNA, 20 bp, Artificial Sequence
  sgRNA
  Emp2_11
tttgccttcactttcatcag

SEQ ID NO: 18998 - DNA, 20 bp, Artificial Sequence
  sgRNA
  Emp2_12
accggccctgaagcgtttga

SEQ ID NO: 18999 - DNA, 20 bp, Artificial Sequence
  sgRNA
  Emp2_13
accgagatcaatgagctgac

SEQ ID NO: 19000 - DNA, 20 bp, Artificial Sequence
  sgRNA
  Emp2_14
ctactgcaagaaggcagcta

SEQ ID NO: 19001 - DNA, 20 bp, Artificial Sequence
  sgRNA
  Emp2_15
gatggtggagaggatcatgg

(The sequence listing continues in the following parts.)

What is claimed is:
1. An adeno-associated virus (AAV) vector comprising the nucleic acid sequence set forth in SEQ ID NO: 69,821.

* * * * *